United States Patent 8,781,750 (CELL-TYPE-SPECIFIC PATTERNS OF GENE EXPRESSION) - sequence listing, part 44

SEQ ID NO: 37824 - DNA, 400250 bp, Homo sapiens
gggaagggcgagactggagcagagccgctgggcgccggagccgaggcgagcgccgcgcgcaccactggtgagcccagctttcttccttgcctttgccccggattccggggcagcacgagagtgctggggaaacacccgggtagcggcagcagcgtgcggcgagcggctgcgggttcccccggcggcttctcctctgctcccggccccggggctccgcggccactgctgcccgctcagccgcagccacacctgcagcagctgccgcggcatctgcagcggggcgcctgctgcggagtcccgtgcgccctgcgcccgcgccgcagggccagtggcacggcgactgcgggctcactctccttgacttccatccctcccgcttcccggcgccctctttccctcagcagccccggcttggcagggcctggggcgggggagaccgggttggaggcggtgcgcccgggtggggactgcagaggggaaaagtgagggtgggcgcctgcgggaagagcgcacacccccttgtcctggcaccggcctccgctgtgccgctcggctgtctctcctgggcggcagcgcgctcctgccggggagttggagccggggttggcttctccacgaggggttcagaggccagcccatgagacatgaaaggggggaaaagttccttttccccctcggtggcagagagagcgtttaactagaaaatggctgtgcataggggaccgactccaggaaactggccactgggacccgaaagcccctgcgctgcccaccgggcggaatggagggtggtacgctagaaatgacatttgtgcggcgagaacagagctggacggagggaaggatgctgagacccatagaaacaatgaaaggtggtcttcacgtcggtgaagtggtgtagactacgggttcggggcaaacagccgagggagcatgggactagaattcaaaaaaataaattaatttggataaatcatatgtggagttgtcaccgaccgttctgtagtcaagttctgcgcggttttagagccacgactgtcacagacgtttttggatggattgagtggttgaggagggttaaaattgagaggagaataaggtcagtgtcggaagctccaactgggctctcggaggggacagtttgtttaagtccctcagtcactggctttacattgtgtctaattacttacgtgaaatacccaaaggattatcataaaatgatgccatcggtggtgtttgaattccaaggaatgaggaaactttgtgaggttggcatgggtttatcatttgttttaatatttcactgatttaaaaaaaacaaacacaatggcagtttgatctgttgtttctggagtttactctcttaaatcttgctttttttttttttcttgtcatggtttcagatttaaaatcttgtccccaaatggccataataatgcagagtattagaatttgtgtggctggccttttaggaacagatggaatccttgaaaggggatttcttcatgaacttaggtagcaaccttctcgttttcaacttgtagcttgtaagcaatatttgttcaacagttgtttatcataacttgcaacatcctagaaatggcatcgttcgtgaaggatggtatttgtggcgagaatggggaaacctccaggctggggaaatgccgagagaacacaggtggcagtagagtacagtgggttgatcatagggcggaaggtggtggggtacaagtacaagatttcaattgctgttctttcgttgtccatgtactgtatgaccccgaagtcaccgacagtcttcgtaaactggatgtaaccacgtctctagatatttgctgagagcctttgagagacgactctaaagttgagatcctttccacagaaggtttttaggtcctatgcttttattccctcttctaatggatacttttaactgaataaattcaccttcaaggagccaatgtgaactggctttctgaaatttttataaagtggtaattgaaaagctggatggtgaggtgggaggattgcttgagcctaggagtttgaggctgtagtgagctatgatcacgccactgcactccagcctgggcaacagagtgagatcctgtttctgaaaaaaagaaagcttgatgagctaaagtgcaaaatactggtgtttacacttagctggagtaatgtgaatactgactccaaaattacttgggaaaaaactattgcatatattgtaagaatccacatgtacaaacataaaatatttttaaactggtactttttgtcatgtttcaaccttttgatgactgttttcttttcctgccaccagaaaaacagcatatgaacattgaattcttttatttttctgttaccacaggaatgaatactgaaagccttgtcataatattagaataatgatgtgtgtggactatcctgagtactggatatctaaatttatcttttaagaaaaatggaagggagagcatcaggaagaatagctaatagatactgggcttaatacctaggtgatgggttgatctgtgcatcaaaccaccatagcacatgtttacctgtgtaacaaatctgcacatcctgcacacgtacctggaacttaaaagttgaaggaaaaaataagaaaaatggtatgtcgtgtctctgtacctttttcaatttcattttaaaaatagacaatacctggccgggtacggtggctaacacctataatcacagcactttgggaagctgaggcgggcagatcacttgaggtcaggagtttgagaccagcctggccaagaggtaaaacccccgtctctaaaaaaatacaaaaattagccgggtgtggtggctcccgcctgtaatcccagctactgggaaagctgaggcaggagaatcacttgaacctgggaggtggaggttacagtgagccaagatcgcgccactgcactccagcctgggcaaaagggtgagactccgtctcaaaataaatacataaataaaataaataaataagtaaataaataacaaaacaaaactggacaatacccttgtgatataacaccttaagttttccgggggcgggggaggggagcaggtgggacagacttttaggaaaatattgtaataagttattactggttatggggggaatacttattttcctacatggggttaggaaaccagcatttgttcagtgcctagtattattattattattattatttttgagacagagtttcagtctgtcacccaggctggagtgtagtggcgcgatcttggctcactgtaacctccacctcccaggttcaagtaattctcctgcctcagcctcctgagtagctgggattccaggtgcccgccaccacgcctggctaatttttgtaattttagtagaaatggggtttcaccatgttggccaggctggtctccaagtcctgacctcaggaggtccaccagtctcggtctcccaaagtgctgggattacaggcgtgagccatcacgcctggtctgttcagtgctttttatgtgtcctattatcctattaaggttttgtatatatcatcttatgctgtaagcatctatgcataaatgtcagctgtctaagaaaacccctctgaaaaggtagatgctcgtgatttcacagcaatagagctttaaacttttatcttatatgaaaatatctttaattgattccattattattcagtaagcattctcttttaaagcatctttgatttgttatttagaattaaatttgattggaactgcatatcttcagaatgatttgaatgttttcaagaaggttctatccagattttaaaactgttttgtgttcatttattttcaataatgttgcactaccaacaaatgaaattagatgtcagaagataaacccagattagccattttgattttaatgtgttattagtgcatattctgcatgctgatatgtgttgacggcatttctctcagccgaaatggtttgtcagaggcagagtaacagactctccataataaagggtctggggggatttggaggaaagactactaaccagggaccccaaagacttgcctttggggctggcttgtcccttacttcaattcactgtgttacctggaaaaagtcagttatgtctctgggcctgttttcccatctgtaaaatgagagagctgcagtcaccctctggttgtctatcgggtccttcttgtcccagtctagagatctgtgatgcagccattcgaggagagaggtcttcgtttaagagcaggggtccccagccccctgcttcggacctgaactggtcagtggcctattaggaaccgggccatagagcaggaggtgagcggcgggcaagtgacctttaccacctgagctccacctctgtcagatcagtggtggcatttgattctcacaggactgtgaaccctgttgtgaactgcacatgtgtgggatcttggttgtgcactccctatgagaatctactgcttgttgatctgagttggaacagtttcatcccaatccccaaccccatccgtggaaaaattgtcttccatgaacgctgtctggagaccactggtttagagcattatttggaggtgattttgtgtttccctgtctggtttgtcactgctttgtccaatgcccttctttttttgcccaattcctacttcccttatagttttcatttgttataaaatggttgtcataaaattaactttatggccctgccagtctagttagcagataaggtaatgattagatttgggtaaagtgtattcgacatttgaaactacttcatagcattttctgcggggagactttctgctcttgagcacacagatagtctgagaaagaaacctctacctaggctgcaggggagggggtcctgtgctttgcttcccaggcccacccttgtgaaattttggcaagcctttcctgtgtcccagcctttgtctcctcgcctcgatgagaaatgcagcccttggtctctggaatacgactttcactctcatttgacgttagccctgtcactgtgttggacagatgcctgtgattggctgctgcagtagcaggagtggtggctggtgaaatgtgtctactcagtgtcattagcaggatcatgagcttttttttcttttttcttggcaagctgcgatggggcagagagcaaaggaaaccaatcccatttggtgtttttagtgcattttgctttcaagaggctcacaaaactcagcctcattaacctttaagtgagtcagtgaggagttgttatcccattgaaataatttttaataaagggagagtgactctagttcctctaataaccaggctccagggttcctggacccctgttaggagtgggtcattaactccagacattagatgagagctgggagagaggaagggcatagagggtggaaggtcaagtcacacaactgggcaggaagtaagaagcttgatcagtttaaaggtattagagctctttgtgtgtagagttacaggagatattccctttctatataatttatttccatggtgtttgaatcttatcttgttttctgtaatggacgtatatttattttataatcagagaaaaatcccaatatataatttattgatatataaaatgtacagattcacatggacaaatacgagaagagaacatggaaagaaatgaatggtatagaaaaggatggattaaagcttttctttgttgttggttaatgacttgacagtggttataaacaaagtttaccagttctaccctctcttttcctcttgtggaaatcttgcaaactttgtttgctaggtaataactgaagttcccgaagtgtaactcattggcaagtatgcttcaggaatgcttagagtgggaggaagagtgtcgttttttttaagttgatgaaaaagaatgcagaaaccgggagcagtggctcatgcctgtaatcctagcactttcggaggccaaggcaggtggctcacttgaggtcgggagtttgagaccagcctggccaacatggtgaaaccccgtctctgctaaaaatacaaaaattagccgggcatggtggcacacgcctgtaatttcagctactcaggaggctgaggcaggagaatcgcttgaacccaggaggtggaggttgctgtgagctgagaccgcgccactgcactccagcctgggtgaaagggcgagactctgtctcaaaaaaaagaatgcagaatattggaatcgaggtagaaggaaaaacgtgtgtttaagagggtgagatagattggagagactttgcggaattccagagggtaaagggaaatgccattgttgaagaaggaaggcctggcattactggaggtatgggatgtgtccctgtcgtgtaagtcagagctcagtttccacacaatataaaagtaaatgagtatctcctatatgcagagcataatgttagccccacaggtcatttattgttggttagtggttttcactgttcttatcacaatgatgataatgatgtagtgaatatgtcataattgttcaaataagaagatatgtccttttctctgatactatgcctttctcatttttgggtaagattcttttatgatttgataggaatatttttatctagccgctgaatggtccatgaaattggtaagtctgggaatctgggcctgagatgcagggaggcctgcccttgggattgagttgagtcatggaggccaggccaacatgtggagtttgtgggtcagctgatggggcccctgggctttccaggaatatagagtcacccaaggtcctaggaactgtgaatgagctaattttgaaagtgccctaggagccagtgactatttttgaattatagcttgagaatgacaaggaaagcaccaagatgaaagatgagggtgtaagggaacagaatgggcaagtggttgaagtgtgaatttcagcaggtgaacctcaagatgtatcttgacatttgattctttgcatgcaggcctctttctggcaaaacaacactctttagcaattcttagttagtgattctaggaaatggtgatgggtgaaagccatagaacctagaattgtgtaatagccagcttggcccagacctctgcagtatcattccctccagggtgagccttgaattgctggaggaagcttcagaatgatttgctcatggaattgctgttattcacctttagttttggttgctattgtggggtgaagaaggagtgtcaaaacaataacaacaaattatttcctttttttttttttttttttttttttttgagacggagtctcacttggtcgcccaggctggaatgcagtggcttaatctcggctcactgcaacctccaccttccaggttcaagcagttttcctgcctcagctacccaagtagttggaactacaggtgcccgccactgtatccggctaatttttgtatttttagtagaggctggggtttcaccactttggccaagcaggtctcgaactcctgacctcaagtgatctgcccgcctcagcctctcaaagtgctgggattacaggtatgggtcctctccctggcagcatcctgcttgctctttggtgctggctctgttcttaccttctgatcttccttctgtttctcaggtagacttctgtcctgggcaagagtcgacctgccacattgagtatcacaatttgctaggtggtattgtttgtcagtggaagtgaataaatcagaatttccttagcatgagttaggtttcttgagttgtttcattcctgggggaactaataccgttaaaatttccttgacatttcaagaaatgatcatataccacattgcaaattttgaacacagcagaggcatgatttgggtgtagagacaccttgggaagcattgattcagactcagattcttcagattatctgatcagaacctcttgtcctctccaagaaccaaggtctgtgtataccttttccaggacactggtgaagagagacattcatttggtgacatccagaaacctcggcttcatttgttccttcctttgttcagcaaatgcttattgagtacatagtttgtgcctggcactgtgctaagttcaggaggacagagaggaatgtaccagaacattggttatagggtgctgcagtagaggcatgtgtgtgatgggagtggaggggaaggaaggctgtcctaatcctgcgagagtggcaagagctgtggctagtgactcctcatgtaaaattcccactacagcaaacccttcagctgcttcctttgtcatctttccttaactcaattttattcctgcctaccacccaggatttgctactccttttgtaagggaactcgggatttggcctttcaaatctctgtggcagtagttcttaagcaggacagttttgctcactggggaacatttggcagtgacattttggtcatggtgactgtggagggataactactggcatctagtaggaagaggctaagaatgctactaaatatcctacaacatgtgcaaggatagccctagaaggaggcagcaggggtttagtggtcaagtcccagtgctgctctgcaatttaatagccatatgacaaagggcaacagaattgtactttgacaacagaattacacagtgctcagtttgctcatctgcaaataggaatactaattgtgcttatataatatgattgttgtgaagatttcatcagtgaatgtataagggcagagaacaatacttgatgtgagataagaccttacttaacgagtatttttatttttagttttaaacaaaaactttaccttttgactctaaagagcttgagtttagagtatccagggcagttgagcttgtagccctacctgtaagtatgctttggtgtaggaaatggccatagtttttgtgtttttctagttcctttttgtccgttggctttatttcccattgtctcatctcttgagatttttaatagctttgcctttcatcccttttttcccagggacccaaatttatgcccttaatgagcttttccctagagggctgagaattatatttatgattttccttagctctgtctattttgggaatggtgagaaaatgggaagcgggtcaggggagatgttgcattacttcctgattgccatagctcccttctctgtaaaatcccgtgaaggattgagaggcaggtggtagtgcttgcttagtaactcttccctttacacccaccagctccactcccaagttgggtgcctactacttccaaaataccccgtaattgggtcacaacattatctgcctgcttggaatcatatttaaaaatcaaagcaaagatgcagactatgtcagcaggatttgaaatgtttccatcctctgctttgaggctttgcagaattattctgaaaacaaaagaaggtaaacttgttatcccaatgaggtggcagtttctatgtggcctagaattatgcctaatttttgcttgtaaaagggctcaaaccatgatcctttctgactttccacagggatgtgagcttttgtggacatcactcaacagatcagatttactgttgaattttcataacataattgacttggaaagcatttcattcagtgttttgaatggtgactagagagaaattaagaagctcagttgttatatctttcgaattcctttcccatgacacagtcatctctcccctgaatgagagcagtggcctcctggcttatccagctctgttcactcagtttggcttcccaagtgctgggcactgttccagatgccacacgtggacactgaccaggatggccactgcctctacctgctcggagctctgggtctatagagaaaggctgacagctaaggaatgaatgacggtactatgtgatacgtattactgggagaaatactcagtgcttcccagacgagcacttatcctgcttgggtgtggggagtgtgtggggcaaagcttccaggagaagggatgctaagtctattccacagtgcacctggacctctatcttatggttccttaaggcaccctgactctagctcccgcatggagcctgctgtttctgaatgcgtgcctccaccttccctcccacctcggttgcttctcaccttggaggctgcacttgcctttttcctggtctctttctgtttctactgtacactgcctccaaggtgatcttctgaaatcttctgcagatctgggcatatcatcccaactcttcaggggctccttgctgccctcaggatgaagtctaagctttttgatgaggcaccgaacatatttcatgatctgctttccatctcgttcttacgacatgccagattttctctggcctttcggcttttatcccctgttgccattgcctgcgaccatccctcctgtctgttctttaccgcctttcagtactccttcaggaagtagcttaaacattctctgatatctttatggttcttgcttggcacagcaagtgggaaagtggacaaggtggggcaggctcactgaaaattttcatttgagagagtccaggatgggtctttttgaaaagcatgtttgttaagataaaacaatatagagtaaaagtgtttggttcagttgtcagggatgtgaggagacatccatcctaggctgctgatttctcatgcttggagcagtttccagaaagatgcagtggggtttgactgaggagaggattgatggagctggagacataaagggagacggcccaggaaacagttcacacaggaagggaaccaggcctggagtactggggagaattggggcttacagctcctggaggttcctactgtttctgggaacttagactttggggccctcttgttagtggtctctgtattcgtggcatttctgctctccctaaatgagataggaagtatgaacactgaatatgttggatactatcactgtggagagggtctccatgttccagaattcaggggggaaaacctcctgcattcaaattccaattatttgagcagaaaatatgtgaatggggtgaaacaaaactaacactgactgttcttattcatgagacttggcaatcagatcactgtcattttcaaaaaatgcctcttttcctaagatttgagataatttctactaagaaaaataaaggaagttctgcattccatcagtttatgtatcattgtctcatgatcacagtcatctcctgctgacttgaattttatttcagtttaaatcattttcctttactagtactagatcctgctgttacgtgtacacgtgtgtgtgtgtatatgtgtatcttttttttacaagctgcaagtagaaataagaaacaaaaataaagtgaggtgttttattgaatttttatcttttcttcctcttagttctgaaaacatgtggattgcaagaaaaaccaattaaaaaaaaaaactgaggagaatgtggatttgtggcatgattatctttatttcctgtaaagaaaacaggattttcattagatcctgttgtgctgttctcccatgagagaaataataatgagatagactgccacatttggagtatatatacaattttgcttaacatttaaatgatttttatacgaacatttgtgaaggtttgaacgtttgcctacattctgcagccccagttattaacaatacagtgctgtcttgtcaagaacaatttctttatatcagcgaaacttcaggtagtttaaacttatttctacaacaggagagctgggtacagattttcattaaagcacatttattttacgttagtattgaccttgaaagttaatttttgaaatgctcagagatacatcattttgataaatggtcaagttaaacaacgcaatgtgaatgtttctatgtgatgcagttgtaaaaaatttgtttgcataaagccaaagattataagagaatgaatagaaacaaaaatagtatggtttcttggtgggattgtggatggttttgttggcgttatcgttcttcctccttcccaagcatccttagtgtttttatatcctgttagcaatgagtaaaagggaaaaaataattcttgtgtgttcatttttgtttcctctaaaggatgtgcatttcaggggtgtttctttaagcaaactaattgggaacaaaagagaactggcatatgctaagtgaaattagccagtcacaaaaggaaaaatattgtacaattctacttgtatggattgcctacagtaaatttagagacagacagtagaatggcagttgccagaggttgcggggagggaggaatggagagttactgtttaatatgtacagaattttagttggggaagacgaaaagttttgaagacgaatggtggtgatcattgtacaacaatgtgaatgtacttaatgctgcagaactatacacttaaaaatagttaaaattccaaggagaaattaatttgcactagactgaagctcctgggggcatgttctcacctcagtgcaatctgctgctgggtctgaagctccgaggagcggggaagtcacagaccccaggagctgggagggtatagacgccactcacctgaacttgacaccaagctactcatccagacaggtttcaaattgtgaattgggtatgatctatgtggggcgtatttttggccgtgtatattactgacttgcactttggagataatttggtaaaaatgaacttgattggcatattctcaaaaactgtggcacctttcccatttaccctgctgagtgtattctcaaagccaagtgactagctggcctaacctttttttcttgcccatgttgttctaaagagagcataggctttatctgtatagatctgggtttaaattcaggccttactctgggatagacggatataggtgggtgccctgaggtgaacagctttttctccctgagccacgtgtgcttttcccatctgtaaaatatctttagtgatacttacctggccatgctgtgggaagggtttactgtgataacatgtgaaagttcttgctatatagagcaagtaatcaagatatttagccacttttcatattttgtttcatattttggagcattttggatttcagattttcagattagcgatgctccaccttttgtaggtttaaaatgctttttattcaactacatggtttgggtttttattcttacctgtctcccctcccttttattatcttcagaaaatacagatgacagtccctctgtgtttgatacttcatattacagtttgataggcttgggaaatgtatcagttgggatttgattctgggtttgatttgatcagcgtggtaaccctaaacaagttacctcctttccctacaggaatcttatgggatcctataggaattataaaggtcagtgtttaatgagccctccgtataaggcaactgtcactgtgatgaatgcactgcatggattatctcatttgatgctgtacttctaagaggtagatactgttataatctcctaatacagatggggaaggtgaggcacactaaggttgtttgagagcatgcagctagagttgcactagatgaagattaaggggccagaatttgcaaaggagaaagcactcagtatatgtgaatacacatgcacagatacacacatgtacacacaccctgaatattttcttaaaacacaagagctactagattgtaacactgggaattccccaggacgatagagaggtctaaggaccaagcagtgtgagaaagatgtcagaagtgctacctgtatttggttgtaattgtagctactttgcattttttaaacaaagaaaatttctacatgctctatagagtgacacatacttttaaaggctgtaactggtattgcgatgttttctttaggaaaaaaaaatcagttatttctcaaatcattgagcattctgtcctgagaatgtgctcaggataatcacggaggataagttccagccgccaggggagagcaactggcagtctcaaaatattctctgtaaatatattagtctgaaaattgcattttaatgtggtgtactagtaaaatagaattttacttgctaaattattccatgttaatagtggtataatttttctagagaaaggctaattttatttaaaaaaaaaataggtcattcatttcttccaaaattattgaattatcctttggaataacctgttagtacttcctcttctatttcagtcagggtaatagaatacaagaaagctgattgaattttatgataagaatttgattttcagaaatgtcattttcaccacaatgtttgctttgaccagctttgctctatagtgcattttgacttgaatgctgtattttggtatttaaagtgagttaaggaacttacgtggtgcttttcaccatgtaggtgatgctagcgtaatatattcatttagttgtgtctgatgtcattcaaagagtaattcttgaaatgggttggttaacaatgatttcaaagagtaattcttgaagtgggttggttaacaattactcataccagatcatttccccaaatctgtctaaagggccaaattctgaattagcctattgtggaaatttctttgttttctagcatacagaggaaatcaggctgccagtgcatggtgaatgtatttctcatgatttagaagtgaacaaagtatagctgatgtagagcaaatgcacaagtttgccactagacaccggaagaacagtgaagctattaataagataaattcaaaacatacccttttacttgaataattatgtacctcatttatgtttttccttgaaggctagttattgtcaggttaatgaaaatttgaaagttgcatgtaatcttaaactgttagctgtagatcccaaagaatcacaagcttttaaaataaatgggcacctctattaagagtttaacaaataaaatatcaatgattataggttgctcttatcaaattatttaattattgttcattggtcaaaattcaaaggtgttgctttagtgcaagaaaaggaggtgcacaataaattagcagtgggcaggtaggcagattataagtactgcccttggaatttttttggtatattaactagcttctcttctagggaaagacttgcttttttatgacaaagaaagtttctcatgtatgttttggatgtgttccatttacctgtataaagagaaaccttgaatctcaaaccattaaccatttccttactctgaagggtagtttgagaactggcaaatcttgcatttataaggtaactggttaaagagactcgagttatctctgtgcatctctggagtcagttctattgagggcatctgtttgggttaaattgtgtcccccccaaaaatataacttgaagtcctaatacttcatatctgcaaatgtaaccttattttgaaaagggtttttgcagatgttaaggtgaggtcatactggatagagtaggttagggttcttaattccttataactggttttcttataagaagagggaaatttgtttttgttttgttttgcttatcctggcttgctttaagctttagaagaagagggaaatttggacacagacacacaggtagagtgtcgtataaagacagacacacagacacacagaaggaagacatgcgaagatggaggcagagactggacttgtgctgccacaaaccaagggatgcttggggctaccggaagcttgaagaaacaaggaagggtcctctcctgaagactttggagggatcatggctctgccaacaccttgatttcagacttctagcttctagaaccgagagagaataaattttggttgttttaagccacccagtttatagcagtttcttacagcagccacaggacacttaatccacaagcctttggagtcagtcggcctgcgtttgaatcctgggtttaccttctaatgctgtgatcttgggcaagttactgaacctcatggtgccacagttgactcatctgtaaaataggactaaaaagaacaccatcttcctatagttgttttgaggataaaacaatatatgtatagcactttgaacagtgcttgctgctattatatttcaaaaaccaattgtttcaaagctaaaaggaaatgatttttgataattctacaaatatctcctgaacttcctctttaatgacaggccatatgctagccagtaagtgtacatgttggcccaggcagacaggatccctgctttcctagatccatcaggcgcttattcctccattaacatgaagaagaaggacatgttccttgtggtagcattatgggcaagagctgggtgtagcctttcctgtggacctcagagacatgtattagggaggtggtgaatatggagccagactgcttgggtttaaattctagttcttatcagctctggccttggggagtgatagaatttttgaattatttctctacctccacatctgcaaaatggagacaataatagcgcctttctcagtagggttattgtaaggattaaatgagttaaaatacttaaagtacctagaatagtcagcacgtaatgaatattgttatattatcaaatgaaaccagaaaggcctcaaatttgtaaattcattcttttgcattttattaagtgtagggagttaatgcataaatcagatggagctcttttccacatagagctcatagtcaaatgggggagacttattcgtctacatgttagtgaaatagcatatgaacaaagaatatgggggtagaaagaagagtgtgattaaatctcctaggagtatcaggaaaagttgttttaagacgggttttgaaggttaagtaggagtttgccaggcaacaaaggcagaatagagcttagaggatgtgggaggaagcatctctaaagacgttggcaggtacagcagacacccagcagtcacagtgctacaagagtatagactctggagccaggattgaaattctgccagttactgttgtatgaccttgagtcactttcttgacctctctgtacctctgtattttcatcttttaagtggggatcacaggctttgggtagataacttggagtgcttagatcagtgtttggccaaaataagtgctcagaaaatactggcttttattagtgttattattcttgtatttgctattggaagataagcattaagaaggctcatcaaatatttttagttcagttcagtgattcctgtgggcttggataaatgctgcggccctgagcccatatactctcttgaaaacaactttcaccatttgaacactggtattaagaggggaaaaaataacatgcatattgttcgagcaggagaaaaaaatattaaaataggccagacattggcacaaagttgtgtacagattgctgattaggcaaaataaaaaaaataaaccggcatgttgagccaacatgattttgttgttaaatctggtgaaccacctgtatctttaagtgatcaatttaaagatagttttggtttgttgttaattgtcttcaaattacccagtgacatcagtctatgttcagaactaatacaatttaaaaaaactagtgctggagcacaccctccgtggtggtgccgcctcacttgggctgtgttcagagggggaaaggagtgtgtgggatttcttcggccacacatttcagagctatgatggcaaatgcatgatttcaactgtggtctcacttagttttatttttatttttgaagaggaggattatttccaattgtggttttctttgatcatgaaaggaaaatgtgctcatgatggcaagagtcaggcaaaaagagactaaaaagtaaacatcactagaaatttcaacatttggagataattgttaacacttgtggtcaaaccttctaagcctctccccacttgcaaaaaaaaaaaaaaaaaaaaaaagcagggggcttttctcaacgacaggaacagcaaagaccagcactggatgtggggcagtgaggttttgggggagatgcttaattgaaaattgttttggaaagttccagacaaaaacagcaaaatggtgataatggaatttttttgcattgaatgtgtttaaaatctttgcgataataagtggctgggcaaaggttacctatgtattcatccagcatgtgtttattgagtacccactaggtgctaggggtatagtaagtggacacaacagatgaaaatctgaactttggtggcacttgcacccagtgtcaggactatagacagtaactaaccatagtacgtaattgacattacaaactgtaagtgctgtgatgaaaaatgaactagacggggggatgggtgatcatgggatgggctaggaggggatgtgatttttttttttttgagacggagtcttgctctgtcgaccaggctggagtgcagtggcgggatcttggctcactgcaagctccgcctcccgggttcacgccattctcttgcctcagcctcccaagtagctgggactacaggcgccgccaccacacccagctaattttttgtagtttcggtagagacggggtttcaccgtgttagccaggatggtctcgatctcctgaccttgtgatctgcccgccttggcctcccaaagtgctgggattacaggcatgagccactgagcctggccgggatgtgatttttaaatcgaggagaggacttgaaagagttgagggaggatcccctgggttgtgcatatggcgggaaggggtattccaggagtggaggatgtcagcagggtgggaatgggatcagtgaggggaggaggagcagaggagtcagaaggatctaagggtagggctgaaggtgggaaaacaacctgtagggctgtttaggacacggaaagggccttgactttgctgccaacgaagatgtgaaggctccaggcaagggtaacaatctaacttacattttatgagggtcctgtggcagctgtggtgagaacagactttaggggtgctgaggtggatcagggagacctgtggcgaggctcttgtgtggtaatctggtttgggagaatggtggagaactggatgcaggtaggagcagtggaagtggcaagaaatgactggattctgaatatttgttcaaagtggagcgagcacggtttgttgatggactgaatgtggggtgtgatagaaagagaggagtcaaggacaattctgaggatcttagtcggagcagctggaagcaggaggctgctgtgaatggagatggaatggagctggttttggtggggatttcagccatggataccatcatttgaggtgtttcatcagcatcctagtggtgatatggactgggcagttggacttacgagtttagagcttagggcagaggtctgagaggggcctgtaggtttgggagtataacggtcacccagggagggggtgaagacggagaagacttacatagcacggtcaggttagggctggacagatgaggaagagctagcaaagggggcttgaggagcagtggccactaagacaggagtgtgacatcttagaagccaaaagaagaccatgtaattcaagggagaggtatgatctgctgggtcagatctaaaaataaatcacacgtcttcttaaactgtagtaattaaccactgaaaacttatgagtgatccaatattacgtaaataaaaaaagaaaaaattaaaaaaagaaaaacgagtgagtgagtattccttagattttatcttacttcaatatacagaattgttttaagtattcagtacaaattcctctgttctctcttcccataccctagaggtctcattgttaatagttaatagtctggataacctttcagatgtgtgtatttattttattttattttattttttgaggcaaggtcttgctctgtcaccaaggctagagtgcggtgacatgatcttacctcactgtggccatccatcctcagacgattctcccacgtagcggggactacaggcgcctgccaccatgcccggctaatttttgtatttttggtagagacagggttttgccatcttgcccaagctggtctcaaactcctgggctcaagcagtccacctgccgtggcctcccaaagtgctgggattacaggcatgagccactgtgaccggccccagatgtgtatatttattttatctatactgatatctgtatatctgtatctataaatgatctctcttcttttcttttttgagagagagtttcgctctgttgcccaggctggagtgcagtggcacaatcatggctcattgcagccttgaactcctgggttcaagcagtcttcctgcctcagcccccggagtaactgggaagacaggcacacaccatcacatccagctaattaaaacaattttttttttttttgtagagatgcagtctcactgtgttgcccagaatggtttcaaactcctcaaagattgggctcaaagttcgggctcaagtgatcctcccgccttggcctcccgaagttcttggattacaagcttgagccactgcctggcctcaatttcactcttaacaaaatatttcaaatatacaaataatctaaaaagtggggactaatgttctagatactgatattcctaccacacccatcagaaaagaaatgcgaacactgttctagatgttttcagatttatctttacttctccattattgcagttatttttactatttttacttgtgccattcaacatacaccctcttacaactacttgctagtgtgagtgcatgggtgtgttttctctctctctctccctctctctctctacccagactcttctaccctgcctagggctatcctgtgtttttcagacagttgctgtaacagcagcagtggtggttctgtatccaactgggtcctgggagacctgcagaagtaataatgcagaaaacagcagcctccgcaaggaacatgttaagctcactgacaaaaagtagcttaccttggggagtccctggtttccattcggagagctcaggagggcctgtgggagtaccatggtctaggggtaggactgaggttttggtgcccttcagttctttctgcatatcctagctttgtcaccagctgtgaccttggacaagtgacctaagctttatgcatcccagctttcttcatccagaggactgaaaatagtaattgcctccttgaaaggttgttgtggggcttataggaaataacatatgtaaagtgcctaagaggcctgtcacagagtatgtgccagttacatttgttctttttccaggtctttatcatcttttccctattttactgttaagttagttggtggacaaaaaagattgagaggtacattatttaaataaatatgctttggttatctataacaggatattgaagttagacaattttagcgcataaaataggtgaactgaaactagagctcaaccagtttttgcttttgtattttaaaattttaaatacagtttcttagccagtaagcctttaggtttcactgtgaacacgttcattgtcaagctcactactagaaatcaaatggtgcctttaacctgtggctctcaggccaccccacttggcgagtgacttggattggtgagaaccctcttctttttataaaaaagattatttaaaaaaatcatttataaggtgtacaacatgatgttatggtatgatacatagagagtgtaaaatcattactatagtgaaccaaattaacatatccatcatctcacagttccccattttttttgttttgtttttgtgccaagagcagctaaaatctgttcatttatcaggaatcccaaatatagtacagttcgttagattcctagtcttgttcatcctacatatctgctactttgtatcctctgaacctatatttccccacctcccccattccattccactgttttattctctatctctgtatgtttgatattaaatttttttttaagattccacatataagtgagatcatgtggtgtttttctttccgtgtctggtataataccacttagcataatatcttctaggttcgtccatgttgtggccaatggcaagatccccttttttaaggcagaataatattctgttgcatgaatatatcacagtttctttatctgttcctttgtagatggacacttaggttgtttccgtatcttggctattgtaagtaatcctacaatgaacatggcactgcagatatcttaatgagatggtgatttcatttcctttgggtatatgcccagaagagggattgctggctcctatagtagttctgttttgagtttctttggtaacctccatactgttttccataatgactacaccagtctatattcccaccaacagtgtacaaacgttcccttttctccacaccttcaacaacatttgttatctcttgacttttttgacaacagcattcctaatgggtgtgaggtggtacctcatagtgcttttaatttcaatttgcatttccttgatgattaattgatgttgagtttcttttcatatatctgttggccatttttatgtcttctttaggaaaaatgtctatccaggtgacttattcattttttatcaggttatttatttttctactattgagttgtatgagttctttataaattttggatcgtgaccgccatattaggtatatggtttgcaaatgctttttcccagtctcataggttgccatttcattttgttgattgttttctttgctgtgcagaaaaggttttgatgtagtttgatgtagtcccatttattaatttttgcttttatgacccaggcttttggcgtcatatccaaaaaatcattgccaaggccagtgttaaggaacttttcccttatgttctcttctgggagtctttatggtttcgggtattatgtttaggtcttttatccattttgagttgatttttatgtatggtataagataagggtccagttttgtccttttgtgtgtggaaatccagttttcctagtactgtttattgaggagactatcctttccccattgtgtcttcttagtgtgcttgtgaaatattagttgactctatagaaccatcttctttcacacttggatttttaaaggagggttgggggagaaataaaaataaatgaatgcgtagaaataaactttaaaaagatttgatagctgttgatgttgtcagtggacaccaggttgggcaggggaattagattgttgcagattgttcataacctagccacgtggttcgattatgttaagcacataggcattaataagggggagagaaggctgtttattggttaaagtggacaaaggaggaaaatacatgtggtagaagttgtccaccctcctcatcctccccactccagtcctctggtcccatgagtgaaatattttatcagtctgagcgttctccttcctggataggcaaggctgctgtcattgagatgtttttgacctcttgggtgtgacctgactccgctgggtccctgccaagcttctcctcagagagaattgaatcgatcaggttgggtctcaaagcatggtccacatgggaaatgatgggccaaccacagctctctggtttttcttctgctagcctttttgctgctctcgttcatcagaaacagcagaccagcgttggtccatttcttcaaagctccttaatcagaagtagaggattagctttctttggcttttttcttttcagatcttcttaaagtgttttactttgtatggcgcaaccactttatgttactttggaggtaaagtttagctgactccaggagtcaagccgtgtttttatggacaggtatgtgtgattagtatgaagttgtcttgtgcataatctatgcaacaaaatacacttagtatccaaacctaataatacaaaggtggatgcatatcccttttccatgctggatacttgctcttcttttcctacctcttctgaggagataatcacagaactttaagaaatagcctttgtagctgggtgcggtgcctcacaacctgtaatcccagagctttgggaggctgaggcaggtggatcacaaggtcaagagtttgaagaccagcctggccaacacggtgaaaccctgtgtctactaaaaatataaaaattagccgtgtgtggtggtgggtgcctgtaatcccagctactcgcgggctgaggcagagaattgcttgaacctgggaggtggaggttgcagtgagccgagatcgcggcactgcgctccagcctgggcgacggaacaagactccatctcaaaaaaaaaaaaaaaaaaaaaaaaaaaatagcctatgtaggaaattcttttgatatagtaagttttagaaagcaaatatactacaatgaaataatactaagcagtatgttaaactatgggacatttttatttcttcaaggattataacactgggggattatcaactttctaatgaaaaaaaataatagcacgtgtaagattggacctatttggataattaaatattaatgaaagaagatgtgacttttgatttttagccatgaatttttaagggacttctatttgaagacatgctgaattgtttactaaattcaggaaacagttacagattttcaaccctgtgctgaggcaacgtgcaggtgcttaggagacaaaagagaatgggccccaggcctgtctcccaggggttcacagacagtaagtgttatcgtggagaaacctgttcatgtaacacagaggagggatcagttagttttgtctggggtgttagagaaagaagaagaaaggaaatgacttactatgtaaggaccacagttctatggctgaagaatctgagccatgtccagaatacttagctaatgacttcctcaggagagagaagtataccgctatttacttgtactgaggactttaatttgttgagatgcttttattgcttgattttctgaggttaggctgttttattgttaggtagcagcagccagagagctgttttcggaggggatttactgtcactgtaatgctctggggctgggagacttttatttacccattaaccttttacattaagggaaagcacacagatcttaggtgtactgcttgatttttccatatatatgcaactgtttagccattacccaggtcaagatagataacattcctatccctcctgtggccttcctcctgccccttccagacagtacccctcccattgtatctttatcactgtaggcaagtgttccctctttgaacttggtgtaaatggaatcatgaagtgattcagtatgtgctttcattctgaccacgtctgtgcaaccatccacgttgttgtgagtagcaacagctcatgtttttcccactgtatatattatatgaatatacttcagcctatccactttactgttgacagacatttggttttccagtttatggctactgggaataatgatgctatgaatattcttgtatttgcctttggtagacacttaccaggcatttctgttaggtatattcttaggagtaggattgctgaattgtaaggggtgtgtaggttgtttaataaagtcttccaaattggtggttccagtttacattcctaccagccatgtatgttgccaccactttttctttttttgaattgagacggggtctcactgtcacctaggctggagtgcagtggcatgatcttggctcactgcatctgtgcctcccaggctcaagcaaacctcccgcctcagcctccctagtagcccagactacaggcacgtgccaccacaccctgctagttgccaccacttttaacccggttagaactgcctttgttccttaccttagttcacataagcatccccacacccacaggcactgttttagtctgttcaggctgctgtaacaaaatactctaaaacaacagacacttatttctcacagttcgggaagctggaaaacgttcgagatgaaggtgctggcagattagggtcctgctttctggctcatagatggccatcttctcactgtgtcctcacatggcagaaaagggccagaaagctcgtagaggatcttttataagggcacaaatcccatccatgagggctgtaccctcgtgatctaatcacctcttaaagaccccacctcccagtaccatcacatttggagttgggattccaacacatgaattttggaggggaacaaacattcagtctgcaacaggcaccacagctggaaatcttcctgcctctttaagattcttttcttttacttcatggaggtagcttgtcaatagggctggaaatgtctctggaacctgttttctttttcagtccccagatgtcttcatttttttctcaccttcatgatggcaaagcctgctaattggttgttctgtctctagattttcttttctacaagccaacctccacatgttcccctagaatagaaagatacataactaaaagcacctatcacagtttataggcactttaatgtgaattgaatggaaatctgatttaaaactggctgtattatacagtctaaactcttttgcataaatatgtattggaaagagttaaggagtaatgatttttcatgctattgaggatctcatttgggaaaaatataaatatataaatctcaatagatgtttatgtatgtatacacatatatacatacatgcatacatagaaacttttttcctttgcctctgcagtgagatttggattacaaaagaagctaaagtacaaatggataactcatgtcacataaatgaattgagagtactgtctgtttaaggatctttcagtttagattttaaaagttttggttgataataataaataactcttggttggcacttaacagtttatgaatgtgtatgtgtgtacataaatgtctgtgttgcttatttaattcttacaatgaccatgttcaatagatagtattacagtattcttttttgcaaatgaggaaatagggtctctgatgagctgaacagtcgtccagggtaacatgaattgtacttgatggtttggtaaagataacaaagccttctgaattcatagcccatggtcattaaattcatttatctcctatctgtgtatgacttctgcagataagctctgaacttaagtttgtgtgtataatattagcctattggtacaactgtgtattattaatgttgtttgtttttctcaaatttaaaagactcttatcttttttcatgttataaaaatggcatggtttttagtaggaaacacagcagtaaataacaaagtataaaaagccattttttaaaaaatcacctgaaatcccaccattttgataggtgttacattttaatatttggcaagtaaaggactgctgccttttgctacctgagatcttattttgtatcattgtatcttcacttcattaggaaaacagttcttacagaagctcatctctgacttgattttatttctgtgctggggttgtttgctaaaacttgaaataatcttaaatgaaaacacaaaatacaaaatagcattctcatattgatgattcctatatgtgtgcagaagctaggaattttagtgataaaattaagttctttgttgctatgcatcttaaatatttgtttgcatttcaaaggaacatatagtacagtcaaatgcatggatttggagtctgacaagtttaggtatcagctctggcttcataatgtcctagttgtatggcattgagcatgtttatcgattaatacctacctgatagggttgctgtgaacacccaacagtgcaaaagtagttgtagttagtaataataatagtgctgtattaaatgcattttttactcatgatattttcaatttatggtgggtttattgcaatgtaagtcaagggtatgggtaatgatggtgctttatttctagtcagcagtaatttgtttccagataaagtagagatctgaactacaacagtggtaatactgagtgtttccataggattgtatagactctgcatttttttgagtgaaacagttgttgacatagtgtaagggttgacacattgtatttttgaacttcttggaatctgcttaatggcaaacaggttgctgagaaccgaaggtcttagctgcaaagtgagcatacatacacagccctgcaaagctaggtgcataccagacaagtgaataacatactaattattatcctaccttggtagtaatagaattgtagcttcaggcactatgtaagacctagctttttgagctggcaaaatagtgattactatttttagttcaatttctgctctttaaaaaaacatagtatactacttgctactcctggatggttttatgtattttaattaatgttatcttattgcatttgtaccctgaggctgctttagtgaaagatataatttcagaaggctgatgaaattagataggtctgactaggaagactctgttattcatatttatggttataaaatatttcgggtacatctgtgtaagacattcttgtgctataaacatacagacactgttgtgaatcaatttgccttagagtgtggtagagtagttacagaccagtatagtagctctagtgtgggggtgatttgttgtttttgttgggggtgtttttggtattaaacatgactttacatttttcacttgaaatctcatcgtgcagtgctgtgtaaagaaatgaaagtgattctaaaccaaacacacacaacactcctcagctctattactttatagtcaggcttaacacattctgatggaattggcatgaagtacgtgaccaggtagaaatcagctttatttggtctaaatgactagccggttatagggcatggaaaatctattttaaatcactttccagagccaaatgcaattaagatgttgcaataaagtgaaggccaattctctgagaaagaaagaaatactattttgaatgaaaaaaatactattttatttgacatagtcaataaagaagaaaagctataataaactatttataatgataatgtgcagagcagagttttctttgaaatgggagttaagaattacataaaggtgtcacagagtgattgaacagttactatacagcatattccctaccttaaaggttagggtcctgaaaccctctttatggtagatcttgtggttgtgaaatttgaaatcttagggggaaaggtcatgggcatcaagagaagaagtgaaccttaggaaaacttagtacacattgtttttaagattctctgaaatcaatagcaatgtgcattttagaaacctcacacagcttcattgtaatgctgtgtattccttttgctttgtgatacataataaccatattaagatgcttttgttgtatccaggggccagtcatctatccaaatacttattgccctttcttctttctgctctccttcatccatccatatatttccattcaatcatttctcctttcctgcgaggtgccattttaggctttggggatacaatgaaacaaagttcctgccctcagtaagattacactctagtgaagggagatagataagtgtctcaggttggattctccacaggcggacgctgaaatggagtttgggaagcaggatgtttatttgcgatcaattcctgtgaacaggaggtggaaggagaattgtgcaggggaagaagctgagctgtgatgcaggtttggcggagtctctgccaaccttccagagagctctgcagtgaatgtcacctctcagagtgtcccacacagaggtgtggactaccctgggaaggatgtgacctcaggcaggtgaggctgcactctgtagccaaggctgaccccaaggaactgagtcatggacgctgtttacctgcatttgctcagcaagttctttctttattgggggatctagcaatgcatctcccagtctgccacaataagtacttaaagtacctggtggtgacacacaatggagaaaaataaagtggatgagggggacagacagtgttggagggaggagaaggccttaaggagctatttaaacagaggtctaaaggaattaagggctctggggcagagtggtctaagcccagggaagagctagagcaaaggctagacatgagcctggcctgttggaggaacaataagggggccagtgtgtgagctagggtatgagcatgtagggtcttttggccattgccttttatcctttatgaggtggtgtattactttgctagggctgctgtaacaaactactataaactgggtggcttaacccaggggtcttctacccccagccagggatactggtctgtggcctgttagcaactgggccacacagcaagaggagagtggcaggccagcgaatgaagcttcatatgtatttacagccgctccccatggctctcattaccacctgagctctgccccctgtcagatcagtggtggccttagattctctaaggagcacgaatcctattgtgaactgcacatgtgagggatctaggttgtacgctctttatgggaatctaatgcctgatgatctgtcgctgtctcccatcactcccagatgggaccatctagttgcaggaaaacaagctcagggctcccactgattctacattgtgatgagttgtataattatttcattataaattacaatgaaataataatagaaataaagtgcacaataactgtagtgcgcttgaatcatcatgaaccgccccctcccaccccctgcaactcccccagtccatagaaaaattgtcttccatgaaacaacttcttggtgccaaaaaggttggggacaactggcttaaacaacacaaattattgttttacagttctggaggctggaagtctgactcaggttattggtagagttggttccttctgaagatcatgagagaaagagaatctgttccatccctctctcctagctcttggtggtttcctggcaatatgtggcattccttggcttatagatctctgccttcatcttcacatggtgttctccctatgtatgtgtctctgtgtccaaattttccctttttataaggacatcattcatattggaattggggcccacctaaatgacctcatcttaactaattacatctgcaatgacattatttctgaatacgatcacattctgtggtactggaggttaagagtgtaacatatgaatttttgagggacacagttcaacctgtaacaggtggaaagccgtcaatgggttttgagcagaggaatgatgcaatccaacttaggtttataaaggatcactgttttgtggagaatagaatgaaaggaggaagcagagtcattgtaaaaagccaggcgagacaatggtgattgctgggccagggtgctagagagggcggtggtgtggacaggttccagatataaggtacagctgacagaatttccttataaattagatatggactgagagagagagaaagagaatgtaagcatagacaaggatggctctcctgggcaactgcaagaatggaattgccatttactgagatgggcaaggtcttggaagaagccagtttggaggtaccattaggagtttgatttaggacttaggtttctgatgcttcttagacattggtatggttaggctttgtgaccccacccaaatctcatcttgaattgtattccccataattcccacatgtcaagggagaaagtaggtagaggtaattgaatcatgggggtggtttccccatgctgttctaatggtagtcagtgagttctcacaatatctgatggttttataaggggctcttcccccttggcttggcacttctccttcctgctgccttgtgaggaaggcgccttgcttccccttcaccttctgccatgattgtaagtttcctgaggcctcccagccatgctgatctgtgagtcaattaaatgtctttcctttataaattacccagtctcaggcagttcttcatagcagtgtgaaaacagattaatatagctattcatgtgatgatattgaataggcagttggatatatgagagattctggaatccagagttcaaagaagtttcagctggaaatgtgatttgaaaggcagctatgttcaccactataccaccaatactggagatgtgatttataaatcatgaatttgtagaaggtgtttgaagctgtgagattaaccaaggttaccttggtgagatcaccaagaaggcaggtactgaatgttcgcaattagagtaatcattcagtagaatgaaggttcaaattgaccattggctttggcaacatggaggtcattggtgatcttgacaagcagttttgatagaatggtaggaatgaaagcctaattggagtgagcttaatgggaggagagaaatggagactgtaaatatagacagcccttgactttacaactgtctctcccttgtttatcctggagatgcggagtcactaggatgctagagatggaaagatctttatgtgaccttcttagaagggaagttaggtacttctcacgcctccttttctgttacaaggttatttaactctacagagtaaagatggcttcatgccaaagtatgttatggtagtccctttcttttttctttttctttttttttttttttttttgagacagtttcactcttgttgcccaggctggtgcaatggcgtgatctcgactcaccgcaatctccacctcccaggttcaagcgattcttctgcctcagcctcctgagtagctgggattacaggcatgttgccaccatgccgggctaattttgtatttttagtagagacagggttgctccatgttggtcaggctggtctcgaactcctgacctcaggtgatccactctcctcggcctcccaaagtgctggaattataggcgtgagccactgtgcccggccatgctagtccctttcgagcaagttctagctcctttcttcctaacaggatagtatattaatactgagttcttaaggagtaagagtgtgttaggcttacatagaattagtcatgaagtcataagggaagaaatatttgacctaaaaggatgtttactgcgattcacttgcatgaataaagaaaatgaagaaattatacataattagctcttgggataatttacatccaaaaacaattttaagcacgtttcaatttcttctttcacgtgtcttaaaatcaagagttataagcaaagtataattaacccacttgagtttcatcgtctcccattatccaaggtaagggagcggaagacccaaaaaggcaaccgaaagagtagcgtgaaacaaaagggcccttgagttgtagccttgcccctggcaacttccccaactccccacaatggcttggtgaaacagtttaggaaaaactctgtgcctgcttggaattgaatgtgggtgaaggtgtgaacttaagctttcagaaaacctgtgcaatttcataatcaaaggagatattaaatgtttagtttctacaaggccatattagctcttaaaaagattttttaaatgtaattgatgggattaaatttgatcactgacgttcctgctcttttgaagagagcacctattctgttaacccataggattcatttgatcaaatgtgatttttttttagatgaaagggacttctttcaggggttcattcttctccactgagttcacagagggaaaaaaggaaggaagtagaattaaactatacaatgaaaacagctttggatttaatacaggagaagcttttcttaatgaggcctcttgaggatggtcatagtgtaggatttgtaaatcattcccttgtagacaatcaaggtaaagtgatcaggagtccttgaaggtgggaggtcattctggtccactggaagacacaagaaaacatgtgcccacatttactgtttagtagtttttgtttttttgttttagagacagggtcttactctgtcacccaggctggagtgtagtggtgcgatcatagctcactgcagcctcgacctcctgggctcaagtgatcctccagcctcaccctccctctgcccccccatcaagtagttgggactacacgcatgtaccaccactatgactggctaattcaatttaatttaatttttgtttgtttgtttgtttttttgcagaaacaaggtctagctaagttttacaggctggtcttgaacttctagactcaggcagtcctcccgtctccccctcccatggggctgggattactgacgtgagccactgtgtccagccaagtttactcttaaggaccctgaatcaagcacacataaccccaccttcatgcaggtttactttgatttattcgggattcacaggaccatggtgtttaaaagcatttgtgtccttgtaagagatagcgaggagggggtcaggcatgctgccttacactgatggaagctcttcactaacccaaacctttgcccacagagacaaatgatttctcaggtttgtgtccattctgagagctgttttgttcctgtactttccctttttgtcttatctgatgttggtctcttaaattcagcattgaaatttaagtatgaaagaaagagaaggattagttggatgttgtttgtattaaattctctaatgagttaacacgttatcaagtaccattttgtttgctttccctgaggttttaaaatattatttccaagataagattcccaggcagctgtcttccttacttctgaatttatatataatctagtgttattaaccctttgtagttcttttttatgccagtatgtgtctgttttgggaatttttaaataaagccagctgtgttaaatattcacagaatcgattttcacttgcttaaagtctttagtgatttatcttcagggagtattaatacggcagtaattctgcattacatttcttgtaccagcatttaattgatgctatatttcatgaggattattgcaggtttattgctgttatatttagagttgtggttctgggctggtaatctagaagcgtgagattcccaaatctgttgttccattttaattgtgtgttcttttgagctgacaagtttgagaagggctgttaactatttaacagacctgatagataaaaactattttagtagagtagacctggggatactttacctgtgtatgttgtgtgaatctatttttttacatgacggtagatgaattgaatctatacatatttttaaattgatatatatgttgatatgatttatgttaggtgttagtgtttgatttacttcccaattgaggtactcggacatctcaggctgtgtgaatggcagcagttgtattgtgttttaaaacaggttaatttacattgttgttctctttgagaaacttcagtagtttctcagaacattagaacacagttctccttggaacctcacactgtatgacacttggcaagtgttcgtcattgtattgaaagaacaaatacatgtctgtagaacagaaaactttttgttgagcgagtaaatggatgtctgtgcaatagacgtgacacgtatacaacacactggtggaccctcaaggaagaaggagagtttgcccatcaatcacagtccttaataaatatttgtttaatgaatgaaaagtaggaaaagaggtaggaggcagttctgggtgggtggaagggaagtgtaaaaactgcagaggcagaaaagtacaagacaaggttatggctcaagtatttgtattggatttaacccaggcagcagaatgttctgaaaggaaccctagactaggagttaacacacttgggtctttgccacttattaagaatgtggtcttgggtgactcagtgaacttttgggccttggttttctcatctgctctggctttcttccccaaaagcttactatgaaggtcagatgagaaaatttatgagagaatgttttgcagaccctcaagggacatccatattagatggtgatgtgagccttgatagaagatgaggttcattcatccaacaaatgtttactgagcacctgcctcgggccatgcactgtgatagatggtggcagtacagtggagggtaaaacacacaccttatctcctggcttttgttctagtgggtgagaaagatatttatcagtcactcaaatagagaattacatactgttgtaagtactttaaagtacagggtaccggaggctccattctagtctgggtgggtttgaggcttctcctgtagatgtatgtagagattttaaagatccttagtaggagtgacttaaacacaacattgctttaggaagtttaatctatttggctacctgtaggatagattgacaaaggattggagtctggaagaataaaaaagttactgtgctgtatatatgtatatttttctttacttggaattgtcttgatgttttgtttaatattgatacatgtgggtaaggttttctggagtcttgatgtttatatggtttgcatttggtgtattagtgaacatctatttttagttagacatgaagttgtttagcataaagtgttagtaaactcttacgtaggttcttctgcgtgtgagaccctgtacttagtgcttcatatatacaggttgagcatctgtaatctgaaaatctgaaatccaaagtgctccaaaatctgaaacttcttaagcactgacatggtgttcaaaggaaatgctcactggagcatttcagatttcagatttttggattatggatgctcaaccggtaagtataatgcaaatattctcaaatatgaaaaatctaaaacttgaaacacttctggtcccaagcattttggataagggatacttaccctgtattaactcatattaactcccaacaaccactgttgagaccatgttattcaaccatattgtcctcattttacagacagggaaactgaaacttcccaggctgtgcagctagtaggtgggacttggacccagaccaggtgtgtgtccatcgctgcattatcatctcttcataaaacaaagaatttaatattgtatgaacgaagataaggtaacctttaaataaccactgtgaatccctttgtttcaatatatttcattcctcttgatttttaaaataaatatttgttaattacaaaattaagaacaaaacctattttaaagcaaaatattttttatgttacagtttgcattttacaatgcagaatgagaaaagcatggtagttcttgatactgctttcagggctgcatagctccccattttttccctttgtttcataaccagaataactgtcagctgagtcagtgagtgtccagagctgttaactgtggtagatcttgtttgcctcctgtctttcactgcccagaaaagcttcaattctgtatcatctgtgcattttagttctagggcagaaaagtcttagagcagatagcatctgtggtgtgtacttaaactgaccctctgaattcacagatgggaaccacaaaatgaaggcaaccactttccatggtgttaattattggcagagccagaaccaaagagcaggacccaggacatcagcccagtttcccccatggcctatttagacattgctcattttcatgcttttttttttttttggtacactattttcattcaattgcatttgtgtaatatatttgacagtgaaattttgcattaattcagctaagtcctgaagtagaggtgtaaggcatgctctggctgttttcaaaatgagttcatattcagattatttcaatttagatattaataagatctcaaatttttttcttataattttagtttttgttaacccaaaatgctttatgaaataagctgtcttgtgttattttccctcattgcattagcttttcatttgttttgcttctttttcttaaaactttgatcctaaactatgggccagtgtagataagctacaaaatgtctgagttcagaattgaactaaacccatggttttggattactttggtttacggccagaattactgacattttttgtagtgatagtaagagaaaatgttttgcagtgtctcataagggactttttatatattactttttgattctgcttttgttttttgacctttgggctggtaggtgggggccaagcaggattgggagggggaagaagctggaagtatgctttctgtctaatgtaacccagcttgtcctctgagggctctggtttaatttggttaatgctgtaaactgctaaaaaaaaatacattctttatgggaattgggtgtagatataatgttactaggaaagagacaataagcttgcagttttacagatggtctcattttctttatttggttagaatctctttttggactctttatgctttctgtgattggtgtgagtctttctgtttttattttgtccgtgttttattaccaactggttatatttcagtaacagagccagggggaccagaatctcttaaatattctgtacagaattttgtgtttagagtgtagaccctcttatctgggaatatcatgaccagcagctggttagttatttaaggtggagaaatgtgaaaaatgttacattcatgtcttaaacattttatttcaaacatgtttgctaatttctgatatggggccaagtcctgataagtggcttccatgttggttttgtacataaacttcacctatgatgcatgatctacacagttttcagtttaggttgctttaaagtaagaactttaaaatacttgtgaatatcttgagtgtagaatcctagatttttatgatttgccttccagtcttttgctgttttcttcctcacatctaatatcatggcatttattttagtgtttaacttttattgaattattccaaatcattcaaacattcaacttcattttcgttgaaacattaatttatctgaataaaaaaattaaaaaacattcatttctctgaatattgtgtttatatacaatttactatgtgtttatatatttaaattgtaagaacaactggtgtaaataggaataaacatatctgaccatagggaatgatacagcttgattggtgggagcagatcactactttttaatctgtatgtgatgaaaatctagtcttttttatttccaatcttttgtggacctgtacttttacttaaaaaacaaacaaacaaaatacaagccttattttttaaatttatttttaaaaacgacagaaataaagttacattttaataaatgtagttggaaaaaacagaatatagggaagaatttctaaatgtgtactttgaaagtgtacatgtcttggcaattcacaaagaattactgttactcttgttaatttttattccatttataactaagcaaaaagttatgagtgaaataatgattcttcatattaaattcctctgtatatactttgaccaaactctatgtatatcaatatttagagtttttaatgtcacaaatgaattcccatcttgcttgttaacctatctaactaggctgggttggtgacaagcttgtcttgaggctaatgtctatccaaactatttctagttttccttaaataatactcatggtagaggaactgatcttatagagggatgtggatgataatgaatgaaaaaagacattttaaaggaattctggaacgctcaggatattcatttttaattttactccaaaatgatgtaagtgatgctatcgtgtcaaaattcatcttcagtccttcttcagtagccagttccaacaatatatcctgtaaatttatgtttaaatttaaatgaacttttagtgttaagaaatggattcctgattttaatactttcgtactgcagttgactaaccttaaactatcatatgtggtcacgtagttcttcagagcttgactagtaggtagctggtgctgcatgtacctcacaagatcagcaacactggagttggtcaatgaagcgagtcagatacttaggcccttaggtgatgcaaccatgtctaatggctctgtatgtttctaaatgccttctcaccatttttgtacttacctcatgggcaactggtaataaacagttggcagactagcacccacctagaccacacattgagtagtcttgtgctcaggtagagtctcctactagttatgagctgctagcgtgctcaaacatcagtcatgttctgatgtaggatgcgccggttaatttggcagggtggttaagcagagatgagttaagggagcctctcttgtgtaaacattttttttctggggagcaggtttatagctttcttgagattctctgacttaaaaaaggttaggaactgcactatcagatatgtgtgtgtgcatgcttgtatgtattatattaatcccgtgattgtgaggccaatagaagtctgcttagttatctcttaagaaatctcagtagttgattcttttgtcctttgcctgagtatattgcctgggcccaggaaaatttatctgctattgcagtttaacacaccctgaaaaagtgatcagcttcggtgtttcagtccacagttacctgttaactaagatgattttaaacgagaatcgtgtgaacagggactacctaggttagctgtgatttatcttgcttttgttcatagctgagatagaagtcagtttttcatgttttttaagtaatcatgttcttctccatctttaacactggggtttgcatgtagcttctgggtattgtggcatataatacttatacagtcatgcatcacttagtggtggggatatcttctgagaaacatgttaggcgatttcatagttgtgcgaacgttgtagagtgtacttacacaagcctagatggtatagcttattacacacctaggctatctggtatggcctattgctcctaggttatggacctgtacagcatgttactctactcaattctgtaggcaattgtaacacaatggtaagtatttgtgtatctaaacatatcttaacatagaaaagttatggtagaagtatggtattgtaatctaatgggaccaccttgtatatgcagcctgccgttgactgaagtgttgttatgtgcacctagaatgtagccatttccgtggagacattttttacagccaggtacttctctgaagtatagttttctgcctaagaactaacacactcttgaattctccagtttctcccctggccgataggaatctgtctagttatctctgaagaaatctccgtatttggttccttcatcctttgcctgagaatattgcctgggtccaggagaatttagctgctgttacagtgtaacacaccctgaaaaaatcagtttgggtatttcaggcccccatttttatgttaactaacttatgattttaaatggtaatccttctgtgaacagggactacttaggatagctgcgatttagcttgcttttattagttcatacctgagataaaagcgagtttttcatgttttttaagcaaatgaaattttagctacagttgaactttgttcccatggaagttattagtagagtctttggtgttggagaaagagtctgaatttccttgtagtggtaataaccagaattttgaaagagaagatgacagcgaggctgcagagggaagtgaaaatgtactaatgatgagtatagatttatttcagagtaaaaaaagtgtagtgtgttaattttagaagcatttcctttcttgatgttttaccttgcaacttgaagtttttcaatatcctaaaatgagctgatttgacagtcaaaaagtatccttgaaaaaaatgacagcttggcatcttttgcctggctgacttttcccccttccatcaggtggaaagaaaaagcagtggtaaatttcaggcatagtcagagggaagccatttttacataattttagtagctcttacttgagtgcttactgtgtccatactatttcaagcatatggatttcatttcaagctgaggatgtgggcagagcccactcccattgcgtgaagtgcaaagtactgtaccaggcattggcgtatgagagtttgtaaaccacacttagttcctgccctctggatgctcctaatctagtgggggagaccaagagcctaacaaatcatcatttgaaatggtggtagtttctatgaagagtaattatagagtgctatgagaacataaagggtgctcgtctagtccccgaggttggtgagagaagcctttccagctaagtgatatttaagccaaaacctgagtatatcttgatgagtagaagttacgtaggccaaagtgtatgtatagggggctggcggatgggggtgggaagacagtctagatgagggtacggtttgcattaagcccttgaagtaatgatcgaagctggcttagggactggaatgtgcctggggcggggggtgctggatgaggtgttggaacagcaggcaggggccaggcaccaggcagtgaccaggattttggtctttgttttagaggcaatggaaaactttaaaggggttatttatttatttattgtttcgagatggagtctcgctttgtcacccaggctggagtgcagtagtacgctcttggcttactacaacctccgcctcttgggttcaagcgattctactgccttagcctcccgattagctgggattacaggcttctgccaccatgcccagctaattttttttgtacttctggtagagatggggtttcaccatattggccaggctggtctcaaactcctgacctcaggtgattccacccaccttggcctcccaacgtggtgggattacaggcggctgccaccacgcccagctaatttttttgtacttttggtagagatggggtttcaccatgttggccagactggtcttgaactcctgacctcaggcgattctgcccaccttggcctcctaacgtgctgggattacaggcatgagccaccgcgcccagccctattaaagggttttaagacaagacatggatagatgtatgctttataaggctcattctgggtcacagtggatacaggtaggtcttcatggagccttatgaaatggttactcagctcgaacagtcactagacctttgctgagctgggcataagtttggttcttggccctgttttgtcttccaaaattctgtttattcaacaagattcaaagttggcttctgacaccttcccctgctttagagaagactgcattttttttttttgctattattgttagagccacctgttacctttgcaaggaagctatggaacaaaacaatttacaggtgttccaggctgcagaatggtccttgggcagggcctactgggcaagtagctctgtatcactatagtccaggggctggctctcagctatggtaatctggaaatcagttatttttcagcacatgtgtaaagtgattgaactctggggagcagattcttgttaacctaaatcatgagagactcatgtaactaaagtgccaggtggttaatgctgagtaaagacaagagctgggagggggtctagacaggagttctggaggcaagcctacatggaaagacaaaggagaaactgacgtagcgagttggttagatctccataagggccatccctgcagacctgtcaaggggactgatacttgagtcactggatgttatcagatattgtacaggttaacacattcaagttatttaggcctcctttttattgatccatacccttccttattttaacttctttatagttttcaatttttcattttgaaataatatcaggcttttgaaaaagtagcaaaaacagtacaaagaattcccctgtattattcacctagatttcctaaatgttaatatcttatataatcattgtacagttaccaaaaccaggaaattaacattggcagaataccatcatctgtagaccttatacaaattttgccagttaaggtcccattaaagttctttttctggtctaggatccaatccaggattagatgttgcatttggttgtttccttagtcttccttactctttcttggtctttcataaccttgacttttctgaagagtactgggcagctattttgtattgtagaatgcccctcagtttgaattttttggttatctcttcatgactgaataagcatttttgttaagaatattatggaagtgatgatgttgtgtgcttctcagagcatatcacccttctttgtttgtaaccatcataacttggtcttccttccaaatggatgtgaaacttgagccaatgttgaccctgagactatgtctgggggcaccgtaggtgcttatgaatgcaaatgtgggaattgagattacatggctataataagattgccctccggatggcctaggatatgcctacattattatatattaattttaaaaatcatcataaaaagaaaaaaagaaatagtttctaaatctcagacagaccactggggaaaatgtccctggacttcagttaggaaagctttggataactttacccattttaacacctcacttagcagagactgtgccatcttggtaagacttgggagttccctgccttgaactgattatttagagggggtattccctgctatggtctatgcactccaactattatatgcggattttgaatttagagtaacctcattctgttttaggattttcttagattaatagaaatgaaactactcaacatttttcttcacaaagttcatcctttattctttcctaactgttcctgtttctagatcttatcttcttaaaaaaaaaaacctacagtaatattttctttccttttttccccccctattcgtttttggatctttactctggtaaaatactataaaaataaatcagctacattttagcataaatacagagaaagccagcagttgaaatgattacagtttggaaaatgttcgatggaggcattttagaagaacgattttaccatatcgcaggctgctgctttgaaataactcatgtttctttcccacctctaaattgtcatttttccagttctcctttttggaagctttagtatgcaaagctttgacaaccatttaggaaaatgaaatcactacccactgtgtgtgacatttgcttgaggataattcatttggttcaaaattggcagttgctgaaatgggtggaacaaagaaatgtttgcatgggttcattgtttgaaggaaggaaaccttccaggtggccatttaattgcagggatgtgaaaagcttttatctgattttgcgtctttgagtggattttttcctcttcagtctctcctagagtagttttaggtaatgtttggaattctctgcacctttgcctgtgttgtacttttcctccctctctgacctcttccttactttacctccctctctgtgctcttccttacctttccttcctctctgtcctcttccttttttttttttttttttttttgagacggagtgttgctctgtcgccaagctggagtgcagtggcgcaatctcagctcactgcaacctctgcctccagggttcaaacgattctcctgcctcagcctcctgagtagctaggactgtaggtgtgcgccaccatgcccagctaatttttgtatttttggtagagacggggtctcactaccttggccaggatggtctcgatctcttgaccttgtgatccgcccacctcagcctcccaaagtgctgggattacaggcatgagccactgcatccagccacttctctgtcctcttccttacctttccttcctttctgtcctcttccttacctttgtgtgggctggcaagtcatttcctgtatcaggtagaaaactttctattgtaaatcacagaaaatttcactcaactaagtttaaacagtaaaggtaatcttcctaactgaagagtagagattaagagttaggcttaggtttgatcagggccgtggttctatttctctgtagatctttaggtcagttctcaagcggtctgaggaatgggactttttcttttttaaatttctataccattgcagaccaatacttttgtaaaatacaaatgaatttctaggaaaacgaattactaggaaaacaaagttataaaaaacaaatataagcccattatttaaaattgttgacttcgctgggcatggtggcaggtgcctgtaatcccagctactcaggatgctgaggcaggagaatcgccacttgcactccagcctgggtgacagagcgagactctttgtctgaggaaaaaaataaaaaaataaataaataattaaaaaaatgttggcttcaacagacaaaattattctgtcaaattgctgtcaatatttctttttctttttttttttgtttttagacgttgtctcactctgtcgcccaggctggagtgcagtggcgcgatctcggctcactgcaggcttcggctcactgcaggctccgcctcccgggttcatgccattctcctgcctcagcctcccgagtagctgggactacaggcacctgccaccacgcccggccaatttttgtatttttagtagagatgaggtttcaccatgttagccaggatggtctccatctcctgacctcgtgatccgcccgcctcggcctcccaaagtactgggattataggcgtgagccaccacgcccagccaaattgctgtcaatatttctaaacatgctcattgtcagtttctgtcctgaccttgtggtaggctgtggaaaagcaccatgttggctctggcctcctctgctagctggattcagtgcagctctcctccttgtggcaagatggctgccagtagtttccagaatgatgtgtgtctttgttctcatctagggaaagagttttcctcagtattgttcctaagctttgagcctcatactaggatcagctcacagctggtcactgagaccagagggtttgtccgtttttgaacctatcaccattagaaggaatattgccctagggatgggggctggtggctctctgaatccatatgacttccatacaatgctgaggaggcacttgcattattcactactgttttagattaataaaatatgcataggcactacttgtacatttagtctgtgataaaataaaaaaaaattaacatttggtttttgtccctggttcctgtcacagagctcctaaaacccttggagtcccctgagtggtgagagtgtctttcacgtgctaatcattcactcttgggggttgttgtgggtagttatcttcaggttgagcctggtcaccacaaagaccaaagcatgtttagagggttagaactttctgctccatttcagacctcgagggagatgagaaggattcatgatttaaccaatcatgcctacataatggagcctccatagtagacagtgagatttggcgagcttctgggttggtgagcacacggaggtgctgggagggtggcatgctccaggagggcttggaaactgtgcgcctgcccccacctcttgcctggtgcatcctttccatttgactgttcatgagttatatcctttttgataaacctttatgtatatgcaaagaaacataagtgtcttcctgggttctatgagccaacctagtgaattattgaacgtgggagggcttatgtggaaacccccaaatttgtagccaagacagaagtgtgggtttaaccccaaaatgcaggttcagtcacccaccacttgcagagtccagttaacaagagcaaggtctggtataaaacagtttttttaaattttattttatttttctgctcaggctggagtgcagtggtgtggtcacggctcactgcaacgtctgcctcctgggttcaagcgaatctcctgcatcaacctcctgagtacctgagattacaagcatgtgccaccatacccggctaattttttgtgtttttagtagagacagggtttcaccatgttggtcaggctggtctcaaactcttgaccttaaatgatccgcctgcctcggcctcccaaagtgttgggattacaggtgtaagccactgagccaccgcacccggcttttcttttcttttctttcttttttttttttttgacagtctcgctctgttgacccggctggagtgcagtggtgcaatcttggctcactgcagcctccacctcctggactcacgtgatccttccacctcagcctcgccagtagctgggactacaggtacatgccactatgcctggctaattttttgatttttttgtagagatgaggtctcgttattttgcccatagatccagatccatttttttgcccatagaatacagctctgggctggtttcaaactcctgggctcaagtgatcttcccgcctcagcctcccaaagtgttgggattacaggcgtgagctaccaagcctggctgaaagtgactttttattccaaagctagcttagcggaagaactacaggcttcttgcttcccttttggagcagaaagtgggtacttttaaaagggggcctgaccctgtaatcccagcactttgggaggccgaggcgggcggatcacgaggtcaggagattgagaccatcctggctaacatggtgaaaccccgtctctactaaaaatacaaaaaaattagccgggcgtggtggcgggcgcctgtagtcccagctactcgggaggctgaggcaggagaatggcgtgaacccgggaggcggagcttgcagtgagtggagatcgcgccactgcactccaggctgggtgacagagcgagactccgtctcaaaaaaaaaaaaaaaaaaagggggcctgacatgctggcatgaatggcttgcaggggaggaagcgagcaggtggaggggttcgtgtacttgcttcagtgtcttatctactgggcgatcaagctggtgactgctggtaccttcatggactgaactgtgttgtaaaagtggccgaaaactccccaggtgtagagagtttcatagtgggcataccttgggttataaattgacgtcttgtctcttgaggcaacctcctggtgggtgagagttccgctctggaattgctaagcacatagttagatgaacttgctgtagggagtatctggtgaagatgaggtaaaaggctataattgcattactaaagagctaagtaggaagtgaggaaacagaggaaagagataagaagagagagagaaaaaaccgattctgagaactatcggggtacttggttacatgggtaacctagggatgtagtactcatggtggcccctgggtgagggcagtcttgtggtactgagcccttctacctgtggcctctgactccttgtgggtagttcgtgtgagagtagcattggatggtaagatgcccaatttgtgttggaggatcagagaatccaagatagtccttgtagcatccttgaaagacgggtactcttaggaccctcctgtgcagtgaggaaacagttaagtgacttgctacaccgctacaatggcacacctggggttctttggattctaactgtctctcccacatgggtgccttgcggacatctcaaatggtcaaataaaatataaaataatcgctgtttttgtgagggaagtgttagagggttcatggctttgggaagtggtttattgctgtgatggtgaatctctctgcaaatggggctaaagggaaaatattctcacttaaagccctttgtaaaataaaagcttaaaaaaagtgaaatccagaattattccctgaagatggactctatgttaattttaatatgtacttaaacacctggatttagtctagccctctaaaaaacagccatgtttaaaagatcacttaggactatttctaaattaaaagaatcaacctcttaagtcataaccttctattggctcttagaacaactggaatttaccctttgtatgtatgttaaagctagtgtgatgtagggttttaagtccagaggataaactagctgttttagttatttaaaggttaacatttaacgagaagtgatattacttcactttttcaggcaatctatataagattttgttttgttttgtttttcaaagggacttatcacagaaagtatctattaaacacttaattgggtttgtgctgtctggtacaaagggaaactattgtggtctcttagataaaagggaaattatgtatctagggatctcttctgaatcaaaggagccgccttttgcatcctgtgtcagtgtcttgaaactctgtagtcctagactactgataattatttgtgtatattttcaaaatcagttgtggattcagagattgtaatgtgcacactgcttacgttttatctcagtgtacaaggtgagtacccctcatgtgaaaatctgaagtgctccaaaatccaaaactttttagctgccattgtgatgccgcaagagggaaatttcacacctgacctcatgtgacgggttgtggtcaaaccaaagtcaaaactttgtttcatgcacaaaattattaaaaatattgtgtaaaatttcctttaggctatgtgtataagttatatatgaaacatgaatttcatgtttagacttgggctccatctccaagatacttccttatgcagatatttccaaatacaaaatccgaaactctactgatcccaagcattttgtttaaggtaccccagcctttatagatcttatagacttttctttataattaatttccttccatctatgttccttgtttttgaaacgttagagaacatttatatttcatgtaggttgaatacaaagctgtagaagtatgttatttgaggttttggagtataaaggtgatctcaaaatttttagacttgaatttctttttctctctcattttctaaaaaatagaattaacgtggaaaatacacatttgcctcagactcacatgcccagagtatggaaggcctcagagaaatcaaaataagatttatgaacatattgaagaaagtggattggtccagtgttccctgggatctgttgaatttagcttaaagtcaagatgtccaggatgcccattatcactgttgacaagaatttttgactgacgcttgtttatgatctgaaaggtgtatatattttcttgaggaactatagggataatttttcttttccttaagaaagtaatcttctttctctgaaagctgaaaatcagcttatattatcttttactcctcctgcctcctggccccaggtattcagttgataaaccatgtcacttccttctttctttggtcattcttgttgacctagtgcagggacccatcaggtggattattgaaatccaaactggaatcctcacttctaatacactcactaatgctttagaatacagatccagggctattcccctattcaaaaatgcgtgatgattctcaaatctctcagcagatatgtggtctatcattaccatactctttccccccagatcttttacccacctgtgctgctgctgttttaaaatctgccggaatcatccctgccttgtggcattacccaagctgtcctctatgtcacattgcatgttgctccatctgggcccaaactgccattttcaaagtctagcctaggtcttaccttatcctggaaattcttctagagtcctcttaagtagttctcacttatcttccttgaattaacattatagagcttatcacctttcttggattgtgtcttcccagagataaagaccatatcttattcaccttgttattccacacaccttgcccttattgatactcagtggatatttgctgaattgaatcaacaattaaataaaatttattatttattttaacagagtcttactctgttgcccaggctagagtgaagtggtgtgatcagagctcattgtagcctcaaactcctgggatccagcaagccgtcctcccacctcagcctcctgagtgctgggaccgcaggtgtatgccaccttgcccggctaattttgtttatttttttgtagagacatggtcttgccatgttgcccaggctggtctcaaactccagggctcaagcagtcttcccaccacagcctcccaaagtactaggattacaggcaggagccactgtgccttgcctgttctcttaaattattttatgatgagcatgtatgtgtgtctatgtagagggtgagatagagagagaaagaatgcatatgggtgagtctaagctcacttcctttatgcaaggtacaatgaagagcgttgtggggagataaaaagaaagcaaaatccagactttgagacagaatcgtccccatggtacaattgatctgattttatcaatgaatcaattgttagaaaaaagggagacagagagatgaataggagacctagagattaaaagaaatttaagaaatactttaaccagttgctatgtgtagactgtgattcaatacacaatctatgtatagattgtgattcgacaaattgtaaaaaaaaaaaaaaaaaagacggggaaatttgaacactgatcagataattgatgttaagaaattattgttaatttttataggtgtgttaatactattgtggttatgctttagagtgtctcttaaaaattttatctttttaagagatatatgctgaaatatttgtggatgaaaggatgtgtgatgcctggaatttacttcaaagcaactggtggtgatgaggtggggagagtagataaatgtggaaataaggtaagattccccatgagttaataatcattgaagttggatgatggctggctgtatgggggttcattcattctttctacgtttgtatgtgtttgaaagtttctataataagcggaaaaaaaataagggataggagacatgggttttgtttttaaagaattgaaagaactttacactggaatttgggaggctcaacattctagctctagctttctctctaattacctgtgtgacttggagccactctttcaacatttctgggcttcacctactctcctgagtaaataagaagttggctgtgtggggtcctcattgtccctggtgtctggaatgttgtactttattttttatttttatctttttagagatggggtcttgctttgtcacccaggctggagggcggtggcacaattttagctcacagctgcctccaattcctgagctcaaacaatcctcccacctcagcctcctgagtagctggcactgcaggtgcctgccactacacccagcttattttgaaattttttgtagagaagagtttcgccatcttgcccaggctagtcttgaactcccgggctcaaggagttattctacctcagcctcccaaagtgctaggattacaggtgtgagccaccatgcccggctgaatgctatacttttgagagagactttgggcttggactcagagattccagaataaacgagcagtgtctatgaaagtcatggtttcacccaagctgtatatttgccaaatcacaattccaaacttaccacgttttttttttttttttttttttttgccagggaagaggatcatagctgcagcattctgtaatacatgctgtcagtttgagttggtgtaatttcattctaaagcaaagaggcatcatatcataattagctggggtagtcttatccccaaagttaatgctgtgggtataatgattaagaggtcaggctcgggaggccacattcacatctcagcttaaccacaagctgtgtcacttggacaaattacttatctacctccttccttagagggtcgtcataaggattaagtgagctaatgcatgcgaggtgcttaggacagtgtctggcacatagtaatggttcaataagtggtagatataattttcattggctttattagtttgatttatattttggattttcagttcttgtaaggcatgttgaggtttaagcacatttgtcatccttaggccacccttcctccctccctccctctctttgagctagaagtatattggagagctcattgcaatgtgagatgaaagagggtgagagggagaccagggaagggagttagtcaccaaacacagcctcttagaggtcatcctgtcccacccttctcttggaggctgatggattgagtcgctgagggatttgcccaaggcggccaagcccagggcattagtggtggagccgtatcttgaacctgggtctcctaactgctggttatgtctgctgcaatcttcagctccctgaagtctcctctgtcattctgattgctaactagagtgcattctggagagaaaatttccctgcgtctggtttatctaatatttaaaaagtcatctctgttaaggaatctctggtcatgtcctatcatttgcagggagtgaaatgggaatgtgcatggtgttcttcaagcactctgactaatcacttcataagctatgggcttccgtcatttcctttccaagtcctgctgatcccaggcccttgtcttccctgtccaggccggcagcacctgtgaggccccgcacccgttccttacagccagcttgccctgggccctggatcactgcattactgttgtctgaatcacctccgtggccttgtttttcatccttgatgttttcccaaaagcattgtttctccagtatccgcaaaacagcatcctgtgatgttttcttcttcttcttcttcttcttcttcttcttcttcttcttcttcttcttcttcttcttcttcttcttcttcttctccttctccttctccttctcctcctcctcctcctcctcctcctcctcctcctccttctccttcttcttcctttttttttttttgcccttaagcctattgcttccttccttaatgttatttcttgcttgctttcattttctttggatgcttctatttattttccattcattaagctgcaaataggattacaagcttcttttacttattccagggatgagattgcagtttatagactattcacatccctttgctttttctgcagcttagaggcactttatagctcatgaaaatttcctagtaagggaaaagtaatatctctataagaattgacagattacatagtgattttatcaacaagataggatactaggcctaagagttgaaaaggttagatataatcctgggtttgaatttgcattcataaactgtagttctttggacaagttatttttacctttttccatttcagttttctcatctgaaaaatgggaatgttaatactcatctctttgggttgttgtcttggcagatttactgaaggagttaagtaagtcggctaatattactgtgtatattgtgatcttatttgcgcttcatagaaaaatagcccttttgaggtagatagggttattttctccatttttatctgactttatattaattcatctgttcccttcccttcttccttcctgtttcctatcagagagagagagaaagaaaaagagagagatagagaaagggaaaggtcgatttaaggctaatacatttctcttgtacagatgcagcattaaggcctagtgagtttgagacttgccctacagtcctctcttggaggaggtggcaaggtgggagtggagaactccttcctacatctttaaacttcaggtctgattgtggttcagtacaacctgagaggacctgagggtgaggtggggtgggtgtaaagctacccttttagtcagtttcatgtccttgatttggaactgtgtccgggattcctgagcccaggtcatagactaggaggcagggtggtgcaggaggcagacacacctgggatggaatctcggctatgctaggaacctctctgctcctcagtttcctcatttgtatagtaaccgtgctgtggggtgaccttgagaaacgggacagatgggtaaagggcctggcatgtagtaggtgctcaatcgatattagttccttttctagtttaaaatgtatttctggtttgtgctacaaaaaaaatcctgctaaaagaatttcaggcagcagcatacaggttgcagaggcatttttgtgggcagtgatacccctcaacacccttgaactattcccatcctcctgggaaagacctgtcttgtagagttgggacttgctttcaaccagtgtttctcacctccatgtgtgcattagaatgacattgctttgtcaaaatacacattttgggctccaaaccagacctgttgcccagacatgtaccttttggaaaagttttccagatgttcctgatgccactgtagcatagagctactgctttcaacaaaccagaatgacttcttagtgtgtctaaaatatgattccgtttgggcatagcctcttagacataaactcttagagaaataggaatccttttctgagaaaagaatatactcttttcacctctgactcattaatgggaaatggatgtaattttcatagtaataatagccaattcaggtgcttttactgtattatttaattctgacagcagccctgtgagttagttggtatcattatgcctatcctgcatgacatgtccaaggccacacagcttggagagtgtggagccaggctttgaacccaggcagtctggctccagagtccattttttttgtccccacgaatatcccacttctcttaattacaagtgagattaccttgggaaatgcactttggagtccgtggctcttttgtttgtttgactgtttggtttttgaggtggagtctcactctgtcgcccagactggagtgcagtggcgcaatctcggctcactgcaacctctgcctcccaggttcaagtgattctcctgccttagcctcctgagtagctgagattataggtgtgtgccaccacacccagctaattttttgtatttttagtagagacggggttttaccatgttggccaggctggtcccgaactcctgacctcaagtgatccacccacatcatcctcccaaagtgctgggattacaggtgtgagccactgcgcggcctggagtcgtagctctcagctaagagccatggaaatttgcgaagaactggcagcttctttctcactgcccctgtattgtttcttggcatatcttggtctggtctggatttcaggaagatccatgcattgcagcagttgtgtgtgctgttggcttggtgtgggtggtgaagcaaatttacaattccatctctcatatttgctcattccactctcccacctatcggtagagcgtttgggattagcttgctctaggggtgaaaaatttaggggtgaattattgggcttctttcgctctagttcaatggtaaacaaagttctctttgctcccaagggcctgttggccttcaccaacctagtgttagaaggtcatttgaagggggctttcatgcaggagctctttgcagcctggaagagagtacaaagtagtccagggaaaaatagtcgggggaagatttgccttgtgctgacctgcctgcaccagaaaattctggagccctcggggaaatgcagcaggtgtgcaagacgatagaaatcgccacttgctgtgtgccaggcactgtgccaagcgctttaaaacactttatccctaatcccttctccatctggaaggtggatgttatgatccttgttttttttttttttttttgagacagagtctctctctgtcacctaggctggagtgcagtggcgtgatcttgggtcactgcaacctctgcctcctgggttcaagcgattctcctgcctcagtcccccaagtagctgggattgcaggcgtacaccaccattcccggctaattttgtatttttagtagagacgggggttttcccatgttagtccggctggtctcgaactcctaacctcagatgattcatccgtcttggcctcacaaagtgctgagattacaggcgtgagccactgtgccccgtctgattcttgttttatagaggaggaaactgactcagaatattaaatgatgagtcttaagatcacacagataaggaacgtattcaggatttgaacccatttctctcagactcagaagccaatgaactttccgtaatactttgctccatcttctgtgaaagacaattgtgtactcagatgtacagcagacattaacttacaaatacaagttattttcaccgctagtgtcacatgaggatttccctttgaataaaataaataaaacaaaacactgctaaatgttctcctgaaatgaaagaaaagaaatgaatgagtgaatgaagctggactggctatcgatactcggagcacatggagattcttccctcgacccccggtgtactcgggaactctgataatttcgtttataggaagtctgttgaggatttgtttttcttttatgttaaaaatgatatattacaatatctggaccataaagtagcagtttgtatttttagctacatttatttctgacttctttactcatgatttttttcccctcaattaattgtacgtcctgttctccttttcttcctcctgttcttctccttttcctattttcgcacccattttttctagtagagggttttgcttgcaaatgttacttggtggataatggatgtaatttttacaaagttcagggtttttttttttttaagtctctgagaacaattcataaagccatatctgtcaacttatgtactactaaaatacaggatgaactttccaacaaatgttgttataatacttgtggttccatttccaattcagccattatagatgccccgaggaaacaaacaaaggggaaaaataagatacgaccaaattcattatgatttcacttttatggttaaatagatttctagctagagctggagttgcttctcaattaaacagatatttctggagggcctgaaatctgccaaaccctatactagtctgtgacttgatttcacctgttgattgggtgaatagctccttttttgctttgagttggtttaaaaaattcttagcagcagctctcagcataatttattaggcaagagtttaggaatgttattccatgaaagctgctttcctgcatgcttgacgggtagcaccatgtctgcctgactgtctcgtctgtctgagtagtctgtctgggtagtgtgtctttcggattctctcttattcgtcctcctttctccttccttctttattttattgactaggtagaaatagtactaaagtgtacttttaaaaagtgttgaatagatcagtgtttcccatcaagtttcctctagaccatcagcattataatcagttgtgcttgttaaagacgcataatcttgtgccctgacccagaatctgaatttgaaaattgctgaactacagttatctgtggtcactgtgttatttttaaactatcagtggaatgttctgtttctctctgaatcaaaagataatctcattttccccctgagttaatgtactctgataaaacaaaaacaaaaacaaaaacaaaaaaacagttccaaataagaatcctggaattaggtttcagaatttgagaaactttcattagacttttattgaaacaagagttggtgtttcatacactgtggatatcctcaagttgttgttagtaaaatgccaaattacttgacgtttaaaaataaactttaatgatgaccaaacccgttaattttaagtctttgttcaaactacttatgatttaaaatgagtcacagagttggatcgggtggccacactgggtagaactgggtactgacctctgccagtcagctgcgtaactccaggccctagggtgccccgtctgtccagccagggattgcatggatatgctgtgatctcccttttggttctgattgagttggaccttgtgggaggagaaacatagatgttgatacatgagcacatatgttggagagagaaagttttatcttggcataggacttttaaaacacaaggtaatttttaatcagttttgggaccaaaaaacactcaatatgggaaaaatccaaattctgccaaaatgtctaaagaggtttattctgaaccagtataagtgactgtggtctaggttacacaatttcaagagatcctgataaagcgtgcatgagagagttgggctacagcttggttttacacatttcagggagacaggaattgtagggtaaaattatggcacaggacttttaaaatgaagctgtgaaagtttacagtccatagagaataaaaatctagaagtttaaaagaaatgattggtagtttctttactcgttcagaaaaacaatgccatatttcccaaaattcctggttatggaaacgcaaccaggaaatggacttccttaaggcaaggacgaccatcctttgttggagacatttgattggttgtactattgccaggtgcatttgtgttattttacaaattctagtagaagcgggtataatggtaggagctgggcagagaagtgtttccagtcatttttcctattagaagccatctctattggaggaaaaaaacaaggcctgctgcctccaaaggttaatcagtaatgacataattcaaacagctggagaactggggagaaattggagtttagcaaatgatttcttgcatgtgcgattgtgttccatttctctccattcatttatggagagaatgataaatgtatcaagggtggtgaagtatataaagagcattgttttttaaatctcagtaatttatggacctctatttagaggaaacatttctcacaaatcctcagtaataaatatttttattatgaaggagcttcaatataaactaggtataaactccttacgcgtctagctcttacttaactgtaaagcagtgatagatttatagagcaaattcaaacaaaactacaaaaccaataaaattcaaattaatattaatttatcatgacagataattttgtttcactaaaattaaacccctcctcgaaaatgtgattatgtttctgacagccggagtgccagttctttttagatctgcatgaaactcaattcctccactttcctgtattctatgcttccttcatattaaagctccttcatttagtaagaatgcaggatttaggttttaattctgcctcatttatcttgacttggccttgaagattaagattgtactactaggtgccaagatcagaaacataaatggaaacctacttttgatcagtaagatttccggacttgttgcctagttacagatgagatagtaggggaaagagaagggtcactggtacctgtaattttgggttgcagatttgggtgagagtgaatggtgccatttagcaaaatgtgtaacaaaggaggaaaagtaggttttgggagaagatgattagtttaagactaatactgcttaggttcctagcagtacggtagactgaataacacacttttccactaaagcattatattctggataaaacattttttaatgtatttctgagaccacaagaactaagacctctccaaaatctctcacttcaagtagttcaaccaagcatcaaagggtaaggtaaaacccaagctttatgtgtaagcaaacacaaaagataggttacctgaagagcaaatgctacaggttgaacatccctaatctgaaaatctaaaattgaaaatactctaaaatttgaagcttttggggtacgggcatgaaactcaaaggaaaatgctcataatttttggattaggaaggcatagcaagtatatattctgcagaatattccaaaatttgaaaatgtctgaaatccaaaacacttctggtcccaagcattgtggataaggaatactccacctctaatatcaccattgtggttagagactaagtcttgggtcagtggcaaggtataagagcctgcattccaccagtacttatttgtaagaggagctaaagtggctctaggaagatagtgccctttggcttctggcagaagcaagtgcacatcctttcaggaggaaggcatcttcactttagaccttaggattttcctgactaacatcaatcaaatcggcattcagaatcaaagatctccagtcctacaagaaaacaagccatcagcagtgcgagtcatcagaaacaagtgaaggccgggcgcggtggctcatgcctgtaatcccagcactttgggaggccgaggtgggtagatcacgaggtcaggagatcgagaccatcctggctaacacggtgaaatcccgtctctactaaaaatacaaaaaaaattagccggacatggttggtggtgggcgcctgtagtcccagctactcgggaggctgaggcaggagaatggtgtgaacgcaggaggcggagcttgtagtgagcggagattgcgcccctgtactccagcctgggcgacagagtgagactccatctcaagaaaaaaaaaaaagaagaaaagaaacaagtgaaaaacaatagatttagaaccctaaggactttagatattagaattatctgatatagaatataaaattactaggtatgaaatattttaagaaagaaaacatgtaatcacaactaaatgcaaaattgaccaggcagatttggaaagccaagacctaaggaaatattagaactgttgaaataaaaactaaataaattagattagaaataggtgaactagaaaaatgaactagaaaaaaagtttgaagaaattaaccagaaagtagcataagggagaagaaaaacgaaagtagttgaaggatataacggtcatgacgagatctcttctgagttccagaaagataataagagtaaatggttaggagtactatttgaagatctaatgtatatataatttccagagagagtttatgaatgacataaatggccatgttccttaaatctaagtaatttatgggccgataagggaagcacaacatataaataaaaaaattcatactagacataaagaaactttaattcacttaaaaaaaaaaaagaagaccatgtttaagaacagccagaaaaaaaggcagattgtttatcagactgagagctgacttcccaacagcaacaatggaagctggaaattagtggaaaaatatcttcaaaacgctaaaagaaaatattgattgtatgtcaaaaaaagctgtcattcaaggaaaaagcaaaatacgctttcagaaaaacctaaacctgattttaccacagaagatcttttctaagaaacttcttaaaggatatacttccggaaggagagattccaggaggaagggctgagatgcaaaaaggaatgatgaagaaataaactggtaaacatgtagataaatctcattaattaaaattaaataaattaaaaatttagctcctcagtcatgctagttagctgcatttcaaggcacgtgtgcctagtggctattgtattgaacaatacaaatatggaacatttccataattgaagaaagttctgttgaacagcactgttgtagagcagcggaagggaagatgcactaagatagtctctgcaatgcgttgactgtaagatggcatctttgtaagagccaccattatatgttaacaattttaagataaacattgccccacatctttaaaatgccattaaaaaaagataagacacacctcaagattacctgtatgaaaatgtaaagaaatgtgtctcttgagcatggatgcagtatggagttagaatgttaggggcacagaagtccaagagttgtggtgcagtagattgggagaggtctgggccagcgctttgagaggccaaggtgggcagatcacctgaggtcaggagttcaagaccaacctggccaaatagtgaaactgcgtccctccaaaaatacaaaaattggcctgacatgatggtggttgtctgtatcccagctactcgggaggctgaggcaggagaatcgcttgaacctggtaggtggaggttgcagtaagctgagatcgggccattgcactccagcctggacaacagaatgagactctgtctcaagaacaaacaaacaaacaaaaaacggtgaggaggtgagatgttgtagagattctttcaggataaggcatatatattactgaaatgaacatcagcctgctatgtatgataggagaagcaatgaaaattgcaaagccttcgggaattctttctgttgctatactggggaaggcttcatgagggcagtaatatttgggctggaccttgaggaatgaagaattgacagagtagtagggcagggcagtatagatagaaggaatgacactaatgacagcatggaattgtgaaaaggtgttagctttggcaataattcctaatgatctagacttcactgtttccagcttctttctaggtagtctagttttgatgaaggaacatttattccctgagaccggaagcatgccttttactaatcttaagttggaagttaatcaaaataactagacacctaacctgctacttccccaatgctctaaatagacaacacttaatacatgtttttcacatcctcttgaattacacaatttattggtaaatttggggatttaagttcagaaaacagttgcccattattataataaaaatattccaatactttttctcattaagtaaaatacagtaaatcagtggttcccaaccgtggctgtattagcatcatctgggaacagttgaaaaatgatgcagagtacttgggctttgtattttatgtaagaaccccagtgtattagtccattttcatactggtatgaagaaatacccaagactgggtaatttataaggagaaagaagtttaatggactcacagttccacatggctggggaggcctcacagtcatggtggaaagcaaaggaggagttaaggcacgtcttacatggtgtcaggaaagagtgtgtgtgcaggggaattgctctttataaaaccatcagatctcgtgagacttactcactatcatgagaacagcatgggaaaaacttgcccccatgattcagtgattcagttaccgcccactgggtccctgccatgacacatggggattatgagagctacaattcaagatgagatttgggtggggacacagtcaaatcgtattaccccaggtttgggaacccttgctctggagttgagtaacatcttggtcacttttacccagatattcattctttttatgcagtattttgaacattggcttttagtgttgttgagtgcatggattttcagattattagagattaatgtgtagatcttaacgcctgtgccttcccttctccttctttctcccccctttcctcagccctttcccctgcatcccatattgaattttttgtacagcagggctgacatgtcctgcatagcttagttctcaggacttttaattaaataaaaattttttttaaaaaagaaactttgctaagacagacttttggcatgttaaagttgaacttgagtttagtttctaaaataatttaatttttttttaatctttaaaataatgactacaggaaatacttctaaaataattgatattccccgtggtaaaactggggttattactggatgaatttcagcatgtgttcttttttcctggggtgaaaaaaaagtgttggggagtgttccattgtatgccaaaacacataaattgtaatccctcaaacctcagagcgcccttcatatggtggtagttatttggtatattgtaaaatgtggcctggagattaaaataagaaataaaatattttactatatacggatcagttagaatattccttttaacacttttgcatggatactttggttaaaataaatcattgtattgaagcagacgtagcattgctgctcgtttctatttcctatatgtattttatatttcctacagatgaagaatgaccaaaatgtcagccccattaaagcagaaatttttttttagtgccagtctccatcacctagaatggtacctgatacatagtgattgctcgctaaaaaaatgtactaaatgaatgagctaacaagcaaccaaaattaaaaatgacactatcacttttcactgataaacttccttccagaagtattgggaacgtcacaatacctggtgtttgtctggaattccgattaggtgccgcctgcatgttcctttagccccctgagccttcccacagatcacagcttcccttagagtcagtccgtgcagaaagagctgtgtcttagtgttcatggttgtattggtaatgccacatctagcagcatagtggtttcttagtaaatatttgttggatgaatatagtgctttatagtttcaataatgctttcatattcagtttgaatggttgacagctccatgaagttggctaatagtatcatcctagttttatagatgatggaacagaggttaaagaggctgttagttatccttgggtcataagtagcagacctggaaccacaacctctaaatctgttaatttcttcatcccttgtttcagaacagctttaaaaacattagtgaacctattaattaattaatattcgccttcccctagttgaaatcctacagggaaagttattacatgaacccttttccaaactgccctaaggttatcagtcacagactttgttggatgccagtttcggttttcatagtagttcttttttggttacctgtgatagattctttttgaaagaaaatttttttttaacgaaccctcattctttcaaacaatttatattcttctttcccagacattttaacctgtaaatttatcaatactgtaaatctaatttttataataaaaatattccaatacttttttttaagtaagttaatgcagtaaatcaatggttcccaaaattaaacaaattttcacagccctagaggagtgggctccagtgtgttccttcttgccttgtctgcctggtcattttgacatagaaatttcagctgtgttgaattggcttggtggatatttctggaatcaggcttgaaaaggagagaccttccctgtgacattagtaaaaacaaaaaagtctgagtcatgtggatcacctgaggtcaggagtttgaggccagcctggccaacatggtgaaacctgtctctactaaaactacaaaattagccaggtgtggtggtgcgcgcctgtaatcccagctgcttgggtggctgaggcaggagaatcgcttgaacccaggaggtggaggttacagtgagctgagattgtgccactgcactccagcctgggagacaagagggaaactcctcatttaaaaaaaaaaaaaaaaaaaaaaaaagctggccaaacattgaagatcctcaaatggtggcagtgtctgggtgcacattttgccagatccattcacggaggccaaagaccaactgacatatgaccaaggttttgaataaaaaaggatttcacaatctatgaatcaaatccagttctcatttctgtttagtcttctgttgagaaaaataacttggtgacttcagtaagctttaatctactttgtgattcttgggttagaggttattttatcagactgctacatttaaacttaccctcattatcttacaaatgactttaaggtgttactggaacaatactcaccacaaagctatgatttcattgtgaaataccaacaagaccctgattccgtttgcctgctgcagacattaatgtttactgttagaactgaggcatcaaagggaataaataaactgctgacattgtgttgccttcaggatccgtcacgggaatatatggtaggggtttgagaagtggttttgggtggagaaaaagcattttcttttttcacccagcgcctgacttctcagttgaggcgggacagagccattgtgtttgttcgggctctcgcaaagccagatcacatcagcccgggccgcggctttatgcgcagcctcacagttcatgcctttgttgccctgatgcacagtcgggaaaggatgacgagaagggagctcagtaaagacctttcagggattgtttctgagtttgtcattgccacctgtcctcctctctcccctggcttttcagactattcccattttgtgagactcctgggtttctgattggtgtggcgtggataccataggtagatgtaacacaaaaagtggaagtaaacaatgtttcaaagaaataatcttgaagaagagagaaaaaagcctgctcttactccaaggctgtgtggacataagcgatgaaggattaggattattttaattattagtgactgtattgttttctttatttcttttttttctgagacggggtcttgttctcttgcccaggctggagtgcagtggtgagacctcagctcactgcagcctcaaccgcccaggatcaagcaatcctcccacttcagccttctgaatagctggaccacaggcatgtgccatcatgcccgggtttttttttttttttttttttttttgagacagtcttactctgttgcccaggctggagtacagtgctgctatcttagctcactgtaatctcctcctcctgggttcaagtgatcctcctgcctcagccacctgagtagctggaattagaggcgtgtgccaccatgccttgctaatttatgtatttttagaagtgaaagggttttggcatgttggccaggctggtcttgaactcctggcctcaagttatctgcctgcttcagcctcccagagtgctaggattacaggcatgagtcaccatgttggataaatatttaaaattttttgtagagatagggtctcactatgttgcccaggctggtctcgaactcctgggctcaagcaatccacttgtcttggcctcccaaagtgctaggattacaagtatgagtcaccgtgcctggcatctcttaatttttgaaaccactaatgtctttcccttaagacttgggtcattttggaagtaagaggccagacttgatgccttcagacatttattatttctaacactggtgcatgcatctttcctgtctctcacaggtggcttggtgcaagtgtagttttatcttgttgaaagccttttgttcttctttgaacagtgggactgtagtgttatcaacagggccagtgctaggaccagaaagctttcggtgtgataggcagtttctgttcaggacacctgctgcccaagcacagtgcactcattgtttcttcagttgaacatgttctaggcagagctgtgtcttttttagcctaggattgagtcttcactttttctcctgcatgcgtttcatttttggtagaataaatttctgtcttcttcttctggttttgctggtatgaatttaatacctgcacgtgatttgtacaaagtttatttccaagagttcatgctgaaatgtcatagtggtggaaagagcacttggtcaaagtggaggcaaatggtctggactctcattcctgctttgctggctgtgtggctgagggaaagacattttacctctctgggcacgggcttattagagcaatgggttgccaaggccccagtgtaaagattccaccattgtgtcttgtgtttttcaggatgccaagagcatcagaaatgagtgtgccaggagtcattaagggccctgctcctgtgagtaggtaacaccaggaggcattcttttatttatttaatttatttgtgtatttgaaacaaggtctcactctgtctcccagactggagtatagtgacgtgaacatggctcactgcagccccgacttcccaggctgtagtgaccttcccacctcagcctcctaaatagctgggcccacaggcatgtcccaacatgcccggctaattttttaaatttttgtagagacaaggcctctctttgttgcccaggctggtcttgaacgtctgggctcaagtgatcctctggccttagcctcccaaattgctgggattacaggccataagccaccatgcccagcccgttcttttaacttagtgacagttttatggcatggccagtgatagagaaatttggatgcgataggtgagggagggaaacaactatggttctctgtctgtggcaagtttgcagagtaaaaaagaattttttatttctaggaaagtgttgttcatcactggaagtgttactggacacttgggttttgaacgtgtaaattaagaacttctgtgatcagataaatacttcttcatttgttagctctgttcagataagaggcagaccgaagatcaggctaatatagcatagataccccatttctgatttgtattcctgcagtcttaaaccccttatttaaaaattctcttaaaatacatgttaattgtagaaaatttggaaaatactagaaagaaaatacaaatagctttccattccataacccaaaagtgctgttgttcatacttaggtgtctttagattatatgcactcagtttgtagaacaaaattgggatcataccatacatatataacttgatattttgctttttttctgctgttcctttcgagatgatttttgggactgaggtttcaactgaaggtagagattaatgtaatgttatgcttagcacacttgtgacgaggactgttttgatttacagaaatagaactgtggacccagtatctgaaaataacatttgtcctgtcccctcttgaatagactttcaatatttggcatatacagatgtcgtcataactgttactataattaacaaatgaagacttcttaatctattagctcttaatgttcactaattgctttcataagattccctcattgagttttctgtgccagaattgctagctgcaccaccagtgagcataagttatttccacactgtttttccttaagccctgattcctctagctaaagcatggcagcgcctgtgggctaggccacatgtttggcagcaggatagttaagggattccttttgcccagttatgttatacgtttgataatatttatgatttacttgttgaatgttggtttcatatataatttcctctattaggaaatgaaagattattcgtttcccctttggattatgtagcctataaaattttctattacaccattcatattgcaatgtaaatatattctaaatcctgaaccgcattagaattttttatagcccccacttatgtgtctttttgtggtgccctttgaagtcctgtaatgttttatatttgagattaaatctgggtttcgctttactttttaaagcatattgagcaagttaattttctgtttcagttcctaaggggaatgattccagccctctgtgtcccaagaattcagactgagccctgccagaacattcctgtggttttccacggggcagatcagtatgttcatgaaattttagttgtagcttgtgttttccatggttaattaaaacatctggcttttcagtttcccacaaacagagcataatcactaggccaaaccttttcaataaatgattaaatatttcaatcctcccctcagaatagcccacacttgtctttaggataccttgtaagctgttgcctctgtttataatgattttgaacgttgggaacatgtttgaggttatcctgccaaatatgtgcccttgagagagagaaagttgatgactttgagtccttataatggcttctggcctttgcccccccaggttggagttgctgtgggtgagctgctgtggtctgtagccaagcatgctgtggtcggatctgcccagccgtggaacagaaacatttgctggatggaaaatccataaaagaaagctcctgtgaaaagctgaggctgacaataatttaagcaaaatcaggttagtataagtaagagaggctggataaagcggattgggccggatagggaaaagttgttttgttccttccaggctcattttggagaccaccccaaatgattattttcagttatttgtgagagtcccagcatgtgtaaatggcagatacatgctgatagccttttgtgtatagtgtaatgatgtcttcctttccttctcttccttttcctctcctctgtcctatcctctttctcatcttcctctcctctctcagagaagagagaaggacgttggcacaaatattggaagaagccacaactggaagccacctatgccaacttcaatggtcttggctttattttggggagaaagcggcgtccagcctcatggagttggatttgtagtttcaaagacttgcactcatttgtgttttcgaactttgaagggtggggcatggagacctgccatttctgttgggataattctggctgtgagcctccagtctgcttggccagattttatatactctaatctttccccaaacaaaagccaccaacacatttcattttctgcagtgtgtgcatttggcattaagatacttatatacgacaggggaagagaatgtcctgaaaaacataggtgtttaaataaatgccaaatgctctcactgtgggccaggtgaatgaaacagcatggataaccccatatgaggcagtaaagtgaaataattcattttgaaaacatatattatacagggacagacattgcagaccatttctgttggacattcagtgggtaagtcagctttctacataagcagctaataaatactccctagaaagtagtgagtcacagtctttcagaatctgtgaagtagtgaatgtctgttggctttgtctgcccagcatccttttcctccatcttttaataaatcatccagatttttcctggacaattgcccttgtttcattttcaccctatgtagttagaggaggtgaccctgctgactcagttatgggcatgtaacataagcgtggccagtgatatggtttggctgtgtccccacccaaatctcatcttgaattgtaactctcataattcccacatgtcatgggaggatcctggtgggaggtgattgaattatgggggtggggttttcctgtgccgttcttgtgataggtaatgagtcttatgagatctgttggttttaaaaacaggagtttctctgcgcaagctctgtctttttttgcctgctggcatccatgcaagacatgactagctcctccttgccttccaccatgattgtgaggcttccccagccacatggaacttaagtccattaaacctctttcttttgtaaactgcccagtctcaggtacagcatgaaaatggactaaagggtcacaaccatctttggaggggccatagtattcttattgcaactattgaagaagttttgccttctgtgagtttgttaagctggagctgctagtggcagtttttctatgacttagggaaaaccttactgaaaattaagacaacacaggataaatcaaagcagggagatggaggaaaagagattggtgggaagggaagggacactcgtatgcatatgcacacatgcacacgcacacatgcgcgtgtgcacacagacacacagacacacacacacacagacacacacacacacacagacacacacatatttttgacctgcaattcagcagtgcctaaacccagcatctcctgtttcactttcttggcaacttagctagttcatctgagttaggtgtctgtctcttacatccaaaacatcccaattggtggtaccttctaggagtgaggtcttagtgtaaaatgactgtggcatagtccctgtctttaggggctcatggtgtagggcagcagtccccaacctgtttggtatgagggactagttttgtggaagacagtttttccaaacagtgagtggggtggcagggatggtttcaggatgatctaagcacgttacatttattgtacactttatttctattattattactacattgtggtctataatgaaataattttgcaactcattgtaatgtagaatcagtgggagccctgagcttgtgttcctgcaactaggtggtcccatctggggatgatgggagacagtggcagatcatgaggcattacattctcataggaagcatgcaacctagatccctggcacgtgcagttcacaatagcatttgcgttcctatgagaatctaatgctgccactgatctgtcagggggcagagcccaggaggtaacgtgagcgatggagaccggctgtaaatacaaatgaagctgtgctcattagcccactgctcacctcctgctatgcagcctggttcctaacaggccacagactggtaccaggggcccctggtgtaggggataggccagataagtattcacatgactgacatgcagtgtgacaatgtatctctagaggtaagaacaaagttttgtgggaacagagatggaattaggaattctgttgggtggtagactagcagggagggcgattatttaacaaggtagaagaggattaagtcttaggaacattaaaaaacattaaaaagatttaaaaaatagatttaattcaattacttgctttttgagtctaaaagaagggaaggctttccagagcatatagttaaagtaaattgcagataatgaagataatttcagaggttagtaatggtagaatcttgtttatttactctgaatacaattgtttaaggcctagccaaatgagaggctatcagaaagctgtctggagttagttttaacacgacaaggtaacagctgctgttctcaccagaacctcagtcagctttctgttttaaggagaattaaatgaatttaaagacttatttcctctttttaatgatagagttttcattaatattatattttgtaattacactgttttttgggggaaattttgcagcaagtacagaaagtttccatgtgacttctactgccagtttcctatatcattagtgtcttgcattagtgtggtatattataattgatgagccaatattgatacattatcattactaaaatctatagtttatattaggttcactctttgcgttgtatgttctatgagctttcataaatatataagttgtatttccattacagtatcatacaaaatagtttcactgccctaaaagaattgcatgttctacctgttcatttcttcttcctgaacccctggccactacttatcttttgccccatagttctactttttccacagtgtcatatagttagaattatacaatagatagacttttcagattggctttttcacttaccaatgtgcgtttaagtttcctccatgtcttttcatgaattgatagttcattttttttaaagcactgaataatattccattatatcgttgttccacactttatccattcacctattgaaggacatcttggttgcttccaagttttggcagttacgaacaatactgctggaaacattaatttgcaggtttttatatagatatgtggataagttttttactcatttgagtttctcaccattaaatatgatgtcagttttaggttttttgtgaatgttctttatcaagttgacaaatttcccctctatttctagttgctgagagtttttattatgaaatagtgttggatttttgttgggtgcttttttgcaactattgatatggtcatgattttcttctttaacttattcataggttggatgatactgatacttgaatgttgagccagccttttgataagagattatgttgactttctagttcaatattaagagctcttatgttgacttgcagatcaatattaagagctctgatacgtgaacatgggacatgtttccatttctttcagttttctttaatatctttcaacagtgttatattgctttcagggtacaagtctaatacttccatatcaaatttattcctaagtatttttctctttttgatgcctttataaattaagaaagtaattattttcaaagtatttgtagctagtgtatagaaatgcagttggtttctgtataatgatcttgtttcctgcaaccgtgttgaacctgtttatcagtactgatagttttttatgtgtatgactttgctagtattttctatataccagattatgtcatctgcagatatagttttatttcatgtccaatctggatgttattattatttatttttgcagtgatttgaaaacttgagtgtgatgtgagaaatacaaagttatgtgctttggagtttctagtgaaatcattctgttatgtagctttttgataaggataaaagatgataattatgaaatttatcttctcacagttgacttagttattcagtcattgagcttcttagtcactcctatatcttctttggagaaatacctgttcaaatcctttgcccatttttatattgggttgtttcttttgtatatagtctgatataagctctttattggatatatgatttgcacatattttcttctagtctctggcttgtttaatggtgtctttccccccaacaatgaaatactgtaaattttaatcattgataaattgcatcaatatgggaaactgtgtgtatgtataaacttattttcttaacggtgttgtttggtgctcagaagtttttaattgtaacaaaattcagtttattcgttttttctttcaaagctcatgattttgatgtttctaaaaactctttggctggctaatcaaagctcatgaaaagtttctgtgtttctttctaaaacttagtttttgtgttttttttaaatgcagtctcactctgtcaccaggctggagtgcagtgacgtgatctcggctcacagcaaccgctgtctgccaggttcaagtgattctcctgcctcagcctctcgagtaactggaactacaggtgccagccacccacctggctaattttttgtatttttgatagagacggggttttaccgtgttagctaggatggtcttgatctcctgacctcatgatccacctgcctcagtgcgcccaggctctttctaaaacttttgttgctttaccctttacattttggtgtttaattcatttggggtcaatttttatgtatggtgtgaggtttgggtctatgtttatcttattttgttgattttttatttttattttttgcatataggtcttagcaccatttgcagaaaaggctaaccagtgacttgactttttttgtagaaaatcaattgaccacaaatgtaagggctttctttctgtactctcaattctgtgcctttggtttaccatctgtccttatgctagtaccacactggtttttgcaatgcaatttttctatgaaaaaagttagttcaagaattggacttaagatgcagtgtcttcactaaaaaacactgttgtacctttgctacttttcctctctgttctttatgagtcactgtgttagagtactagtatttggtgttttctctttggggtaattatggaaatctaatatggtagatgacaatgtggaatcaatcaaagtgcattttccagattactatatatatgactttaagcagtgctttgtttttcataaaggtggtaatcatttttatacctgttctgcatttggaaaaaaaaagattaagtttttcattacctctgtcttaatcattcccaataactactgaatgaaggttttacaaggctggcatattatttcaagtattttcattaatggtaacatgaattgggtctcatatcacaaaactattattttactaaatagaaaacctatgaattaaaatgtcttgcgtgtgtttggtaacatagtgtagttgtatatgttttatgaaaatgggacatttttcatagtataaaatgctagctgtatttttatatttacctattctgtttttatctttgtattagtatgattctgaatagctaagtgtgaagacattaaaataattatattagaaatgtgaagattgcaaaatatatatatctttagttacaactgcgttatggatgcataaacattgaaaaggaaattgtttaaaagtcagtgctttattgtgacatttggaatctagttgatcattttctcttgttttctaataaactcctaattttgtttgggacatgacatttttaatgtgaaaaaaatctaaatgtaagtcttggtgaaatgcagagacatttcccttctctggcacatagctgagctgactattgctgctgggctttaactggagattacagtcatgctattagatttggaacctgttttctgcagtgccgttagtaggtcaagccatgcgtcctggttcctggagggctcagttctcaggatggcttatctgcttcctgctttcttcgtaatcttctcatttcaacctgagtagaccagcttgatggcaactgacatgtgtgttacctggcccttttactttcctgggaagtcttttaactgataatatcacctcctaaaaacatatccatagagcaacatggaattatcttttttattgttcatttaaagtcaaagccataagtaagctttcatttataactctaagtccctggaaataggtgttatgaaacttttaacccagtcacttctttaaatcttttctttctctctgttgcccctttaaacatctttgtgacctattcacagaatgactccatgaggagtgtagtataatgttctggaaagataaggtcttcttattcttgttttcttttgggagctgaatcaaagcatggctgggttagagtaacctcttaaccatcgtttactttgaatagagcctttttgccagctgaagttgggattcaaaatgattgaatcactgaagtttgagttgtagtacaattacattcatgaagactctggcctatttatgatcatttgcttgcagatgaagcaaaatcagatcaacctagtcacattcactgagtcaacaccagaatgaagagagtgtcagggaactgggtgtggtggcacgtatctgtagtcccagctattcaggaggctgaggcaagagaattgcttgagcccaggagcttgagaccagcatgggcaacatagcaagacccagatcctgtctagaaaagaaaagagtgcctggaacttgcttctttagtacagccacaattttgtatacatctgtaatgaggatgtttatgacaaatacattaacagagtttggaataatatatcttttgatatttttcttgtctttttttatgttgaataatctgtgaagtataggttttctttaacagctttcaaagatactgtgagtgacatacagtcatttattttaatataattactgatacaagaacaaacagtactttctcagtttcatactgatctgtgatgcataaaatgtttaatttgattatattgtccaaataagatctatacgcatgacacgatagctattcaaagtttctgaaatttccaaattgattattatctattcaaataagcattgatcattgatccttggcttcattcataaacaaaaatagtctactggtttggatagtgtctatgaaaaaacatataataatttataaaaaacaagtatcaacattggtctggcttgcattaaaaaatctttcggtgcagtttgttagtgtactgtctttaaggatgaaagaatatagttttgaatgtaatcgtcatgcatctgaggccctttgaggacaggttttagaatcatagtaaccatgctatgcttgggtttgtaagggtgattttttttttttttttttttttgagggctcaaggatatagtttgttactgctgtggctttttttctggtgtctggttaaaatgtcacagagcatatgaaaagtaagacagtaattagtgacttgaggaatgaattctcctagaaataagaagtctggagttccaatcaggactttagatccttgattattctaaaataggattgaaaatgaccactggtcttgagcagtcattaacatatgagtgataaggaatgttgaatttgtgttacttcagtgcaaatcagttaaattccaagtgaactagttagcagtgtcctgtaaggagggcagctgtggtagtttgctggagggaacgaaatgaagtattattgagggaaacagccaaaatgcaagcccttctggggagaggttgcatgtgcagtttgccaagtactaagcactttctcagtatcttatgggagtggctcaaggcgggggcagacttcatttgatcctcacaacagttctttgacagagacagtgttacccagttttagagaagctcaggattggagagatcaaatgatttttgttcaagtcttacacccactaatttaaatttgaatccagatgttccgaaactccatgatatacttgtataaatcaaagcactgcctatgaagtggtttacccagagcaaactctctttatatattttctttatttgtggggggctgggggctgggactacaggcacccgccaccatgcctggctaattgttttttttgtatttttagtagagatggggtttcaccatgttagccaggatggtctccatctcctgaccttgtgatcagcccgccttggcctcccaaagtgctgggattacaggcatgagccactgcgcccggccctaaaaagtttgtcctggctgggcacgatggctcacacctgtaatcccagccctttgagaggctgaggcaggaggatcacttgagaccaggagttccagaccagcctggataacataggacaacctatctctacaaaaaattaattaacttaaaaaaaaattagccaggtatggtggcacatgcctataaacctagctactcaagaggcagaggtgggtggaccacttgagcccaggaggtcaaggttttagtgaacaatgatggagccactgtattccagcctgggtgacagagcaagactgtctaaaaaaaaagaaaaaaggaaagtgtgtcctaggttttatagctaggtatgtggcccagccatctactccatgaacttgctgtgaattactgagaggtattttggtggctgggggaatcagatactcctaagcagctgcttagagaaggaaggaagaagataagccttggacattcctggcttcccctcccccttactctgcactccttgtttgggagctgcctagaatttttcagtggggagagagggaccaaggtgtttacctctatgatggtttgagactctggtcaatctgttgcttttctagtattctcacctggtagcattcttagttaagtacctagtagatgttaatccctttcttccttttcctgtcgctgtgtctgcctcttagacacaaagtacagaaactaataaacggaaaggttaagctatacagaaccctttccaaagctgtgattgccaacctccagctttttagagacatttctggtttgattcacggagtctgtgttgtctagaagagcttgacttggtctgctaggggttgattgtctagcagttctgagatgcagtttgaggcacagcaggtcagttgtgatacttccagcacgtgcaaaaaagggacttctgtttgagattaaattatcttctgaaatagacacaattcaaaagcaatttggtgatgtatttcagaacttaaaatcaccagcaatttcataaatatgttcacttaaaactatgccaagatatttatatgatatattgtagcatatttgtaaagaatgaagtagttctgtatatgtgctcctttggaaagatttataagatatatatacacacttacgtgtacatatatataaaaaatgaaaaaaatgccttgtggaatcaatgtgattaccattcccttttgtataatttttttaaaaaaggtatatatgctggtgtatgcattttttccctgaaaaagatgtacagtacaactgttaataaactggaaaactttttcttccttttctgtatttgaattttctaactatgttcacttatttttctttcctttaaaaaaaaatcgggatagctgagcagtatgattatgtatcattttgctttagttttaatgtattttataaaaccttactaagtgttttttaaaaatattgcaatttttttctaatgttcatttgtcagtttttcttgtcctctgggagttcagaggaagtaagcaatttttgtggggagagtggtaaagcatatagatagcaaatgttctcaggaaagcttattaattaaaacattgagttgaaaaatagaaaggaaaaagatatttcctaaatgtaatttgaaggacaatgaattcaatcttgctgaagtgtgtttgaaggtgtacctttatgcttagtttgtttgctttcaaaggagctttggactgaattgtatttgcttttcagactgcagggctggaggtggccatggaagcctccagaatctgattgctaatcaggaaagctgtttgctaagaaaggcctgcctgtttggacttgaagtaatgactgatgcacagataaagccagggtgactttttaaatatcttttgacttctgtgtccagattttgcttttctcttaattaaaacccttagacaaaggtcacaggtcaaaggagatgattcctctaaactcttctggtagcaatagctgcttaactcttcaactcttgataggcttgtctggaaactgttgtgttcatttttctatgacgtgatttacctcctttggcttagtttgagtgctgaaatgtagtaatagatacgaagatggaaatttttttttacaatgtagataatggtagtctggagaagaaaggcattgtgctaacctttatccatatttcatatggaatacttgaagttttatttttactttttatttatttatttatttatttatttttgagacagagtcttgctctgtcgcccaagctggagtgcagtggtgcagtcttgactcactgcaacctccgcctcctgggttcaagtgattctcctgcctcagcctcctgagtagctgggactacaggtgtgtgccaccatgcctggctaatttttgtatttttagtagagacagggttttgccatgttgcccaggctggtcttgaactcctggcctcaggtgatccacccgccttggcctcccaaagtgctgggattacagacgtgatccactgtgcccggccgaagttttatttttaaaaatcagtaaacagtgttatttttctaatttcataagaattttagaaacgtattttcctaaaatggtttgttaaatacctcatccgactcagtaatgtttatttttgccatatctccttctctttataacttctgtactgatatctgaccttaaacttagtcatgccaggaatcataacccctatatttcaaggtatgtgaaccatagtacaggaattttaatctattaggaagattaaggggacagtttctaaaatacatatctatgtatgtatatgtatgtgtttgtatgtaattgatatttataatatagaaaagtctaaaacaccaccattgtcagttgatatcataaatgaggaaaaactgatattatcttcagtacatactcacttcccaaaagaatctgataatttaaaaattcagggtaatcaatacctaatacaaagatagcaaactcaaatgccgacaagacagggacccaacagaaagtaaaccagtgaacttgggcatagagtggagaaaaagggcacagctactgctcagcttctcgcttctgctgttcaggaatgaggctccagtgtagcatgatctgctgatacatcaagagaaggcagaaatgtagagctttgtgaatgcccccatacttttaatgtgttggaaacacattaaaaaattaaaacattgtactctcgcatgttttgctgtgatgttccttgtcagtacttcagggcctgagaagcataaggggtggcgcttgttctttggtgacgtatggtctagttgggcccttatgatgtggagcagttgaagggctgagataaatggtgtgggtgctgaaggccacaggatcctaaggaggtagaaattggtgtgagtcagaccatcctaggaagcttcatagaggaaggggatctgtcctacaaggccttaacatttagggccatggagagaagggagggcggatggggagcagaagtggggagggcgtggtcttggggcatcggtaggcactcgaggagactggcctctgtagaaggcctcacagtgggtctgtgctctgaagagctcctcacagagctggaggagagttagctatggggagaatatgagatgtagttagaaaggaaaggagggggccaccctctggggccctctaggcaatcataaggacttcatgttttactgtggggacagagaagactgattgcaagttctgatagcagaagtgctgtggtgtggcttgagttttaacaggattcctctgttgagaatagagtgtagagggcaaggatagaattagggcaagcagcaaggaggtcactggaataatccaggccagatgaatgagggcttgggtaaggggcagcaatggatctacgctgaaggtcgagtcaggactgttttctggtggaatggaccttggaaacatgtccacattccattcttttcattgataatgaccaagctgcagcttagacccttctcctcattcctagataactgtgaaattctagaaattttccttctcgttctcaattttctcttttcatcgtatagctacagcaggattgatgttggaatgctggccccatcacagcctccctggcttttgaacacagtgggcagatttctgcctcagggccattgcattggctggttcttcttgtgttctcttccccagatatcctcctggataatgtcctttctcatttaattcttactcaaatgttagtctgtcggtgaaacctaccctgatcgatgttttaaaaattgcaaaccttcctgtcactcctccccaaatccctcttaaccttttaatttttttccctgtagatcttagccccttctaacatacctgcatactttacttacattttaagttattgtctctctcttctcactggaatataaatgccaagaggaatttatataaatataaatatatttatatatataaattgcaaaaggcagggatttttgtttttgttcactgatacatccctgtcacctagactagtgtctggtggggactgggtacttgataaatatttgttgaaggaatgaataagtggctttcaagaggcacttaagatataccacatgtcagacactgaaaattaaaaacaaacaaagcaaagacacaagccctgccccagcgcacatggttcagtgaggcacaacagcaggagaacaaagcctgttgatctaatacaatgtgtccaaacttctgtgcaaacaaaagtaaaaaagcaagtaattcttcccttttcagccaagtctagactgttgatttggacttcccaaggcacacaggtaggggagaggtgatgacatttcagggagagggagcagtgtgagaggggacatggaggcaggaatgtgccatctgtgtagtcaggagggtgttggtggtggagagtgactgaagatgaggcaagaaaatggaaagtggggccagttgagaggggacttgaataccctgcacaggagtcttgactccccaaatttattgagctcctgttgtgtgtcaagaacagtgctaggtgcttgggattcaaaggtgaatagatggctcttcctgctttatgggtttcatcttctagagagaggctgtggtgttaagggagaagaaaaatggccaggattgtggtgggaatggagaggccaggagagacagaggagggacactggggtaggattaataggatttggtcaaagacacggtgtgtgatggagggagtaggaagtagagtcttctggctcgtcactggggcttaggggtagataaatgttgacagtgttgtctgtagtaggaaaggcaggtaaaggatgcaaggggctggaaatgccaatcagagatctcaggagggatgtgaaggaaaattaaaaatatataatagcccgttagttttgtctttgggaagccaggaggctggagatacaggtgccccaaccaggaaagttggaaggggaaatgtgtttgtaggacagtaggggaagtgatgtgtgtaccttaccagaatgtcacttccatgagggcacaggtttggtttgttcactgctgtatatccagcccctagaacactgcctgatacagagtataatctcagccattgtttgtggaattaatgaataacgtagttgaatttggaggacaaaactggagtcataagttattagaaggcttaaaatgagattaaagtgattacaattatattattttagatattcttttacagggctttggtgatcagttagattttttagaaattttaaaatgttaccttttactggtgatattcctggtcacatacttgctttggatatatacccaacaatgggattgctgggttgaatggcagtcctaagttctttgagaagtctccaaactgctttcctcagtggctgaactaatttacattcccatcaatggcatagaagtgttcctttgctccaaagcctcaccagcatctgttgttttttgactttttaataataaccattctggctggtataagacagtatatcattgtggttttgaattgcatttctctgatgattagtgatgttgaacattttttcatagatttgttggctgcttatatgtcttgttttgagaagtgtctcctcatgtcttttgctctttttttctttttttttctgagatggagtctcgctctgttacccaggccggagtgcagtggtgcaatcttggcatactgcaatctccgcctcctgggttcaagcgattctcatgcttcagtctcccaggtagctgggattacaggtgcttgccaccacacctggctaattattatatttttggtagagatggggttgcatcaagttggccaggctggtctcgaactcctgacctcaggtaatccacccgcctccgcctcccaaagtgctgggattacaagcatgagccatcgcccctggccttttggccaggctggtctcgaactcctgacctcaggtaatccacccacctcggcctcccaaagtgctgggattacaggcatgacccatcgtgcctagccttttgcccactttttaatggagttatttgtttttttgcttattgaattgtttaagttcctcctagattctggatattagatctttgtcagatgcatggtttgtgaatattttctcccattctgtagtacatacctgctttgaatagaaatcttaatctccgatagtgttatcatttgctgaacccagtttgatgttggaagcaggtagtctagattaacacagcagtaggcaacctttcatgccaagaagtgaatggctacatgaaaaggcacatgtgaagtgagtgagaatgaaatttttttgcaattgccttctattgatgtggaatatcaagtgaatgctttgatttttttttccttgtgttgtattgtcgcagtacaaatgcttataaaatgtggactggcaactggtgcttagaaatctttgggtttccccaaaagacttttcattatggttgtttggtgtgtgtctttatgaagtatttcataaagacagtgaaaaagatatgttgctttttttttttgtaatcaaaatcagggtgtcattgggacattgtagaatgtagtatcctttcattatattagaaaggtagctaatctttaagtaagtgagaaatgaattgtgagtttattgagtctagcctcatggcactggtaagaataaatggaaatagaaccttgccatgttagtgattccaacagtgttatggactgaattgtgtctccccaaaattcatatgttaaaatgtgagtgtatttggagacaaagtctttaaagaggtagttaagataaatttaattatcttaaagaggtaagataaatttacctcttaaagaggtagttaagataaaattaaggagggtcctagtgcagtctgattggtgccttataagaagaagaaattaggcacagacacgttcagtgggaggacactgtgaagacatagggataagacggctctctacaagccaaggagagaggcctcagaataaaccagtgctgctgacaccttgatttcacatttctagcctccagaaatgtgagaaaataactttctattgtttaagccacccagtcgtggtactttgttatggcagtcctatcaaactactgcaagcaggcagcccaggctattttagcatcacagtctccctgcaagtcaggaagagggagactcagtagtgccctgggtatcccaagatggatgtttctgtttgaatgctcacagggtcgccaggtaactgctgttgtctgttgttcattagtcattcatttctgatcattttcttctgttgtttattcatttacttatttattgacagggtcttgctctgtcgcccagactggagtgcagaggtgtgaaacagcttactgtagccttgacttcctggtctcaagcgatcctcctgcttcagcctcccaagtagctgggaccacaggcatgcaccaccatgcccagctaattttttttttttttttttgtagagacacgatctcactatgttgcccaggctggtcttgaactcctggattcaagcattcccccggtctctgcctcccacagtgctgggattacaggtgtgaaccactgtgcctggcctttctgatcatttttgttggaagctgcataccttgtcagcattttgtttccttccaaaactccaattaaaggtgtgaaacgaagctgaggtgcttatcttacaactttctgtgattggagtcctcgggtttcatttatatggatagtcccaagctcagctgactagatgagattcttgctgaggcaggacagctttgtggacggctgtctttggtgtgaattggaccatgtgcatgggatgccagggtttcaagccaaggctgctttctcaagagactgtctccggcagcttggaatttaagtgaagcttaatttaatccctggttttcacagtaaatgtgtagggtgtatgttacttacagtaggagttggaaaaccattggcttcctttggcctatttatttgaatttgatttacttggaaattttccaagcagcagagcacttagaggtcttccaaagaacttaaaaagttttcatttcacattccaatagatctgttttcaaaatgggtagggcaagtggagtctgtgattaattaggttatagtaaattttgttttttttcgatgtatcctaggtttgaagaaaatgagaggcataaatgttgagaactatcttcttgaattccttcttgattgggttgctgggacacccaacctcaggatatttaaaatacctggagacctaaagtgaagtactctcattctctattttgtatctagggccacatagatgtgtttgatgtgaatcacacctcttcattatgtgtggccgactcttctgagtaataccatgaaaagtgcttcttcaaattccatatcttcacatattgctgttatgtaagaggaatgagactattataattgagtgaaatttaaaatcttgtgctttaagttatgaaataacatgcttttggctatgccatcctgcaacctggccttttcagcaaattttgtagcttgtggggacagatgaccctgaattccagcagcacctgcaatcaaaatagttctcattccagggcccacacaacagggtgtgtttgaaagtacttaaaaggaaagtgtaggcaacgcattgtacccttagtcataaaacattatcctggaatttgccttgccccaaagcttgggaagccacccttttctccctatcccaaagtttcattgtaattcccatttctgaaaagaaagaaagagtacgatggaatttcttcactaggatggcagattgaaggtacttaggtgaggaaagagacgctaacagagcttgtgtgacaagatgaccaaaatctgggtggaaggatagtcttagaagagtgattaagtgatgtttatttacccaaataaactatttttccagccaattataacaaatgcatttattccatgtttaatcagttgtagaatatccagcagattcatggggtagaatgtattttatcaagacaaaaatagccagcttgagaaatgatttaaaccagagatcagcaaactacagcttggaggccaaatccagcttgccacctgttttttttatatggcccatgagcctagaatggtttttacatttttaaatgcttgaagaggccaggcgcggtggctcacgcctgtaatcccagcactttgggatttggggaggcgggcggatcacgacgtcaagagatcgagaccatcctggctaacacggtctctactaaaaatacaaaaaattagccgggcatggtggtgggcgcctacagtcccagctactcaggaggctgaggcaggagaatggcgtgaatgcgggaggcggagcttgcagtgagccgagatcacgccactgcactccagcctgggcgacagagtgagactttgtctcaaaaaataaaataaataaaataaaataaatgcttgaagaaaagtcaaaagtaggagaagaattttgtgacagctgaaaattatagaaatttgtatttcattgtttataataaagttttattggaacacagctgtgttcatctatgtatgaggatattccgcactgtatatcaaagctctgtgggcaagcttcttcctgctgaggcagcacagctttctggatggccatgaaaagcaactttcatggtacagcagcagagttgagtattgtcacagagactctagtccacacagtgttcagttatttactgtctggtcctttacagatatctctgcccttccctgctagtttaagcaatcgtttaaatttacttgtggtttttttttgttttgttttgttttttggtttttttttgtgagacagagtcttgctgtcgcccaggctggagtgcagtggtgccatctcggctcactgcaacctccgccttccaacttcaagcaattctcctgcctcagcctcctgagtagctggtactgcaggcgcatgccaccatacccagctaatttttgtatttttagtagagatggagtttcaccatgttgaccaggctggtcacaaactcctgacctcacctgccttggcctcccaaagtgctgggattacaggtgtgagccaccacactcagcctctgaatttacatttgatcatatttttgattgtttactgtgcagtgtgctggttttgacatgcagggtggaatatcctcatgttggatggcaggttattccataagctcatcttttaatagaaacagaatcccttcaatgtaatctgcaaaagataaccactgagcatctccttggtcactggaaattgagccacaaccattaagaaagtggaccagctgttctttcttttccctctctgaccgaccgaatcattcatttattcaacaaatatttagtgagtgccggctgtctgcttgccactgttcagccagtgacgatgaatggtgagcctaacaaaagcccctccttggggaccctacattctcataggaggagatggatcgtaagcactggggggaagaagcaccaggaagaaaagacaaagggggagagagagagagagagagctggggcaagagagggctgctggagatgtggtgctgggccaaggcttttggccacaagaatcaggtgagtaggaatttgtgacatgaagactcaggaggtggcattccaggtggagggaactgcaggggcataggcccccaggtggagccagtgcggcgtgtttgaagaatgggaatgctgttctggaggccagggcagaggtgaggacagaaaaatattggtggggcgagggacaggtttcggagggcatggcacggcagggcagaataaggacttaaaacatttttaattctgggagagacgaaaaggctttgagcaaagaactaacttgatctggtaatgttttttaaaaaaatcactgaaattacaagatatatcctctgccttgtggtttattgcagataatggcattttgtggattaaaagaaagaaaaaccctttcagttcaccagccacaacagttagctttaagagtgttataaaagtaggatcaaaacaataggaattacaggccaggatcttcttaggggagtgttcaaagcttcaggtatccatatcagtccaggtcccataagaaaacaggtggcatatggtaggtaatgggaagacaatggactctagtgtggagggaatgccactcctaccttggtgcttcaggacaattaatctgctagtgttgtttagaatggattgaagaacagaggggaagaaggtagggagaccaaattgtttcattaaattatataaaaaattttcaaaaaaagtcagcttctattgtggaggaaaactattgtacagaccccagtcagaacagtgaagatacttgtactgtcctcaagtgtcattgtacttgttgattaacatatattaaaaacaagcaggtgtggtggctcacactggtaatctttgcactttgggtggccaaggcaggaggattgcttgagcccaggagtttgagaccagcctgggcaacttagtaagactcctgtctgtacaaaaaataaacaaaattagtcaagcctggtggtgtgccctgtagttccactacttaggaggctgaggtcagggattgcttgagctcgggaagtcaaggctacagtgagtcgagatggggccactgcactccagctttggtgacagtgtgagacactgtttcagacacacacacatacacacacacatacacacatacacacacacacacacaaccaaaaaaggaagccatatattaaaaatgttgccataaaaaatattggggacagggtatataggagccacaaagacgtggctgcatccgggggctagtaatagccaagctcctcccactcctaggcctgaggggtgagggaggaagcagtttccaggggaccctatatagagagccacctgacaggacccagggaatatggtgggaaaggatttggctgaaccaaaatgggagccagtgggcaagacagcctgttgttaaatgggtcagcttcccagaacacacaacacggtggcagagtagagggcaggtggaggatttccatcctaggggacacctcaggagtcttagctgcatcccaactctgtcgctttccctcactcccaccaccagccacaccacagatgcgcacgcatgagcgtgtacacacgcacgctcccaagtaccctctggtattcttccattgcttttctgaccaggacagaggaactatttattaattgtgaaatttgaggacatttctcattatttttgtggtatttgatgctataatatttgcaagacaaggaacatgtgggtagctctacgcattccattttccattcctgataaaaattcaaagcacgtatgttactgatgctagagttaaacattttattttttaaaagtatcatttctaattggctgcagaaggaaaaatacagtaagcaggacattaaaaatcttggggaactatattcagttttggctattctggttacaaacaaagcaagcattgaattttagccacttcaaacagttttcgttttccaccgttgagcatgttaaaactgtgaagacacagaagtaccattcagtaaactgcttctttcagcagcttctgtgatatcccagtactttggaagccttccattttctttcaggtacaagaagttaacaccctgaattagtcactatctgtgtatataaagccaggagctttatattttgtactgaggcagagctgaagtttttagataatttgatcttttaaaaatatttgacttttcacttgatttaggttctgagaatcaaaggttctactaacaaaatggtcaacttggcaaagagaaatatgcagaagtcaattttaggctgtattttgcaagagcgcggtgcctgtgaaagcagcccaagctgtacggatggtgaaactcatttttctcccctactttttctggaatctggccaaaaattaagtatcgtggcacattttctcaacaatcttggccccaaattggagggctggctcagggccccaggggaaaagaaaactcccttttccatttatgattatcagccatgttataaaacttaaacattattttaaggtcaaggaaaataagtcaccttgaatttcccgtaagttttgaagcactggaacgaggtctgtttttgttccttggcttttgctcatgtgtcggttttgcagcacaggatcagtcacgtggttgtggggcctttggggttgaggagcttccactgcatgcaaaggcactttgttaacacagcgggacctgggtgagtgagccaggtcctaggcctgagtcggtttatataattctgctcaggagattggaggcatgaacagataggtggcctgcagagaaagagagaacctccatggatgacaagaggactgtggaaaattattaaaaaatgagagggatcctgtctttctggtggagagagtgaaaacacagctggcatggagccaggccttgaaggatcctgaggaacagagtcactagtcgtggatttgaatgagttctgtgtcttgacttcaactcgtaagcctccgttttcctcatctatataatggtgatgacatctttaccacccatatcacggtatttttatgaggctaaattacagcatggaacacaaaccataaaatacccgaatgctgttacttattattgtcatgaatattatcaaatggcatctgttaaatatttatttttgatgcttgttatcacatttgtagttttccaggagtttgatctaaaaaacacagttgctgccactgatggtgatttcttaggccagctccacataggaaggtttttatatgtggtagactttttatatgtgcagatctcacaaatgcagtgtggagtctcttgttacagttgagaggagtctctggacagggtatgtgaaaggctgagctcccttctttaggcaggaatcggatatagtatggtggagtatgttaatgtacagacagacgcttgaagttctgggtttaagattgtctatagaacttgggaattgggactgcgatttttaaggaaaaaaaaattgccaacttttttttttttttttttttaatggaacttcctagagcctttctgggacttactttacttgttagaggagtaggaggtgtggtaaattccttcctgggtatgttaattaaaatgtagtgaattaagctggagaacttggagcccgaaacatgttagtgttgtataaaaggaggaatataaatgcatgagattaagtttaaaaaacacgtgccacacatttagctagagatcctagttcaaactcactcccccagtcggccccattcacacgtttcagtgccaccttctttgttaaagacgataggactacacttctttggaattagtttaagaggtagtttataagccagtcaagaaaattgacctcatgttcatgctcttaaaaaaaaaaaatcaattatttttgagacaggcctcactctgtcacccaggctggagtgcagtggcatgatctcggtttgccgcagcctcaacctccagggctcaaaccatcttcctgccccctcctcctgagtagctggggccacaggtgcgcactacaacgcctggctaatttttgtatttttgtagagttggggtttcgctgtattgccaaggccagtcttgaactcctgagcttaatcattttgcctgcttcagcctgccaaagtgctagaattacaggcgtgagccaccgcgcccggccagtcttaattttttttaaagcatttttagatttacaggaaaactgagcagatagtacagggtatctcaatactccctcacctccctttctctttttttgtatcttaatatggtatgcttgttataattaagctatattgatacgtttttattaactaaaggctatcagatttattcagcacatataaaaagtaccacatataaaaaccttcctatatgaagctggcctaataaatcaccatcagtgatagtaactctttttttagatcaaactcctggaaaactacagatgtgataacaagcgtcacagacacataaatatttaatagatgccatttgataatattaatgacaataattaacagcattcgggtatttgacggtttgtgttgcatgctgtaatttagcctcataaaaataccatgatatgggtggtaaaggtatcatcatcattttatagatgaggaaaacggaggcttagaaattgaagtcaagacacagaactcattcaaatccacgactagtgactctgttcctcaagatccttcaaggcctggctccatgtcagctcattcaaatccacgactagtggctaattagatcagatttccttagggttttttgtttttgttttttgttttttgttttgataggatcttgctccatcacccaggctggagtgcgtggtacaatcatggctcactgcagccttgatctcccaggctcaactgatcttccttcctcagcctcctgaatagctgggaccacaggtatgccccactgctcctggctaatttttttttttgttttgttttgtagatacagtttctccgtgttgcccaggctggtcttgaactccagggctcatgtgagtctctccccacttagcttctcaaagtgctgggattacagatatgagccactgccctcagctagatttccttagttttgacctgagtcaaatactgtcctttttcatttgccactttatcccatcatgtagaacagttgcctgacacatagtgactttgcacagatgttgttgaaataaagatgctctgcctgcccttgagttggtataatagagtagggaaggatcaagccatggtgcaaatgacaccacactagcgcttaggaatttggaagcagatggggctgagtgggaatgaaccctggccctaccatccaccaatcctatgacttgggcaagtcacccatcctctcaacctgttttctcacctgtgaaaagaagatgataataattcctaggccaggcgtggtgcctcacgcctgtaatcccagcactttgggaggccaaggcgggtggatcacaaggtcaggagttgaagaccagcctggccaagatggtgaaaccccatctttatcaaaaatacaaaaattagctgggcgtggtggtgggcacctgtaatcccagctattcgagaggctgaggcaggagaattgcttgaacctgggaggtggaggttgcagtgagctgagattgcgccactgcactccagcctgggtgacagagtgagactccatctcaaaaaaaaaaaaaaataataataataataacaacaataataattcctacctcattgaggtagggattaaatgaaagaacacatatgagagtttccagactctggcctcacccatgagaaactcttagtaaatatcttcttaaagaccatgcaggacagaatgtgatacctgtgatgtgagctgcagagtgtcactgagagtcagaaaagaggggatcgcctaaagttgggatggggggttaggaaagctttcctagagagggcaacatttgtgatggacccaaaagaatgggtctgttcttaactgagggacagtgatgggagaataaaacaccaggttgagagactgtatctcacaaagcgacagaggtgggaacgtgtgagaatgtcttttggaggaaagaaaatcacccaatgtaagtggactataatttaatttggcaagacaacacgacgagagagagaaaggtgtaaggccataaatgcttttgacagatatatatttcagcttttctaaaagttttcaagtatagaaaaaagaacagtacaatgaacacccatataacccccctcatttatacaattattaacattatttgctttctgtatagaaatcaatacatattattttttgccaaatcattaaaaattaattatagctagcatgactttatttttttgagacagagtttcgctcttgtcgcccatgttggaaagcagtgacgcgatcttgggtcactgcaacctctgcctcccaggttcaagcaattctcctgcctcagcctcccgagtagctgggattacaggcacccgccaccatgcccagctcatttttgtatttttttaagttatacttttaagttctggggtacatgtgcagaacgtgcaggtttgccacataggtatacacttgccatgttggcttgctgcacccatcaacccgccatatacattaggtatttctcctaatgctgtccctcccctggccccccacccaccgacaggccccggtgtgtgatcttcctctccctgtgtccatgtgttcccattgttcaactcccacccatgagtgataacatgcagtgtttggttttctgttcctgtgttagtttgctaagaatgatggtttccagcttcatccatgttcctgcaaaagacatgaactcatccttttttatgtctgcatagtattccatggtgtatatgtgccacatttgctttatccagtctatcattgatgggcatttaggttgtttccaagtctctgctattgtgaactgtgctgcaataaacatacgtgtgtatgtgtctttacagtagaatgatttataatctttttgtatatacccagtaatggggttgctgggtcaaatggtatttctggttctagatcctcgaggaatcgccacactgtcttccacaatggttgaactaatttacactcccaccaacagtgtaatagtgttcctatttctccacatcctctctagtatctgttgtttcctaactttttaatgatcgccattctaattggcatgagatggtatctcattgtggttttgatttgcatttctgtaatgaccagtgatgatgagcattttttcatatgtttgttggctgcataaatgttttcttttgagaagtgtctgttcatatcctttgcccactttttgatgggtctttttttggaaatttttttaagctccttgtagattttgaatattagccctttgtcagattgatagattgcaaaaattttctcccattctgtaggttgcctgttcactctgatgatagtttcccttgctgtgcagaagctctttagttttaattagatcccatttgtcaattttggtttttgttgccattgcttttggtgttttagtcatgaagtctttgcccatgcctatgtcctgaatggtattctctaggttttcttctagggtttttatgattttagatctacgtttaagtatttaatccatcatgagttaatttttgtataagttgtaaggagagggtccagtttcagttttctgcatatggctagccagttttcccagcaccatttattaaatagggaatcctttccccattgcttgtttttgtcaggtttatcaaagatcagatggttgtagctgtgtggcgttatttctgatgcctttgttctgttccattggtctgtatatatgttttagtaccagtaccatgctgttttggttactgtagccttgtagtatagtttgaagtcaggtagcatgatgcctccagctttgttctttttgcttaggattgtcttgggtatacgggctcttttttggttccatgtgaaatttaaagtagtattttctaattctgtgaagaaagtcaatggtagcttgatggggatagcattgaatctataaattactttgggcagtatggccattttaacaatattgattcttcctatccatgagagtggaatgtttttccatttgtttgtgtcctctcttatttccttgagcagtggtttgtagttctccttgaaggggtccttcacatcccttgtaagttggattcctaggtattttattctttttgtagcagttgtgaatgggagttcacttatgatttggctctctgttcgtctattattggtgtataggaatacttgtgatttttgcacattgattttgtatcctgagactttgtggaagttgcttatcagcttaaggagattttgggctgaaatgatggggctttctaaatacacaatcatgtcatctgcaaacagagacaatttgacttcctctctttttatttgaatactgtttatttcttcctcttgtctgattgccctgaccagaactttcaatactatgttgaatacgagtgatgagagagggcatccttgtcttgtgccagttttcaaagggaatgcttccagcttttacccattcagtatgatattggctgtgggtttgtcataaataactcttattattttgaaatacgttccatcaatacctagtttattaagtttttagcatgaagaggtgttgaattttatcgaaggccttttctgcatctattgagataatcatgtggtttttgtcattggttctgtttatgtggtggattacgtttattgatttgtgtatgttgaaccagccttgcttctcagggatgaagccaacttgatcgtggtggataagctttttgatgtgctgccagattgggtttgccagtattttattgaggatttttgcgttgatgttcataagaaaaatatggaacgctccatgaatttgcgtgtcatccttgcgcaggggccaggctaatgtctgtgtcgttccagttgtagtatatgtgttactgaagcgagcactaatttttgtatttttagtagagacagggttcaccatgttggccaggctggtctcaaactcctgatctcaggagatgcacccacctctgcctcccaaagtactgggattacaggcgtgagctaccgcacctggcctgtcatgacattttaaccctcaatactttagcatccatctccaaaaaaataaggaagcttcataataaaagtacaccaccattatcataccaaacaaaattaacagtagtccccaaatattacttaatattagtccataatcaaactttctaaattcatttcccagacctttagtgttttaacaaaattttaaaccagaatccaggcaaaaggctgtgtattgtattaaatacacaatcatgtcatctgcaaacagagacaatttgacttcctctctttttatttgaatactctttatttctttctcttgcctgattgccctggccagaactttcaatactatgttgactagatgagtgacaatttagtcaaattgtccctgtttgcagatgacgtgattttgtattgcattgttatgcctcttacctctctttaaatctaaaattccagctatgatattgagatttttaggatttggaacattgaaaagattatggagctttcccccaactcagatatccctatctaacaccaaaataattcaaaaaagaaacaatactgaatttcaaagtaaatgtaaggaagtccatataaattcagatattttttctctcatcaggttggtgcctttgatactagttttgcaatttcaggtaatcacatttttaaactcagcatatgcttgctttccttcagttaaataacccagccctggactcacagaattcaatagacatacagtggctcgttgttttctgttgagctgaatatctggtatgtctaaccttcacagatatgaaaccacattgtttttttttttgagacagagtctcgctctgtcgcccaggttggagtgccattgtgcaatctcggctcactgcaacctccgcctcctggattcaagcagttcttctgcctcagcctcctgagtagctgggattacaggtgcatgccaccacacccggctaattttgcatttttagtacagatggggtttcaccatgttggtcaggctggtctcgaactcctgacctcatgatccacccgccttggcctcccaaagtgctgggattacaggcgtcagccaccacgcccggcctgaaaccacattcttaataatgctgtgtagacccacagaagtgatttttggcttcattgtatttacaggttttttgaaccctaggttccaaccttagtggaatttcatacagaatttcacagtttttctttaaggaaaaacatcaggtaggactgtgggcagaactatagtatgaaaacccatatcctgcagtgagaaactcttacctggaagcgggaaaggagtagaacgcagagtgtgcagggcgctgccaggcctgctataaccaggagtgccctgcataggccatgggatggttgggtgccttctttttggccctgcctgtatcccagatacttgtggccaagcaagtccctggaattgttgcaggcattgcagtgggagtgaaatgcccaccagctgggctacatcttccacgactgagggaatataacttggtattcattggaactccactgaagagaggtcgggtgctttgggagtgttttcttgcaaatatgtgccctctaattgccttttcctaatgatctctcctcattctgctttggaggtggggtttctccaaggatcatttcttttccacctcacctgcaggtgcacagtgaatgatgctttaatttatttcatttcaccttgctgtggaactcagcccatcccacctctgctgtgagaaaagcatttccatctgtttcaactttcctgtggttctgttgacccacttggaagagctccagtgtagtgcctgctggtttttttctatctgcccttaatttggtttgccttttattgtattccaactgaacggattctttctctttcttttaagggaaaggacctgagaaaaacaatacttgtaatggcgactgcttgttaagggtaattgctgtttcatgttaatttgcatgttaaaatgagaatatagggaattgctaaattcaccaacctgttctatcccaaggctagtccttttaagtatatttgttgcttaaataaagatggagctatgcagaatggaaatgtccaaatatgcagttttttttgtgcatgtatatatagagagagcatttaaaatttttatttccatcagcaagagtcattatacaatacatggaaattacagaaaagcagaaagaagaaacccagagacaactagcattaacattctgtgaaattatgtctagtcatttcaatctacatgttatatactctttaaatgggaatagtttcactataactgtctagaactttttgctactccaaagaatgttctgtggatcagcagcattgctatctcttgggaacttgttagaaatgcagaatcttgggctccaccacagacatactgaatcataatttttattgattgctattacatatacattaaaatttggaagcactcttctgcaaatggggtccccaacccctaagttttggagtggtaccattctgtggtctgttaggaacagggctgcacagcaggaggtgagtggcaggtgagtgaggaaagcttaatctatatttccagctgctccttatctcttgcattactgcctgagctccgcctcctgtcagatcagcagcagcattagattctcataggagcacaagcccttttgtgacttgtgcatgcgagggatctaggttgcccactcgttatgagaatctaatgcctgatgatctggtactgtctcccatcacccccagatgggatgtctagttgcaggagaacaagctcagggttcccactggttctacattacagtgagttgtatagttacttcattatatattacaatgtaataatagaaataaagtgcactataaacatcatgcatttgaattatcctaaacccctccaacctcccctcaccctattggggaaaaattgtctttcacgaaaccagttcctggtgccaaaaaggttggggaccgctgctctagaacatactatacccagggcagcatgtagagagaacacaaagtagaggggatgcaaaggggctcagacctatattctcttctccattttctgtcagtcttgcctaaaataatttttgtcagtacatgataaggataaaaatgaggtctttttttttttttttttgagacagagtcttaactctgatgcccaggctggagtgcagtggtgcgatctcggctcactgcaacctctgcctcccgggctcaagtgattctcctgcctcagcctcctgagtagctgggattacaggtgcccgtcaccacacacagctgacttttatatttttagtagagatggggtttcactgtgttggccaggctggtctcgaactcctgacctcatgatctaccctcctcagtctcccaaagtgctgggattataagcgtgagccaccgtgtccggctgaggtcaaattttttaacagggtacgacaaccttgttgagaaacacgactgtgccatgtgtaatcatttcactcagtaaacactaagtgcctcctgcgtgccaggcacatgtgtggcagccacgggccttgcattccggcttgcatgtgctgcagtggaaacatacagaggccaaggaggagggagtggttgcttctgcagggatgggggctgtaaattagaaagaaaggtggtctctgggtggagtcttgatggataaatcagttatcataagttatgagtattaccaggttctggagagaacacaaagatgataaaatttgtctcatccttcaaggaccttatgcttggttaaaggacaggagacagtgtttaaaactaaataatacaaagcaccttgatattagggtagaaccagaagacaagggtctgaacattaattttttagctccgtgacctttgacaaattattccacatgttggaacatccgattcttctgtaaaatagggataaaatgatataaacacctttataaaatcatattgctttcttggccaggcgcagtggctcacggctgtaatcccagcattttgggaggccgaggcgggcagatcatgaggtcaggagatcaagaccatcctggctaacatggtgaaactccatctctaccaaaaatataaaaaattagcccagtgtagtggtgggtgcctgtaatcccggctactcgggaggctgaggcaggagaatggcgtgaacctaggaggcggaggttgcagtgagccaagatcacgccactgcactccagcctgggtgacagagcgagactccatctcaaaaacaaacaaaaaacaaaacaaccaaaaattagctgggcgtggtggcacgcccctgtagtaccagctacttgggaggctgaggcaggagaattgcttgaacccgggaggtggaagttgcagtgagccaagatggcgtcactgcactccagcctggcgacagagcaagactccgtctaaaaaaaaaagaaaattatagtgatttttttctttttttagtgtagagagatagggtcttgccctgtcgcctaggctggagtgcagtggcacaattgtagcccattgcagcctagaacttctggcctcaaaggatcccccacctcagcctcttagagtgtcgggattacagcgagaaccatggtgcgggacctgtagtgctttttaaagtgaaataacatagcaaagcactggcttgcagtggatgtggaatcaatgctgtgtggcaaagatatttaaaaagtgccaagtgagcaccatagatggaaaattgaggaataacagagaaaaagagagagtattttgacttggagtgtgcgaggccatgtggcctgtgtggccttgaggatgctgatgaggcagagaaggtatgaagaatgggccagtgggaagagaagcaaaagaggaagctgcagttttgagactggatagaccaagaaaagagataggagaaacaaggggttgggtttgttggggtgatgtctgtcttagacatgtcaggtttcagggactgctgaaggctgtaggcctgggtgcgtgtgtcagacactgcccttgatgcaggctcagccaggggtgggtgaggaatgaggtccttggccctccctgggcagggtgtttggtcagtgtaaatctggaaaagggaatctttctgacttgttggaaatgtccgcacctgcacagcgtttctcaccaggatgggaaacacaggctgaatgttttaaaccttgaagacctacctcttcttcagacttgggtagaggagaactgaacttttctgtgtaatttttacccactgtcatcctcttccacgggtctctttttttttcttctcaacgttcttcctcccaactgagaaccattaattgcttcagaaaagaaatagaattggatttcttttttttttaagaaatggactaaatgctctaacactgaagaactatattcctatgtgcgtcagtttcttttcaaccattagctcctttatgatctctttatacagggtgggtatagcccacaagtaactatggttactagtttttataggttgtgaccagtctgctgtataaggtgttaacattttgcccaatctgccttatctccatctcttctgtttttttgtgtctgtgtctctttacacgcacacacttaaaacatgtttgctgaaccatctgagttagttgtagagattatgaccttttcaacatgtatttctcaagcacaaggatattttcccacatagcctataataagatgatcaccaataaatattatctgatatataaataatacttgaatacatgttcagatttcacctgttaccctaatactgtcttttatacccgcctcccaatccaggatgagtcaacagtcattcattgaattttgtctttttagtttcctttaatctaaaacagtcaccctgtttttgttttgtttttgtggttcatggcattggtgtcttgaaagatacctttgttttgtagaatgtatcacaatctggttttgtgtgattgttaccttatgattagatacagattaagcatgtttggcaaaaatgctacatagtgactgtggcgatacctactgttccattgtcctggaattgattatgccgagcaccacttggttgagctggtctgccagaactctccgtttgtaaagatgccttttctcttaggtaatctgtggggtgatattctgagactgtgtgtgagtgttctgtcctacaacaaccctttctagaatggttttagcatgtattaatgattgttgactgaatcagtgattgcattggtagttgcaaagtgggattttcttctgctctccctttgatatttattagctggcatcctttataaagaagagtttcccccattattttttcaatgaatatttgtgggtttatggtttcttttttaatccaatgtattatagttcatcaacatcattcttttttttgagaaagggtctcactgtgttgcccagactggagtgcagcggtgtgatctcagctcactgtaacctccgtctcccaggttcaagagattctcccacctcagtctctcaagtagctgggactacaggcacctgccaccatgcctggctaatttttgtatttttttgtaaagatggggtttcactgtgttggccaggctgatctcaaacacctggcttcaagtgatctgcctgccttggcctcccagagtgctaagatgataggcatgagctactgtgcctggtcaacatctttttttttttgttcaaactgccccacttttggctatgaggagcccttttaaagcttctcctcctatgtccttttgtcatgtctgcattagcatttgagcactcccttgctttttggcacagtaagatgttctgggcttatcttgtactttctctgcccagacccaactatttctccagtaagcaaaagtatttagaaaccaagatctaggtacttgggattttctttaaaaatgtacctaatctaggccaggcacggtggctcactcctgtaatcccagcactttggaaggccgaggtgggcggatcacgaggtcaggagatcgagaccatcctggctaacacggtgaaaccccatctccattaaaaatacaaaaaattagcctggcgtggtggcgggcgcctgtagtcccagctacttgggaggctgaggcaggagaatgccgtgaacctgggaggtggagcttgcagtgagctgaggtagcgccactgtactccagcctgggcaacagagcaagactccatctcaaacaaacaaacaaacaaagaaacaaaaaaaagtgcctaatctataaaaagttaaaagtcattaatcatttaagttcatccacccatttcccaagattattcccttggtggcatcaagagttttagatgttcaccaatgaagggagaaggccatccaaagtgaaggtctttgggctttgggctagaggttgaagaggaatgcacaaagggaaatgagatagtgccaaagattaacttagataacattggaattctgccccagaagtgacttagagagcctgagaatatagtttctgtgtgttttctaggtagactctgaaaattggttacccttttttatatccattaatggtaagataatttattcccctgagctatacatatgctaattcttaaagcaatttaagatgtgtagtttccatgccaagagttcctaactgctctgtattttcagagtcagtgtaaggtatgtatatgtgaatgtatatctcagcatgtctttgaaaaattaagattcatagtttttattttgaatactcataattggacacagtctctggattttctggttgattataatagttggttaattcttttttttttttttttgagacggggtctcgctctgtcgcccaggctggagtgcagtggcgctatctgggctcaccgcaagctccgcctcccgggttcacgccattctcctgcctcagcctcctgagtagctgggactacaggcgcccgctaccacacctggctaattttttttgtatttttagtagagacggggtttcactgtgttagccaggatggtctcaatctcctgaccttgtgatctgcccgccttggcctcctagagtgctgggattacaggcgtgagccactgcgcctggccaatatttggttaattattaaaggtgcatatgcgcagcattttaggcagcaacttgtgggacacaaaagccaggaatttcaaaatttccaaaacaatcattgtgcatttgatataatgatagagtctctgaggaggctgtaaaccttaaattgactgatttgtctggagctccatatttcttccatgatatttttatatataatagcataattaaaatatttattttgccttttctatttgctaaaatgaaacaaaacatgtagtaatttggtagagaacctatatgaaaatgctaaaaaatacaaaagcacatttgaaacataagggtttgtttttgtttttcatcggtgtcagcatttttggaagtaaaaaacaaaacaaaaatagactatacatctatgcattgtatatcagggatatggttattattcagctatgtatgctgaatgttaactgctttataattttataaaacaaaactaccaccctctcctacacatacaaccactgactttcaatcctcagcacattcttgagagtgggagtcctattaaagtaactgccctatatgaagtagttactgggtgtgcaggtatgccaggaaagctaaattgaaagtgaaaagggacacatcacttaaatatgctgctagtgcactactcacaatagcaaagacatggaatcaactcaggtgccccttgacagtggactggagaaagaaaatgtggtacatatacacactagaatactatgcagccgtaaaaaagaactaaatcacgtcctttgcagcaacatggatggagctggaggccattatcctaagagaattagtacaggaacagaaaaccaaataccacacattctcgcttgtaagtgggagctaaacattgagtatgtatggacacaaagatggaaacagtagatactgggacccacttgagggaggagagtggcagggccaagggtgggaggagggtgaggattgcaaaactacctattgggtattatgctcattacctgcgtacaaaataatctgcataccaaacccccacgacacacaatttatccagataacaaacctgcatatgtgcctctgaacctaaaataatagttagaaagaaaaaaaatgaatagattaaaaataaaataaatgtactcctagccaagcatgggtgagtgaactcagatgtgtggtggccaagttgtcccaaattggcccttgattcctgtatatcctcagccttcagttcttaatgtgatatcagtgtgtgggattaaactaagcacactcatgactaaaagagtcactgtttttggcaagtatttaaagtcagttttgttattgggaaaattttaatatagccacgttcttttggaggttacaaagaccaatctctcttttcttacttgctatttaaaactcctcaaactggaagtttatccgcatgcccaaatgcatccctctttgtatttgtttaatcttgatcttgtttgaaaggagctttatccagaatacaatttctttattcagaatgaaatttctttcagatattaggacagcttagatacaattatataattaaaaatctttcaactggattttactaaatccatgactgtattagcctgtaaaagcaaattatattttggcctctgtaatgggtttataaactttaaacatccctattgggacggactgtatttgtccttgaattatgagatagaaaacactttcagaggtccagccgcatgactggacctattaatacttgtgattgacaaggaagctcctgatgttcttgtttttttggctagccttcattctattggctggattcacatgtgacgttaaagtgggggtaaaaaggatgttcccactaatgcaaaatataaagaaagtaaaaattactctgttgtaattctaccatttgtaactagcagtttttcaaatgttggctttttttttctttctagtcttttttcttataaacaaaactgggaagatgagtatattacattatagtctactttctcaatactgcttaagaacattttctccttttattaaatattctacagattttaaaaaactatccattgttgagtattgtgttttaaaaattatttataagagtattacttataatagaaaaattccttgtatatatctttatgcctatcttgaactctttaaaagaaaatttagagtctttttaatttattggtttttaagaatgaaaagtaattccattcattttgtcctttccagcaattatggttaagctgtcttgtctgcaagaatctatctttataacaccgtcatcttgatctgtccaaaatggtcctgtaatacctcctttaacaactttagggaatcttacataaataaatttatcatgtaactgaagctgacccttaagtgtctatggttggtaattgtaaacattgtgaaagacaatcttttttaaattgcattacaatatgttgctgtcctcttaaacataatgacaaaatatgaaaatcacaatttcaccccttctggataaataacaagtatcttttataaacactagttattatgtagtcaattctgataaaatgatctatgtgttcttaaaaaccacattatgcagaatcctgcagtaaaactcacagtgcttaggagaggaatgcagttggggacacaatactcaaaaaactatcagtgacacattaaaaagggatgggaactgaataaatactgttgcacaaatttttcacatactaaatggttaaatacataaatagtgcaataaatatggtacttcaactcgaaaaagtcctgacatttgcttgtgaactcgtgctttagaagggttgccacttaggagttattgtgaagtggtggcagacggattacctgaaatcagatggagtcgggataccagatatggcttggtgtggctcatagcacactggtggaaaccgaagtcaccggtagatgtttgaggcatggactgtgttcattctgtgtaaccatatgcagctggttttggcccaagtgcagccttctgcgataacctagtattcttgcagtgaaatcatgcataaagaaacatgaaattcgagttacactcaaattgttctcttgaaaaaacacaagcgttatagcagaactgagtgtgctgtatggtaatacagtgatgcccaggggataggtgaaatgtgaaattctgcttgtccctatctgaagtagagttaatgcatgtaagacacagagaagaacctggcataagagttaacagtatataaatgttggcagtaacaatggcaatagtaataaatgatgcttatggtgtttgcagggttctgtctgatttttagttacaactacttgctgtagctgtgccctctttctaattgattttgcagtctcctgtggcttgtaaatgagtgtatcacgcttcttagaattacgtctagtagaagtcctgtaataggagagcccgaggggtatgccgactttaggttataggttacatatggcatctgttttgcctacttaaactattttatcttattaatgattttattgccttagaatccatttgcacgattgttggggaagtaacatgtttttctttttcttttctttttttttttttgagatggagtctcgcactgtcacccaggctggagtgcagtggcatgatcttggctcactgcaacttccgcctcccgggttcaagcgattctcctgcctcaggcttctgagtagctgggattacaggcgcatgccaccacgcctggctaattttttgtatttttaatagagatggggtttcactatgttggccaggctagtcttgaactcctgacgtcgtgatccgcccgcctgggcctcccaaagtgctgggattataggtgtgagccaccgtgcctggcctagaagtagcgtgttataagtgaggttagaattgtcagattttctgtttcattaggaaaaaatgaacacggctttctcttcccattcttatctgcagaaattaaggtgtgcttaatacatttgaagagtatttaaaagttgttgataactttccttaagttgttgtgattcacttctttttttttttttttttttttttttttttttgagacggagtctcgctctgtcgcccaggtcggactgcggactgcagtggcgcaatctcggctcactgcaagctccgcttcccgggttcacgccattctcctgcctcagcctcccaagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgattcacttctatttacaactacttctgtgttgataagatgagctcatgtttggaagtgggaactggcaagtgtgatttcggaagaccttccttcccaagtcacaatataattagaagtccagattctccctcggttcctttttgtgactccctgagaaagacatctttaacaggagtggttgccaagaagcctcactagttcctgcttttgaaactttaataaggcgacagatcgaactgccatctagatttagaaagccttgttagtatattatgaaagaaaaatagtttacatttctcatcatttaaggatcccaatgacatcgttattttgttgatgcagagatactctgaatgacagtcgggtattttgatttttcatttctgatatgattttgaatttaaaatttttgtctctacacactttctagatcgatctctttgggctgcctgacctccttgggtgcttgctattaattaacagactttgtggggaaaaaaaggagcttgccttctgagctttgtaccaaagacctgggaaaagtaagtaattttaaacttgcttttaaaaaattctgttatacctctctcagaaagttaacaatagatccatggctttttactttctttcattcctggcttaataaattttatatgttttcatggatttgtaacatggaaggagactcaggaaacctctttgtgtaaaaaaaaaaaacttgcaagagattaagatgatgttctacattgtgccatttcttttgggtttcataaactgagtcctcaaggttgtgacaaaacttttatcagatttgcaagtgattaaacatcaaatacaaggcaatgtaatatgatgtgacagaaaagtgagtccagttgtctgagctttcaggtgttttagacttttagatattttggataggctttttggttctgaatttttagaataagtatgaaatcgacttggttcttttcttgtctggaaaggaaagcaaaatgtggaattgcttgtccaataaattcttcatgtagctttgtcttggaagaattgatgcacctcccagttttattttagaatttttttgagggcactataagacattctaattgagacacttgttgaatgtttttgctgtcttttagaaaaaattgcttggaaccagaaaattcagttttattctcttatctttttgaaaaatggaccttacagatctataaagtcgatctgtttttttaatggatactgcttggaattatgagtgaccaaatgcccgtaacaatatatgcaaaataaaatatgcacgtgcacgcacagaaacatacacaaatatcctctctagcatgttccagaaacattatcgacaataggaattgttcttccattaaattactagatagctttctaaacttcctatgctttgtgtcttatagctccactctatttctggcagtataaatgagttagttgaagcatgtttaaaataaaacaagacagaacagaactttgctttagttctatgaaagcattaaatagtaagatcggattttatagctctgttgttattgtatttactataaatttaattattattaaattgggttttattttgtaataattataataaggtaagggtcttgagttttgaagcttatttgaagttaaatatttgtactgaaaaaataaatattttgggaggccgaggtggacggatcacctgaggttgggaattcgagaccagcctgaccaacatggagaaaccccatctctgctaaaaatacaaaaaaattagctgggtatggtggtgcatgcctgtaatcccagctactcggaagcctgaggcaggagaattgcttgaacctgggaggcggaggttgcagtgagccaagattgcgccactgcactccagcctgggcaacaagagcgaaactccatcccaaaaaaaacacaaaaaccatatacgtgtgtgtgcaacacacaaacacacatacacacagacatagacactgcacatacacatgtaatttctgagggatgtcaagtctctgctaaaatatgaattagttgaaagtaaggaaaatctcacccaaaatatatttttttgttacagtgaaatatttgtaatagtgaaatattattgtcagtggaatttaaaaaaaaaatagaaatttgtaggttgaattttattgtcttgtaatcacatgttaatcttaaaagaaatattttatgttgtaattgtgtgttgtagttgttattccattttggaaggatatttgaaaaaggattatgttggaggccacccaatctgtctacagaaatagaacaaaaaggtcaaatgattgattctctggacttcagggtctagatatttgcagtggtgtttagattgcaaatgtaacttagcttcagaaagtaagctacttaagctgcctttcaaataagctgccttttcaaatccttatttcaaagaaataagcatttctttaaaatttcacatagtctctagtgcagtattttctttacattataccaaaatattcccttttgggatacattgtagcattgttgtaaaagttgtgttttgattttatagagggaaggcatctgtgggacttgtgtgtttacagtaagctaaagacagccctgtgttactacagggactgtgacaaaaagatctctgtgtactaaacttgatgttaaggccagacgccgtggctcactcctgtaatcccaacacttttggggggcagaggtgggatgattgcttgagcccaagagctcaagactagcctggacaacgaaagagaccctgtctctacaaaaaataaaaaagttgctgggcttagtggtaagtgcctgtagtcccagctaatccagaggctgagatgggagggtcacgtgagcccaggagtttgaggttgcagtgagctatgatcacaccatagccctacagcctgacacttgagtgagatcctgactctaaaaaaaaaaattagtaaaaataaagttgatgttacatgtgaatatttatatacgcagaaggatgtttacaatgtacccttaaggttaaaaaaagagaaggttataatgcagaagtgtactgcacataaatctgattttgaagaactagttaagttacatggaagttaatgggaggggacgggaggggaggggggaggtgtcttttctgatatttattaaagtcataagaaaatgtttctgactgctctttgaaaactgtaagggatacttaaatgtcttggtggtttctttttggaaaagcaaacacacaattttagagaaaattcagaaccctagacaacctccacacttctttttaacctctgtcctttactttcacttttttcttaattgcatgtgtcttcaaagtcttccttgtttcaagcatttcaagcaattcagaaaattgattgtttgaggtagatttttggaaacttgagtctataatggtgataaaatataaccgtaccttcaaaaaaattagccatggattgttttaaaggaagtaaaatttgtattttattatcctacttaatgcatgtccatgtttggttttatgtcaaccctaaatgagtatgcagcaagttttttggtaactttttccacttaataataaataatgcatatccatgctaataagtatttacctacagcatcacttttagtgaaagggaaacaactggatcttagccttttgtttaattttgggctgtcctggctttcagttagaaaggagtgtaaatatgtggaatatatggcataggtttttcatgtgagaacagaacagaaaaggattccccatttagaatctttatggtgtttactgtagccagacatattctgaataggaggctcatgggtctgaatatgtgctcaaaatggtaagtgtcactggctgacaggtgctgtatataaagctttgtgtcttctttggtccctttgttatattatacaagagcgcaggtgacatattcctcctgccgagctgtcttaatcaatatttctgtgcctaagggaggattttacctacgcatttctttctccaaagaaactccaaatagctcagatgaaatgatggttacagaaggaacactgatagattttggaatataatttatttatggagcaaactacagtccaggttaattggagatccagaatgttttataaacctttgtgtgcattcttaatttttagttcatttattgagcgaacatttgttgagcaactattgtgtgccaggagctcattattcaaagatgaatgagatatgtccttccttttagggaacttaatttgagtttcaaaattagatttaaataacctttatgtagcatgtaccatgtgaaaagcagtggaatggacgttatattcttagacaagatgttcaatgactacaattcgataatgatatttattgacctatacctttcaaaataagttaggaatatagttttctaatttttaaaggtttttttctcccattatgattttggtacctgctgctactttttaagttaaattaggaaatggaaaaaggaaagttaaacaaattacaaatgtttaattggtaaatgtagagagtggttttgaaaacatggatgtgtgtgtgtacacacgttttatatttggaagcctatatgcatatagtgtcatcattttttttctagtagaatatttcttagttcacatgatacaattaaatatatttatcaagatttcttggtattttgcccttagagtgactctgtcgcccaagtaagtttggaagccataccgttaagcacttgatgtccacaggaattctaggggtgggcgttattgaaactcgggggaaaagtaacttgctaccttgatacagttagaacatgtttgagtcagccttccaattatgatgcatctcactacaaagccctgcagtatcttcctgactcccatgagctggtggtgaaagctgattcaagaatgctgtaggtatgcaaaggacgagcagtcatttcagctgagaaatcaggaagtatgttcactgcattgaagagctggaactgaagtatgacttgagggctgagtgagaagacagaaagtagggagataattgaggctgtagaaaaagcatatgccaaggcatggaggaatgggaactcatggcatatccagagagtggcaagaactccaccgtggctggggtatggagcgtggagaacagagtggaccctgagatcgaaaaggtgccagagtgagaaaggtcacacatgtgccatgctagagacttggagtttctaaacaataaatagccatccagagttttaaaaggagaaataactagatgggagttttataaagatcacttgggcagtagtgtggaatatcatctggaaaagagaaaactggaggctggagacccagggccaccatgtgaggttgtgtagattgttcactgcagaagtgtacgtgtgagcagcagatgggaggacttagaaccacccagcacacttgtcatcaagctgtgcactcatggggcttggcctgcctagagagagcaccttttataatttacacaatgggatgatctacttgcttttaattgttttaaaagtaataggtatgattagataagatgaaacagtgtcccctagggcctaagagtctggaggtgggcatactaagctattggctgtatgtcaatgggctcgttccctgtcctctgaaagcctatttcctcatctttaaaggagagttaataataggttctgacagggccctggacagaccagttaagagaaggggtgaaatatgagagatggagaaatgatagatctgggactgcaggctgctgctagctgttgtttagccctgagagtgtgctgggaactgtactaagaactttgcctgttttattttatttaatcttatatctgctttcagcagtggatgttattaccccattttcaagattttgaaactgagcccctggcaggtaaaataacttgtccaatgtcacacagccaaggagtggcattgtcactacttgaacccaccactgtaactgtcatgtttatgctcttaaccattttgccacatttataagtgatcttttctgtttcactcctttaatatcctccttgcatcctgtgttgtttttaacttgaattgatcatatttatgtaacattttatttaatttgctatactataagatcccgagggctggggtcaggtctcatgaatttttttgtctttcgtagcaccttgcttaataaaatatggcagataacactcaataaaatgtggttgacagaggctgggtgcggtggctcatccctataatcccagcactttgggaggccaaagcaggcaggtcacttgaggttaggagttcgagtccagcctagccaacatagcgaaaccccgtctctactaaaaatacaaaaattagctgggcgaggtggcatgtgcctgtaatcccagctactcgggatgctgaggcaggagaatcgcttgaacccgggagacagaggttgtggtgagccaagatcgcaccactgctctccagcctgggtgacaaagggagactccctcttaaaaaaagtggctgatagaattaataatctctaagattccttctgtcttctaaagttaaataatttttcattctataggtaaagcttcagttgcagttatacagttaaagtccagtagaacttaaaaagggcttcttggatgttagtttggtgtttggactgatggttaaagtttcaagaaattcctaattgccattttatctgaaaaataatttgtgacttgctgtcaaagactgaagcgaagagtaaagtgtacttcttgcaagccctttttggaggctataaagctatgcttgctgcttcattgctgcagcaggtataaaactccaatgtcataaatgatatttttgagttcataaaaaatattacattgtcactcatattagtaaggacctcagtctctaaactcatgtggagccccttgggccaatggtcacttgtttttttcttcttcttatttttattgacaaataaaaattgtatacatttatagtatacaacatgatgttttgaaatatgtatacattgtgtcaatcctaaattaagcgaattaacatatggattacctcacatagctgacagtcactcttgtttggtgcctgctggagtcagatttagacaacaaagtgacagttaagggcaagtgactgtcagatgccctggagtcagactgactgtataggtttggattccatctcttctgcttatgaacttttttttttttttttgagatgaagtttcgctcttgttgcccaggctggagtgcaatggcacaatcttggctcaccgcaacctccacctcccagattcaagcgattcttccgcctcaggctcccaagtagctgggattacaggcgtgcgccaccacgcccagctaattttgtatttttagtagaagtgggggtttctccatgttggtcagggtagtcttgaactcctgaactcaggtgatctgcactccttggcctcccaaagtgctgggattacaggcatgagccaccgcgcccggcccttcttacgaactttttaacccttggcaagaaaaaaatctgggaaatgaggatgggtaagaaaacaggttgtgatcataggttcatgtacctggttcattaggaacttagggaaaaaaaaaatccttatccacttggaagccactttttgctcagatacccttaaaaggaagccaaaattgtgaacttgtaggacagaatttagcacttcagcgttatagcctatgtttatctcaggatgaccctttgctgtttttaaagcagagttcacgtgctcttgtaactactgactgcatctactctcatgagccctaaggaggtagtttaggctttgcttcatgctctgtgtgcctgagtaaaataggaaatgatggcttttaagaaaatggaaattattacttgagatcaacatttcatctgggctttgaaaaactctggggtttctttcatcttccaggagagcagcacaactgagctgtgagaaaggaaaccaaaccctagggaaagttttatagctcgtttctgctgatgttactggaaaagaggaaggtaagggcctctaaatagctctcgtagcctcagtcgacagtaagttcaggtgttctggaaatagaacacaggggagctctttatccccattggcctctgcttggcctgaaggagagggtgaaacagcagcagaatggatctcttaaaacattgttgtacagcaaaaacaaatgtattcccacagcagagtttcatattttctttcatgaatttaaagttgaacagaggccggtgatatttttctcttttgaagttttacatcttagattgctgtaagagcaagcacagttgaatgaaaactctattcagaccaagtactttttttttttttttttgagacggagtctcactctgttgcccaggctggagtgcagtggtgcaatctcggctcaccacaacctccgcctctcgggttcaagcgattctcctgcctcagcctcccgagtagctgcgagtacacacacgcgccaccatgcctggctaatttttgtatttttagtggagacgaggtttcactatgttggccaggctggtctcagactcagaccaaatcttactcttgttgtctgtagctgcttagttctgcgctttaaactaagggcaaacttggctcctgcattcttgacagtgaaaagcaggagctaggaatgccgactttaaaaacccacttccaggtttgcctccacccattatgtgattcctgcaagaaagcttcagtctgctgtaagctggtaatcccttaatactttgatactttggtaaagcaaataagatcagattatataacttttccttttacttgtgaactaattattgttttcctgcatttaaaagcagatgttaaactcctcctttgatgttcaacagcagacagactctagttgtgccttacagcccttgatgcatgtctgttgtttgaatgaagatcagctttggcaaattagattttgatggctgcattttgatctggaccatagaagagaatggcaatttattcttttattcaacatttattggattcctgcctggccctttacataaattgtgttcagatctcacaaataccagaaaaccttgcaaaacatgtctattttatagataagaaaaaatagagcatagagagtggttagaaaacttgctcaaggttacttaccttgctgttaagttcctgggtatttggttggatttttttgctgacctcaaacctgttactatataggggctgccttttaagaggacataatcaatggagcaaagatcttgaggagctgggattaagaaaaaagtacttaatatataatcacagtgttgtggaagaaagaaataatcatgagcccctcattcattcatttactccgcagatatttatggactgcctgtgttgtgctagataactctgcaaggtgttggtgattcagtgatgggaaagacacaatcaatccctcaccaacttcaagaaggaagtagggatgcaagaaagagtatatgatatgttgctcccctaaaaggccacagtgtcttgtttgggagagcttttatgaagtttttcaagatgtaaaaatgttgacatcttcacaaaaattacttacttttttattcttttgcttcattatgtatacaaaagtatctgcaaataaacggggggtgacttcgctagcatactttgtagctgcactccttgtttgggctgctttggacgtgcagaagtggaggttggagcaaaaactgtattgcattttaaacaaagtcttgcaaacaaaaattgtggacaattacctcgcaaggactatatctaactcagctttgggtacccctttttccggagaagatagcagagtgcctagtacaactctgattggttggctcagtgatgggaaataaaataccaaagcaaggggagaggaacctcatagatgggggatgagttcagatggtatctagggagagtgtgagggtgacaataaaataagccgacaaatacaccaggggatcagatcacatggcatatcatggacttaattcacacttacagactattgcagtaaccaggagaggaagagcagtgtctaggtagtctggaaatgacattaggttttggtgcttgagagagactgcagtcttcctttgacttctgactcttctgactttctgctcacatatgagccctctatgccttcttccccactgtggtctttatttcattttttgagactttcagctgttatatgcagtaattgtttctttaataagttaggtgaccatacatactaacttgctgggacaatcctagctatgcctgctgttctggcaaaatttttgatactgacccctttcaatatcaaaaatgtcctggtttcgatcataaattaaataaccaccctactaataaaggaatgttgtagcattctatatctttttaaaaaatctttacagcattcagactgctttgatgaactaaatgtggatgtagtatcagtaatattacatagcagactagtgtctgatgtcttataagtagaaaaaggaaaaaatgagcagtagctgaaaaggctcaaatgtactgtagagagaaattaattgatttcaacaaaacgaacttttattacaaccagttgttggcatacccataggagagagggcacttaaaggttgccatgatgatgggtagtgtttagggaatctagcatccttcgagaaaatcttaccatagcttgttttgatttagagtttcagtgtttccattgcagtggtaatttaattcagatgcattttcatttatttcttaagtagaaagtaaaagaatataacttcttagaagaaagattctgtcagaggtttatagaaacgactggaggggaaatgttaaattcaaatttttcccttaaatcttcttttaaattatgtcttctgatgaaaatggtggtgttttaatcaaaggagatattcatatagggactcaatgggacaccatataatttatgtttgggtttttttacttaataagtagggttaaattgccattatagttcatatacatggatttgaagaaacaagctagtgtttcgttatataaatatatgtaaaataaaagctttcggtgttcaggtaatgcttgacaataattgcagtaggagacatgggcgtaggatcaaaacatgcttatgaccactcttttccatatcaatattttatgaaatagtgatgcagttaccttcagatcccatagtgacttgtaccctgcagtattatctcttaaagtagggtagatttacagagtagagggactgatattatgtaatctggaaattctgtttatctttgaattaaattttgactcttccactggctatctgtgaatgagttttttctttgagccacaactttctagcctataaaatgggaatactaatatctgctgcttagcttattaatagaatttttgttaactcctgaatctaggataaacatgaagtgtataacacaaaggttggtgttctcccaggctcaggagttaataccagatactgaggatggaaaaaatgtgtgattgttgaagggtgagactcaaaacataggttgagcttccctaaaaaaaccgaagtccaaaatacgaaaatagatatctgacactttttgagtgctaacatgatgctcaaaggaaatgttcattggagcattttggatttcagattttcagattagggatgattaactggtaattatataatgcaaatattccaaaatcccaaaaatctgaagttcaaaacccttctcttcccaagcattttgggtaaggaatatttagcctatagttagtgagcagtttctggccaatcagaaggatgctgactgtagatgttctggatggtcatcctgacacccacccactggatatcagcctcggttgtcaatgtccagaaatctgtgtttaacctgcgatggtttgcaaggaaacccactggatctcttagttaaattaatgccccttctctcagctttgttacctagaaaaaaaaattaatgcccctttctctgagatgatctggaagagaaaccattttcatatggtgaggtgagtctggacatcatgccttgatagctgtctcaaagattcccattttcattgcacaccctgctaagcattgctgccagcactgtggggaccagctctttggggactctgctttcccattttcctttccatccctcatctggaaacatgtccttaattccctagagaagatagaagttgagtttatgacttaaaaataaaacaaaacctgctagttatggcaggcctagacccattcctcactgggccctctaccaggctgcctctctggtttagaccatccaatccctacttcagaagtgactgtcagcacagctagatatagaatctaagcatcaaagaggatgaggccctggaagagggagggtttcctccttccttctcccaagtctttccttgctagtttccatttcttatctcaggatctgcttcttcccaggataattgaaaatgggaaatccacctctcacagcgcagatcctaacccctttccacagggctgcgatggcaatagccacagctgtcaaaaagtctagtatcagtacagaagctccccatataatcctaggaagttcctttgctagggcaggggtgagttgataaaccatagtgggtgtatattgatgtggtcaagagtctttgagaaaccactttgtggtgaccttttcaccaacagactaaggtaatactcctgacctttagctcaggagttcgattagagaagatagaggaacacaggaagcctgagtttacaatcatggttgtaccacctccttatgtgaccttggagacatcaagtacctcttctgcagttctcattttcttatccattaaatggtttcacatgtaacatgatttttaaggtccttgtcaatcacgaattctatatatctataataactcctaaaagtacctcatacaagttttgaatagattcagcttgtctgtatctgaaggtgacggttaccattcttaacaccgacttggtttgtgactgcggctgttttgtggaggcccacgcatctattgctggaaaaggctatccccccattatttggtattataccgctgtcttggtatgcttttgaaatacaatggcagaattgttttctgatgattatgataagctcaacaagtctcccctgtgattgtcttatgtaaaatgtcccactgtaggcctgaatattagtgatgataccgctttgtttaaaatactggattctggctggccacagtggctcacacctgtaatcccagcactatgggaggctgaggcgggaagatcacttgaagtcaggagtttaagaccaactggccgtcatggtgaaaccccatctctactaaaaaaaaaaaaaattagccagtcatggtgatgcatgcttgtaatcccagcaatgtgggaggctgagttggaaggatcacttcacctgggaggtggaggttgcagtgagctaagattgtgccactgtactccagtctgggtgagagagcaagactccatctcaaaagaaaagaaaaaaatatgtattggttcctctgtatctgaatagatttaattgcttctgatttgtgatgttgaatatactttatagattaaatacaggtgattgttggtaacttttaaggtatattttaaaagagaataaatgctgatttttccgtttctacagaaaacatcattggggttttaataggaattgcattgctttaagtagtatagatgacttaatgatactaagtgttctaatctgtgaacacaggatgtctttccattcatttttatgtaatcaatatttatttatttattttttagagaaagggcctcagtctgtctcccagactggagtgcagtggtgtgatcacaattctctatagctttgaactcctgggctcaagtgatcctcccgcctcagcgtcctgagtagctaagactatagatacatgccaccatgcccagccttttccatttatttgacttttatcttattctgacaggttttttgtgtgtgtgtgtgtgtgtgtgtgtgtgtggaatttttaaggttttctacccatgagattatgtcatctgcaaacaaagataattttactgtttcctttccaatttaggtgaattttttttttagccaagttgctctggctaggacttctactactatgttgataagaagtggtgaaagtggacattcttttcttcctcttgatcttacaggaaaagctttcagtcatttaccattgagtatgctattagctgtgggcttttcatatatgacctttattatgctgagatagtttccttctgttcctaattcgttgaatgttttttatcatgaaagtttgctgaattttgtcaaatgctctttttgtatcaaatgagatgatgatgtgttttttcctctttgttctgttaacatggtgcatttcattgatcaattttcatatgttgaactatccttgcattccagagataagtcccacttgatcatggtgtataatcctttcaataagctgttgaatttggtttagtagtcttctgctaatgatttttgcatcaattttcataagaaataatggcttgtagttttcttatttttaaagcgtaattgtttttctttggtatcagggtaatgctggtctgataggagtttaaaagtgttccttcttcatttctttggaggagttgaggattgatgttaattcttctttaaacatttgatagaattcggctgtgaagctgtctactctttgggttttctttgttgggaggtttttgattactaatcaatgtctctgctggttataggtctgtgttcaagtttttcatttcttcatgattcagttttggtaagttttgtgtttaggaatttgttcttttcatataggttatctaattttttggtaattatactcctataatccttttgattgctgtagaaacagtggtaatgtcccctttttcacttctgattttagttagtcttctttttcttagtcagtctacctaaaggaatgtcaattttgtcagtcttttcaaagaaccacctcttggttttgttgatttttcttggaggttggcttttatgactttcatttataacttattattatacaaatcattatagattatttcagtattagacttctttttttttgtttttgtagtttggcaatgaaaaaggcacctttgccttacatatgtagatgcatgaagggtttaaatagtcagcactttaaaataatgaacttgaatgtctctgccattttttgttccttgggtagtgcctttgtctcactactcattgtagtttgttcttattatttgttgcattattgtggttactctcttgtggatagttaaggtagtgtccatgatttgataaccaactggaaagtttccttatgttttcttcatgctgaactgctaaaaatttaggtgagattaattaattgtcattattatattaaatgaaaagccaaagagtgaacttagggatgaaagcttagaggaccagtggtctgaaaatttcaaattttaattctgattttctgaatcagtgatgttccattcaacatgtagattcattatctctctataccctatacccccatgtaaaagttttgatgttattgtaattcagtgagtgaccttctctgagattatgtgccataggcagtttcagtctttttttttttttttttttgagacagagtctcactctgtcacccaggctggagtgcagtggtgcaattttggctcactgcaagctccacctcccgggttcacaccattcttctgcctcagcctcccaagtagctgggactacaggcgcgcatcaccacgcccagctaatttttttgtatttttagtagagatggagtttcactgtgttagccagaatggtctcgatctcctgaccttgtgatccacctgccttggcctcccaaagtgctgggattacaggcatgagccactgtgcgtggccggcagtctcagtcttattttcaaggaaatgccactcaaacaaatcatttaatgacttacttatactgaagctgagaatctcgttcaggcttcttggcttactttaatttctccctcccttccttcatttcttccctgctcctcagaaatcaagaattttctagttatgttttctttttaaaaaaaaaaattaacaaaagttgtatgtattcaaggagtacaacataattctttgatatatgtatgtgtactgattaaaaatatggaatacttcacaaatttgcatgtcatccttgtgcagggaccatgctaatcttctctgtattattctgattttagtatatgtgctgtcaaagcaagcaatttaatttctttttgataattcatttactcaattcttttggaccagaaacattttatctcaggggcatgatgaacacttgtcctctgtagtgcaatgtcttgtgtattttattatcgaaattcttacttaaaacttacatttgcgaatcaagccatttctttttttttctttttctttttttgagactgagtttcactcttgttgcccaggctggaatgcaatggtgtgatctctgctcactgcaacctctgccacctgggttcaagcaagtctcctgcttcagcctcctaattagctgggattacaggcatgtgccaccatgcctggttaattttgtattttcagtagaaacagggtttcttcatgttggccaggctggtctcaaactcccgacctcaggtgatccgcctgtctcggccttctgaagtgttgggattacaggcgtgagccaccgtgcccagcctatttctttaagagatttctatcaaagttttcatagatttattagtttgttatctagtcactattaatgatcactttttttaccaataaaatatttttatattgcagctttataatacatattttattgattctaagacacagatcttttcacattttaatatctttaaaatttgatatatcttgcaatcactgacattttgcagctatgattcacagcattttaatttttattattttttaaggcctatgaatgtaacataacttttatttttattcttagtacagaaaatactggtgtatcttctagtcaacagcagttagatgtgatgaaataagttactgttaatgatcactgtaataattactgttagaaacttactgtgaaacttctacctttacaacaggacctataaatggcaatgaaacttttttttttttttttttttttttttttgagacagagtctcaatctgtctccaggctggagtgcagtggcgtgatctcagctcactgcagcctccaccttctgggttcaagcgattctcctgcctcagcctcctgagtagctgcgactataggtgcgggctaccgtgcccggctaatttttgtgtttttagtagagacggggtttcacatgttggccaggatggtcttgatctcttgacctagtgatccacctgccttggcctcccaaagtgctgagattacaggcgtgagccactgcacccggccacaatgtaacagttttagaaaaagtttagagtggaaaaaaatgacctgtaagccctaaagctatatactttaacaagtatattttgtatgtatttcattcccgtctttttacatgtgtacatatttttatctgtttgtagctatagcatacatactactttggtctacttatttttttattcctgttatatcttaatttctctttgtttcaggccttcatatttgtcttatttatttatgtattgagacaaagtcttgttctgttgcccaggctggagtgcggtgggatgatctctcctcactgcaacctccgcctcccgggttcacgccattttcctgcctcagcttcctgagtagctgggtctacaggcatgcgccaccatgcctggctaatttttttgtatttttagtagagatggggtttcaccatgttagctaggatggtctcgatctcctgacctcaagtgatcttcccgcctcggcctcccaaggtgctaggattacaggagtgagccaccgtgcacagcctatatttgtcatttttaatagttccataatctatcagtgtatgaccataataaaactgcatgccgcccagctgctgaaaatttagattgttgccatttttccttttgtgaataatgcttcagtgaacaactcttttgcatatttttattaattttatcattaattttggccatttgttttatgaaatataactttggagaggatctctttagccctgggatttgaagctgcagggagctatgattgtgtcattgtacttcagcctgggtgacagagcaggaccactaactcttaaaaaaaaaaaaaaaaaaaagaaacataactttgtagaagcctcctgaactgtgttttactgtgaagaatcaatctttatattcaaataaattcaaattaacagctgctattataacactgttcattcattctttcactcagctatatatcctccaagaaaatacactggatcattatgcgttccataggttccaagagctaaggaatcaaagttaaataggacaccccccgatgtttgatattttgttgcatagtgggagactcaaacttatcaaaaataagtactgtgtgatgagggatgttggaaagataagggttaaagtttcttagcatgtaatttactttgagagcattgttgattggtgttcttttaagttatgaggtgtggacataccatgttacgtttttaaaatgtgtctaataggtttatctgacagaaaatggcccctcctgacctatccataacttccttttaagtctaaacgtgtgtcctgtgatccaatgtttgtctagagttccgtgtcatgttcctccaacatactgtgtcatgttcctccaatatactaagttccctgttgccagtaactgtgtcacaagtctttttcctttctatacctactacaatctgctgtatttgtagtaggtgtcaaagtatcggtagttcatttgacttgcttttaattgtagttttttaaacgaatgacaatatttcaccaatttatactttccttagtacttcattgactatcagttgatattctatgatcaatgcaattttaattctgtcttgtcatatttgtttagttaaaaaaatttcaagttaagatggttgaaagattatataatcccatagagatttttatagtaaaagtttaaaattctggtacttgtgttggttggaagtagaaccttcactggacaaggtaaaacccctgtgtataaatgtttggaggctgtcttaaagctttgttgagatggaaaaaaaattttatataactaagtatcaattcaggcatttgacacaatgaatatattttggaaatagccatttatggttctagcattaaaggtgattagctagctatgaatttacctcctttatacgcatgcattacaaagtggaccctacttttaaatttctcaagaaggtattctggaaacagcttttgagaatgatttcttgggattttttttccctttttgtctttccatttctgaaacctgaatagaattgtgccatgttctttgcagagctgtggtgattagattgtacagtttcacacatgtgtacacacgtacacacatacacacacacagacacacacacactgctgtgcagaatcactgtcctgttgtgtgatcttcaaatgaagcaagagaggaataatctgggattgactgagataaatttatctcagctcttcaaaataccatgtgagcatagtgtaactcacttggacagctgtggaatgaaactcttgttttagtggccattagatacgtcaagagaactgactacgtagaagaatgtgtggtaaaggtagtttggcaattggtcaaatttgaagtagcatttacaggccgaggcaggtggatcacctgaggtcaggagttccaggccagcctggcctacatggtgaaactcctaaaatacaaaaatatctcctaaatacaaaacatctcctaaaacaaaaaaactctcctaaaaatacaaaaattagcctggtgtagtggcaggcacctgtagtcccagctactcgggaggctgaggcaggagaattgcttgaatctgggaggtggaggttgcggtgaggagagatcatgccactgcactccagcctgggcaacaagagtgaaacaacatctttaaaaaaaaaaaaaaaaaaaaggagcatttacatcaccaactgaaattaaataattgtcccccaaggtgatgtgtagcctgacttttgtgactgagggattgatctcttgacaagtctttatgaaataacaccacaggagggaaaattatatgcaggcatcaagctttgcatttattttgcaagccctctttatcgggtttgtatgatcttgttgtgtacagctaacaaaaggttacttctttgtcatgaaagccgtcctcagttttcagagacagtggggcaccacagagactttctttctctgcatccacatttctattaatgtcattactgcatttgattcctttatgaagcccttttggtcacatcaacagtgcattctaagctctctatcttaacttctagctttgtctgcaaaatttgtgtggttagcctgaggcatatgcagataaattgcccaggttcagtgttctcagactgggaactaaatgtgctgcagaatgctgaattgatgggtgtagcttttcagcaatattgatgtttctacagttgaatgtaaatctttggatgccttggtttgcattttcatagtcgtgtagttcctgaccactggttttcaaactgcctcgtctctctgaaagctgtgtttcagtggaaagacaaagaaaattgttcttcctcacccactactcttctgcccattcacaacagtaagaatctgagcatgtctctggccacacgcaaacagtggcagctcccgattcacaagctgcttacatttccaaagtgaggttgttgtgaggtcaattagtggtttagaactctgaatgggttggctaatggtagaaactaatataaagaataggtgagctggccggtcgcggtggtttacgcctgtaatcccagcactttgggaggccaaggcaggtggatcacgaggtcaagagatcgagaccatcctggacaacacggtgaaaccccgtctctactaagaatacaaaaattagctgggtgtgatggcctgcgcctgtagtcccagctacttgggagggtggggcaggagaatcacttgaacctgggaggtggaggttgcagtgagccgagattgtgccactgcactccagcctggcgacagaacgagactccatttcaaaaaaaaaaaaaaaaaattgatgagcctaccaaaactttggtaacccttaacgttccacaaacagttttatctgtatcttaaagcttaaccttcccccatgtttctctatggaaaaatcttctttgttctgctttgaaatcttatgaaacaaacatttcattcttaacttcagtggatggctacctatctctacctgtgtatcctggagcaatgtatcaatcagggttcttggatagaagcaacagagactagcttaatggtttaagcaaagaaataatttattgagaagatattgggtacattctgaatttacccaagttgggggaaagaacaggcactaaaaagagactgcacagccagattcatagccaaggtcatacaataagattagttctatgttgggtagaccctgtcactgaacactggacattagtgttcgtgctgaccatctcttcaggatcagacacttggtaccaactctgtcacttcagcctttgctgcctctgagcagtgggtgttgttgccattgccctcacccatggtaatttccctcctgctcctgcctctttatgtctctggttctagattcagggttgaccacggctaagtcatgtgcaagccttggctataagacactctgggaatgttagtgtctagccatttttgcttctatgttgagagatgtgcctctcatcagaactcacatgatgaggaattccccaaacataggggaacagagtttagatgccggccatttcccagtccttctcccgacataaggataaaagtcaccataagaagcttcagtaagcactctggtagaaggggaggtgttacagtggccaaggtgtttatccatatgaagctgtggttaatgaactctatttaactaagacggccagttgttccttgtgcactggtgtccagggtccccttcaccatgtgttaactaaaactagaggtgtgaagatttaggcatatttgacctctcacactgtggtccttaaataacaagatgcactaaattgaattttaacaattggattagctaggaggagcagattaagacttatctgtttccttgtttatagtagaaaatgaaatttcacattatcaatttgtcttatacagttgggtggtttatatgtttcattgatgaacttctacccttttaaaagttgattttttaattgcaattatacatgtatatagcttacaaattcttgcccacggatttgcattgccgttttccacttctcagaagcaactactccttagttcatttagctcttcttctggtatttacttccttgtagcaaattaatatgtttatattggtaattcttgaattttttttttccattttagtcattaaacatgaattccattgaggaagagaggggtttatctttcttttattcttcctcccttaaatacctgcgcttgtactctctaagatagttatatctcagtttgttttcactgtaaatatttttcacagctgagctatgcaggatactgttattttattttctttcttgtatagcacattaaaattttgttgcttggtattctatttatttactatttatttatccccaaattctcaaataaggtcaaacacaatggcacatctcttggttcttgcatgtgtgcatgtgacatttttcttgggctctctgcttgctcattctgttctggactgtttactcttgaggcctatgcacagctgttgacctggaatttgtccttagcaatcacgttgggaattcttgattgacctgtttattggatgccatctcttttggttttgaccctcttttggggaggcacattgcctggctgctttgtgagaaagcatgtgtagatggaatttttttgagatctggcatgtgtcaaaatatcatttggtcttcccttacatatgattgataatctaatttaaagttggagattactttccctgggagtttagagggtttgttccattttcttctgcttccaattttgttacagaattgttgcatgctcttctgactctatgtactttgtatgtgacttgtttcttttctttttggatgcttttagggtatttaaaaatcccccagtgttctgagcttttcttgtaatccaccttggtatgtcactttttcattcattgtgaagactgttctcttttttggagttcctatttgtcagatgctggaactcttggatttttttctccaatgtaattattgtttaaaaaaaaatccctggctgtgtgtgggcttacacctgtaatcccagcattctcagaggtcaaggtgggaggattgcctgagcccaggagttccagacaagtctgggcaacatagtgagtccttatctcttccaaaaaaaaaaaaaaaaaaattagctgggtgtggtggtatgcgcctgtagtcctagttactcgggaagttgaggtgggaggatcacttgagcccaaggattcgaagctgcagtgagctactattataccactgcactccagcctgggccacagagcaagactgtgtctcaaaaaaaaaaaaaatcctgatttttatccttttatctttttgttctactttaggggaacatttacctctattatctattaacctctctgttgatttttttatttctgtgattataatattaatttctaggagctttttcttgttctcacagtatctgtattttatagcatccattctttattgctttgtggatgcaatatgttttaccctcttggggttcttaattatgtatatttgaagtcttctccctgcattgaccctgttccctcctgaagttcctgtctgtcatgctggaccctatttcacatgcttggtgttcatcttgtcatctttattcatgaggaggcacaaagcaaggctttgtcaattggtggcctcgcataagatgaccacctcttttcagaagtcaccttgtcttccagttttggtatctgtagatctcttttcttgggcaggttagtttctccagaaaagtctccagtaccaatctcctactggccagtgctctgggaacccagcagaggaaggggctgtggagtgcatagttccacttagtccttctctttttcagtcagtccctccacctggtcactgttcctagtgtccccgagtgcagatcttctcaagcttaacctttgctgaggtgggaggaggggcatagcaagcttcatggtttagcaaagatatggagttttactccttaaaatgacttgcaagccatcccccagttttcagtgctgcctccatcctgtcttctcatccaaaccccacttaactgtgtcttaacttacactttcctcaagttctttgccgcatactggtttgttacttcctgacaattctgtctatagacgtttatgttttgtctgcccctgctttgaaaattcactcatcattgggccattttccaaaaatgttttccatgaattttgtcctcttccattctctcttctcatgaacttatctctgcctctcacttactgtcatttaggggtggttttgggagggaatggagataagcaccgggttgtaatctatcacatgtacctgataatccctggtgatcaacttgtgagattcagttcaatttagatacctggttatctggtccattaaggaagagttcatttgatcactctatacttttcagttttattcagagattattactctcactgtcaaaatgaactaagtgatactgttttgttggtttgagaatataatagaaaaaaggtcagttatctctaaagtatacattccaagtctgacctcagacccagttataagcgtaacataatatttccaccattacaaaaaataatgaccttcattgcctggagccataatcacagttgggtcagtttttcttagatttcctattaggttgacttgagttgggtccaagctggaagaaaacattcttttctaagagcccctttatccagtggtcccagttgtgttctatagggaactgagcttccttgaggcatctctgtagattccatgaataatgttggacccttgatgttcttctccattcccatgctcaaatcacccagagtatctcttacaaaatgcagaaagttttatgtgccagaagcttccatcattgaacatgtaaacaccacagcagaatcaaggccgagtattatctttcaacttttctccttaaatttcattagtacttcaattttaggaataacaactgatttattaaaattatgtttaatatattattaatgtgtatcaaagattactgtaaaattatttttgggtcttgttcaaccattgtaaagtcaaagggcaatcaattcaaattttaaaggttttgtatctccagagtttgaatgaatataggggaatctgatctgatttcttttgtttttttggagacagagtgtcactcttgttgcccaggctggagtgcattgtcacaaacatgactcattgcagcatcgccctcctgggctcaagcagtcctcctgcctcagccccccaggtagctgggactacagacacgtggccagataattttttgtggagtcgagttttgccatgtttctcaggcttgtgttggaattcctgggctcaggtggtccacttacctcggcctcccaaagtgctgggattacaggcatgagccaccatgctgggcctgatctaatttctaatctagagtttacaaaaatccttttaaaaaaaacaataatatggtgaaaccccatctctactaaaaatacaaaaaattagccgggactggtggcggatgcctgtagtcccagctactcgggaggctgaggcaggagaatggcgtgaacccgggaggcggagctggcagtgagccgagatggtgccactgcactccagcctgggcgacagagcaagactccatctcaaaaaaaaaaaaaaaaaaataataataataatatttgccttcatatggtagaattaatatttttctgtttcagacgcctcatgttctttgttgataaatcaatagattgagagtatgtagaagttctgagacgaaatctttctatttgcaggttcctgttgtcactatgataaagagtgctggggcatctgttttgtgctaaagctaactagaagtgtcgctgctctgagcaacaggcaggaagtacttctgtccttaaaaccaaaaatagatgctctttctcattatcatagctcaaatgatcatcttttttaatgagatgggcacatcccttgtggttttcacagatttaatgaccagattatttaatgcagagcttggggaagaacagctctggtaagaaagatgatggaaattttactggaagcaaaaataacaactttattccttcttttttctttctgctaatgttttcaacctcttattcctttgtttgtttgtttagagatggtcttgctctgtcacccaggctgaagtgcagtggcaccatcatagctcactgtagccttgaactcctgggctcaagcaatcctcctgcctcagcctcccaagtagttgagactacaggcacgtgtcatcacacccgacttgctagcatattgattgactgcttaattgatgagatgaggtcttgctacattgcccaggctggtcttgaactgctggcctcaagtgatcctactactttagcttcattgtatcattgtattcattacacactgtaatgctgagattacaggtgtgaaccacctcactgggcctcctgctgtttttttcttttgttgttgttgttaattatttttcatgattcttaaagggattcacttgtcttattttaatatattggtatgtttacacatttctcactatattttaacttccaagagaccattaccacggagaaaaaaaattatttgttaagagagttggaggtgtcaggatttaggtatactgtatgtggtctgacttgctttggacagctctgccaagtattgtgtattagtatgttggcagttggaaggtgaaaaattgcttctttgctgattttagaaagttctgtttgtatttctgaaagtaaggcaagaaacaaagagaatagaagaaatttaagggaaataaggtaatatatgtgaaggtgccttgtaaactgctaaatcacattacagcaagtgttgaacttaaagtgagaaaataagatccacaaagatgctataaagaaaaatgggagaaagagaaaagaacttagataggaagttgttaagaagaaacaaaatgggaaaatcataatggggaatttttacattctaggttttttttactctgaaaattcaggagtagttgttcttgctatatgagcagtgaagtaaaaaatattttttagccgagaagaatgttctgtggaaataattgggaaaaagaatcttatctggggtggtgaaagttggatagaaactactaggcacaagacctagtctaaaaaaaggtctaaataaagatctgtgtgttgtagggggttatgtacttaattaaggtgtaattcacatttgttaccacttaattaaggtgtaattcgtatttgtagatctcttctgagcctttccttttgttctcaatcatacctttgcaaggcagatatccttagcccattttacagatgaggcttggaaggctaattgatttgccaacagtcacttaatgtatgcaatggtaaagtcctccctttcttcaggttctgagtttgttcccacatttctagattgttcacatcagggcaattggttttgttgtgtttctggagattctgcttattgaatttctccaaaggaggtgcttgttaaataacagtggtcacttagaaataacacgctccgggcaggttttttaggcttggctaaatgacttcaaatgagttctgcttaaggaacactatttgaattccctaagaaccaagaaataaacaaaaaaggcatcacaacagcccaagtatgtgttcagaggccgtgccctgtgcccttcagatcttatctggagcttggtattttaagtttcgttctcttacacttcattattttatttgaattccaaaatcatagctgacttgaagaagggaaaggttggtactataacagaaatgagatgcaactctttaggacaaaggagaggagatagccagactgtgaaaggcagacacatatccccaaagcctagccgccatctgcctttgagtagaggaataaacagccctctgttgcctcagaagcttctgagaacagctgtcttgccactggcctttaatgggcaggttaaacccagttaccagcaggatacacacaaagccaacttcacaccctctccctctattcgccatcaatttatctccaactcagatcctgactctagtcggccacagctcttgacttcagacctggctctgtaacttggatttccccttgggctctccagagtgtatttatatctgtgctttccttgttgtgagaacttcagcagtctcttccttttgattctcattgcaccctgtgctttagtagtaactccccatccagctctctttgtggtggtagaaacccagctcctacccagtaactgctgccactccttttccttggagttagtattctcatgttccagcagagcaagtaatttatagtcatgttgatgatcctgtgtcaccaaacaaagattaatcatattctggattctctgaagaaggcattaccttttagaaaaaaaaattaatccactatggttgaaattaaacccattttgatacttaaatgggtaatccttcagctgttttgaaaatcgtgatcattctcaatgtcttattctttgagattttttttaaaaaattttaattgttttttttgagacagagtctcgctctgtcacccaggctggagtgcagtggcatgatctctgctcactgcaacctctgcctcccgggttcaagcgattctcctgccccagcctcccaagtggaagagattacaggtgcccgccaccacgcctggctaatttttgtatttttagtagagatggggtttcgccatgttggccaggctggtctcgagctcctgacctcaggtaatctgcctgccttggcctcccaaagtgctaggattataggtgtgagccagcgtgcccggcctattcctggagattttaaaaagcagaaattatattgtactataactgcagaatgatgcagagaattataattattgaattatagaatatattattttggaagagcataagcaaccttttagatagcttacatcacctttctattaaaaattgttgctttaagtaaagccatttaaaaattttttgtgtacaaacttatcttttaggtcaacagcaggaaatgcttaagcagagctattacatatcttaaaatagtgaaatgagcattgtagaactagtggctgttggcatgaaatgtttactttggagagaattcttggcatttttgccccacatcagcatagtaagaacttgtaggagaggagggaagcattaatgtatttgttgaggattaatgactttgtagagcatttgtgatagtgaatatattatggctagtaccgtaaatgcagtaattaaaaagctgcacactaaacactttgtagactggcaaatatattcccttcctttccttgatggcttgcattcaagtgaatagcgtatatttatcttgatcttagcgttcttaagagtagaaagaagtctcaaaggttgatttccttcccgagatattgctagtcagatggacacaatcagatttgatgttttcaggatcaagttattttttaacagttcagaaaaatgtcacgtggtacatactaataaaaaaaactattcctcacctttggaagctttattattaaagttatttttagacaaatattaccttgtgctgctgcgtaatataaaatgtgttcaggccaggcatggtggctcacgcctgtagtcccagcactttgggaggccgaggcgggtggatcgcttgaggtcaggagctcaagaccaacctggccaatgtggtaaaaccctgtctctactaaaaattagtcgggtgtggtggtgcatgcctgtaatcccagctacttgcgtgtctgagatacaagaatcacttgaacccaggaggcggagactggagtgagccgagatctcaccaccgcactccagtctgggcgacaggagtgaaactctgtctcaaaaaataaataagtaaaataaaataaaatgtgtccagtaagatcatgatacctcagggcttcttttattataaaagaagtaaaattgtgagtaatagaaatatatattaggactaaaacagacctgcaaccaaggtgaatttttaaaattttcaaggaagcgagacttggttatctcatgactatttatcttactgccccagcaggttaaactgaagtgggttgtgtgaatgagcatctgggaggagaggcaccatgctgtgagagtaatgatgtcctgtccttcacaggggaggatgacaaagaaggcagacagatgtaaagtctgcaatttctgttgctttgtgtcctcaaaatgttcatacccatctattttcccatttaagaggcatcttgtgtttcataatttctgagtcctcccacttaacatgcagtatttacttacaagttcatatttatgagttcataaagattttcttctgtgaaaagtataaatgcagctgaatgtgatttgcagctttgctttgagtcagttagggtaggaaaagaagaaatagactatttctgttctcaccatttaattggcctccttacctcctagttgtgaaagcttttcactaatgtattggtttattgatttatttcacatttattgactgcttactacatcctatgccccgaggatacagagatgagtgttccagttagtaggcatctgatgcctttgaaaccatctctgtcctgactgacttcagtgcagatagcattggttctaaaatcctttcaagttccagaaatggcctggatcttgttcctgttaacagaatagacaaaccgcagagcagtcttagagtttttgagatcacaaaggctgtctggggaacataaaagctgcttttccaggtgttttccatcgcatcgggtttctaatgaatcttgctcctttggcattactgggatactttccaagtataaagtcactccactccatttctgaattggctaaaaccctagatggaaaagcgttcaggagatcacagtgggatggcataactactgttttaagaggcagctaggaagtctcagtggcaggtgccactgccaacccattctcccttccttcttgcctttactctcaaatgtctgcctctttttcattttcagtagtttatccatggtaggaaggacctttgaattggagcaattcaagaagctttctaagatggtgggtagggccaggcatggtggctcacgcctgtaatcccagcactttgggaggccgaggcgggcagatcacaaggtcaagagatcgagaccatcctggccaacatggtgaaaccccatctctactaaaaatacaaaaaatagctgggcatggtggcatgtgcctgtaatcccagctactcaggagactgaggcagcagaattacttgaaccaggaagtcggaggttgcagtaagctgagatcacgccactgcactccagcctggcaacagagcgagactccatctcaaaaaaaaaaaaaaaaaaaaaaaaaagatggttggtaatagttttgcttaattaaactacacgtacacctttggaaatgttgacacccaaagcctgagatcattttaagaaaagacatcttccagatcttttgcttataatagtattttttgatactctgaagttctactcttaggggtaaaacttataaatgctcttttctatcttggtacaaactgccttgtttgtttgtttaccttaaaacagacttagactactttaatttggggggattgcttgccagaaaccaagaatttcaagatccatgtcctcagaccatttacctgtcatctcattctcaacaaagagacgttgccaactattttctagaaacattgatgcaatttggtctattgcctccaaatcccaatactattcattatgaacttactatagccagatttatctttcctgtagcccccacttacccagtttcatttctgtgattgcagtttcccatagtacagtacactaagatagttatgagaaatagagaccacattcacttgctctattttattattgggtatcattgttaatctcttactgtgcctaatttagaaattaaactttatcatcggtacatatgtataggaaaaaacatagtataggtagatagggcttggttctatccatgatttcaggcatccactggggatcctggaatgcatcccccatggacaaaggggagctactgtactttccttctaatatccgaggattgtggactcccctcttcttcgaggtcagtcccttcatctgtactcctgaccctttggcccacctcttttgagatctcaggccatctttacctcttcccccttagactttcagcctctccccctgaactgagtccttcagcctgtagccatgcgctgtgagcacttagtctcttccagcagccacgcattccctttcctgggctcttccacttgctctgtttattctgttatctctgcctccaccacttcactaaaacagctctccatcaaggtggacagtgacttcttaaatgtcaaatccaaaggtatacttttcattttttatctttattcatctctttctatcccgtggtacctctctaccattcttcctgggtcttcttcaaaagatggttttcctctgcacattctgttatgtgtgttctccaggattctgcactgatcctgtaatgttctccttctgtctatgttcctgcagtgacgtcactcactgacacaatctctgctcctttctatgttgtaatcacttttatgcctttatgtttttctcaagctgcttctccaggctttacgctcaagaatatctcagtatctccccctgaatcttccacgcttcaatttctctctcttttttttttttttgagacggagtttcactcttgctgcccaggctggagtatgcaatggcacgatctcagcttactacaacctccgcctcccaggttcaagcgattttcctgcctcagcctcctgagtagctgggattacaggcatgtactaccatgcccagctaattttgtatttttagtagagatggggtttctccctgttggtcaggctggtcccgaactcccgacctcaggtgatccgcctgccttggcctcccaaagtgctgggattacaggcgtgagccactgatgcctcagtttctagtgccccaaactaaattccttgtcttccttatttcttctcctatgttctctaccttggttgtcactaccatccacccatgtgtaataaacctagtgttctgctttgaacttccggatggttccaagtactaattcttctctcctcttctctacctacttctactgccctaatctccaccctttccttctccctgaatgattgtaacaaccgaacaggtctcctgcctctaccctgcccccttcaaatccacccagagaatcatgcatccaaaacccagatctgacccatcagtggctgtttacacccaggataaagtcagagttctttgagacatgtacatggttgccatctggctccaggcttcttttctggcctcactctgcaggcctcactctagagagtggccagcaactctggactataccatgcggtttcttacctttcccttttccatcgccttgtctcgcatccctagcgcggctaactcctacccagccttaggacatgctaggcatccccttttcttggaaggcctccctgacctgtccatttctggactagacgcccatgcttgatatgaatctcaatgattatgctcatcccatggccctagggtggccagtttgtgtgcatcctttgcctcccctagacttcactttccttagagatagagatggtatcttattcatctttgtagctacagtgcttagcatggtgctgggtgtatagtaggtgttctgcatatgttttttaaataaaaaatcaactgacagtaaatcgacttgatggccacaaaaatgggcaaaaataatttctgcgtaggagtcacccttagaagggagcatgaaggggacttctgcagtgctgataatgttctggtttttcatctggtgtattttcagtttcggaaaatacattgagctgtccattgtcgtgtgtgcattttctatatgttatatgtcactgaaaagtttttttttttttccaatcaacatgacatctaacctctccaatacagaaaaaaaaatttcctcatttcaagcttttaaagttttataggatattagttcagatgtcagagcaaacagccaggcagtgctattccttgatgttaaggaagaatagaaaagcatcagggaaacgcaggtgagattgcctggacttttgatgggggtcagagaaggccagccctggtcaagccttccagtgacctgcacctctgtcacacttattgcagggcctgcatgctaatcatcagcaagccctgggcctgcctgcggtgacagggagacttcatcttgcatgcgactatgaataattcataaacatggttatctggaaatatgtggtcatcattagcattttaatgaaaaaaaaaaaaaaaaagctgtcattatcctaagtctctgttttgtttctaccttttttttttctccccccaccacagctaaccatctcagtctttcctgaggacttgggaactgccgaggcctctgccaatgtgttgactgtcgctatgggctcactgttgtccaggcagctcatgtatgtatgggatcagtctctctcttgcttttttctctttaattttcattgtagaatatcacaagagtactgaattggtaaaagctttaaaggtttaaataaggatgtttagaaatacaagagaatggattgctctagggtaagttttaaatattgcatggtaagaaatgttatctaaattaggatttttgtaattaagtggccctataagaccagaagtgtatgtcaacaatctcctttttctgtttctgtgcatccattctttttttccaaatttttcttttcttttttgagacagggtcttgctctgttgcccaggctggggtccagtggcatgaacacagctcactgtagcttcgaacttctggttcaagtgatccttccaccttagcttacggtgcaattgggactacagatgtgccaccgtgcctggctaattttgtttattttttgtagagatggggtcttgctgtgttgcccaggctggtcttgacctcctaggctcaagagatcccacccacctcagcctctcaaagtttctggattacaggcatgagccaccatgcctggtctaatgtatctattcttctacaggcttttatttttttaagctttcctttttcatcacaatatgttaacatttgaaatgataataatgccataaattaaaaacgtttcacagtgattgtttgaattcctttataatcacaaaattcatggacccagaagagaggtcccctgggtatgtctctgtttaatatgtattagggagggagttcctggctcttacttcttagccttctccaaaggaggaaactctttcagttccctcagggatgaccttcgatgtctcacaacactaaagtttttccagcagtcttttgggaactgctatagttgtagccttttcctatttgtcgttacccctgattaacctgggagaaaaatgattcttccctttaatgatctatgtttatttctatgaagggcagtgtgtctcagacttacttcttgctccctgcagtcttttggccttggagcagctgtatagatatttatttgtttttgttgctttcctttggaacctgtggaattttggctccaagtcaggggaaatttggggtaattccccataagtgcttttgcccccatatcctttctgtaattatgcttattcatattcatctttaagtcctattaccttgtgcagctcagtttttttctttataggaaagttatggctgggctcatgcctgtaatcccagcagtggctcaagtctgtaatcccagcattttggggccaggcgtggtggctcacgcctgtaatcccagcactttgggaggatgaggcgggcggatcacaagatcaggagatggagaccatcctggctaacacagtgaaaccccgtctctactaaaaatacaaaaaattagccaggtgtgggggcgggtgcctgtagtcccagctactcgggaggctgaggcaggaggatggcgtgaacccgggaagcggagcttgcagtgaaccgagatcgcgccactgcactccagcctgggcgacacagcactccagcctgggcgacacagcgagattctgtctcaaaaaaaaaaaaaaaaaaaaaaaatcccagcattttgggaggctgaggtaggcagatcacttgagcccaggagtttaagaccagcttgggcaacatgatgaaaccctgtctctacaaaaaatacaaaaattagccaggtatggtggcatgtgcctgtagtcccagctactcgggaggctgaggtgggaggattgcttgagcccaggaggtacaggttgcagtgagctgagattgcaccactgcattccggcgtgggtgacagagcgagactctgtttcaaaaaaagaaaaaagaaagcaaagttagaaccaccctcaagccctcacccagacaattgtttgtaaagtaagtcagacagttaaaagcagtggcactttatagcagtagggagggatagctgataatagaatagggattcggaccaacaaccagcattaaagccagcagtgttggggtaaacagctcttcacatattttcagatattgttagcatctccaagggtgttacagatttactctgaaattatcaattttcatagtgagcatcatcagaaaaaagtttacacctgtaccctgtataacagggatctgcatactgtagccaataggtcagatccagcccatgcttatttttataggagctgagggtggtttttatatttttaaatggttacattttaaatggttatataagcacctacataatctcttttttgtctcttggccctcaaagcctaaaatatctgtgagcctgttaagaaaaaatttgcccacccctatgtagaagaaagttgaagggcatgtactgccattgatccaagtgaaattgttagtacttgagcatttttgacatacagaaggttaatttcatatggttcaagctaatatattttgagaacatcgttctttcacagtggttaaaatgctaacatttgggctcttggagtggaagaagtaaatttatctgaaaaattcacatatgtggacttgctccttttttcatcttagagaatgacacattggccatcagctgagtgcctttccagagattaccgaagggccctgagctgcagaggtgtgtgctgtccagtaattgcaaggaagctctttattttcatttgacttgtttcttactaaaagctctttaggagaaaactatcttctcctcactgggtgccagaaacgtgctacctgtgctcagcgtagagattgctgccccgaggcctctgctgagcttgtcactttgtgccttttttctggtggagggagagtgagtgactgcttttccgggggcacacatctgcataacacattgcctgaaatgcccttccctggaactagagtgtggttcgtaccctctcatggtttccatctctgatttcttttcccggtgttgatccctcagtccaaggcatgaacactgttacttattttatttgatttgttctccattcctcccttctgcgtactcctttgtagcttgcttctcctgatcattaaataagatttggctgggtgctgtaaccccagcacttcgggaggccaaggtgggcggatcaccggaggtcaggaattcgagaccagcctggccaacatggtaaagccccatttctactaaaaaaaaaaatacaaaaattagctgggtgtgtttgagggcgcctgtaatgccagctacgagagaggctgaggcaggagaattgcttgaacctgggaggcggaggttgcagtgagccaggattgtggcattgcactccagcctgggcgacaagagcaaaactcaaaataataaataaataaataaataaataaataaataagatttgcttgttgaaacctcaagctgacgttctgcagaggctactcatagcagaaagaaatgttaaccttagcagcccttgctgccctcacataaggcaggaaagccaatttgacctggggcctgctcaccaggcctgtgtctgaacagggccacaactgttccctggagaagggaaacgatttcagtaaaaaacaacagcaacatgccatagttaataattttatcatcaggtgtggtcggaatcatcagtcaagggtcagcagtgcatactgctgtgctctacattgtttttgaggcttgtatgtcagactggagttttaattttctttctttctgttttgagattattctgcctttccaggctatctcctttcaggacagggtgctgctcttggatggaatgcagaatggcatccattgagcacgaaaataagaagtaaatagctagagctgttcttgccaggcttttcatacagatatttgtgtttatgttaaaactccagttttaaaatgagtcatgtgccacataacaatgtttcaatctatgatggactgcatgtacaacagtagtcccataagattataagaccctatttctcctgtaccttttctatgtttagatatgtttaggtgcccaaatacttatcattgtatcacatttgcctgcggtattcagtacagtaacacgctgtacaggtttgtagcctgggaacactaggctctgccatctagcctaggtgtgtagtaggctgtgccatctagcctcggtgtgtagtaggctgtaccatctaggtttgtgtaagaacactccatggtgatgtttgcacagcaatgaaatcgcccaacgatgcatttctcagaatgtatttctgttgttcagcaacacatgactatattccaggaattgctaataaaaattgcatatttgttcatttttgtctgtacctatccattcctttggatgactgcagccaccactgcaactgcagctgtgaggatctggactgttacaatagcttccagaccttggcctgcagtctctttgcctgcaaacttaactcatgcatagtagccaaatgaatctaactgaggcatggctctgaccatgccgcttccctgctgaaaatgtttagtgtgtccccactagtttaaaaggtcaccctggtatttgagtcctttaggtttcctttcactgctccttatttttattacccattactcatgatgaatgatcgttattgttgttagtattattgctattcagtagacatttatagtagtctgtgtgggctgctcctgccagggtacaccctgtgcctttgggtcacgtgcctttgctcctgctgtttcccctctggtatgtggatccatcttttggtaacccgctaaaatcctgcttttgccatggggtgcagcagagtcgttctctttcccagggagttttcctggtttccctgctggaagcacgtgttcctgcagctcttaaatctccctcttgatgcttgcttgtgtcctaaattccttttatattttggcacatgtatataatttgtctgaactccagtactatttccctcctctcctctgtgagtgaggacactattatatctacggtagttgctccagtatttgtggagtcatcttgggctaaggggtggaactggataataaccatcctcagagcctgtgccagccacgactgagggggagggagtaattggagcctgacgctgaataaatgcttaataatatatatcgaatggatgaatgaatgaagtacttgcttagaaacttagctcagcattgataaggggagaaattctttgcatattacaagtttttgcaaatcctgttttccaacacacatggttctctttagctttagttgtattcatggtaactttttcctgaacaaccgctatttacttttctatttctagctcttgggcacaggttttgccagttgtgtcgactgtctcttttggtaaattgtttcttgtttggtgttaagctttcactgtaagtctcttcagtagaggttgttttatgtgggagtcctgtacaactaggattgtgcaaatcccccactttctcattttcctcagttagtgccccatgggtgtcctggcttctggaccagtgttattgttattattattattttatttttttttgagacggagttttgctgtttgttacataggctggagtggagtggcacgatcttgactcactgcaacctctgcctcccggtgcggagaccagcttggtcggggagactctaacccagcggcactagaggaattaaagacacacacacagaaatatagaggtgtgaagtgggaaatcaggggtctcacagccttcagagctgagagccccgaacagagatttacccacatacttattaacagcaaaccagtcattagcattgtttctataaataataaattaactaaaagtatcacttaagggaaatgaagggatgggccaaattaaagaaataggttgggctagttaactgcagcaggaacatgcccttaaggcataaattgctcatgctattgtttgtggcttaagaacgcctttaagcggttttccgccctgggcgggccaggtgttccttgccctcattcgcgtaaacccacaaccttccagcttgggcgttagggccattgtgaacatgtcacagtgctgccgatattttgtttatggccagtcttggggccagtttatggccagattttggggggcttgcccccaacatcctgggttcaagcaattctcctgtctcagccacctgagtagttgggattacaggcgcctgccaccatgcctggctaatttttgtatttttagtagagatgggttttcaccatgttggccaggctggtctcaaactcctgacctcaggtgatccgcctgcctcggcctcccaaagtgctgggattataggcgtgagccacctcgcccagcctaatgttattgttttcttggcttggggacctgatgcttcatgggtgttctgtatttggatgccatacctctaggtgggagccgtttaaattttgatttcttgttggtgagatatgaccctttgttctccagggttcatcaggatctcagcccctacacactaagcctgtctcatgttctgatagccttttacatcttcagagctttaactttctctcatctgactttaagttctatctttggttctggcccagggatttatttcttgtgattttgatttttttcttagtattttcttagttgttaatgatctctccctcagtttttccacgtgtttgaaacaggcagagcccttccctgtcacctcagctcaccatgttgattggaaactttattaccaccatcctattaaagaattttaagatatttttgtcaccaaattgcaatccctgatttctgcagaactttagatgttaagtattaattcagtgaatgggtgctctgcacatccctctactgagatgccatgaacctgagtaaccacatttttgtagtgtagcatagtcttatccgtggctacctccttacttgtagataactttctgtgcatgtctcagagtccgtcagttagattctagatttttacatggcatgtgaacccaacctgtaaaattggtgatctgaggcctgttgaccgccattattttcagatactcataaatacagaccttgttttcacatacctagtacataatcttacatcttgatgttgagactagtaaagaaaggttacttctatgtatttatctttcactgaagaaagaaatgaaatttcaatagtccaaattaagtcccttctttgtaacttgctcttgctttttttttttttaaacctctcttgtaattcgctacttccagggtagagatttgcagtcttattttgttgtaataaaagagtgtcctttttgtttggatgctctggatctatcactttcccttttccagcaaatagagtgggactaagaagccctgtgacaagtcttcaccaggaggaatcggatgccctggaaagaagcctacctggtgtctgcttttgttgcagaatgagactctggaaacatgccagaatagtctttggagggactttagtcctttttcccttccctatactccacatgaagaggattaggatgctgggggtaggtcagaaagggtcccatgtgtgtgagaggacaggctttgcccctgaaaaagatgagaagaatgtgttgtcctcagggcaggaggcacagcacctctgctaaaggaagagcggggaggaaatgccccagccagacttgggaagcttaagacctatcttctgcgagcagcctccagaagggaaaggagaaacacatgcaactttttatggggcctcattttgaaaccaaagcaaaaggacttatttttccaggttcttggacacttgctcatttatgcaaacctgaaattgtcctcaggagaagtgaactctgctgaccttcctttgcacaaaaggccacaaaaatccgtgcaagatgaaaccaatagaattctaaacgaatgacttggcatatttatttcagagtcataagataggtcagtttgttgtttgcctctgtagcttctagacctttctgttatgaatatatactaagaaaaagaaaacagcaacatatactattgaacattgtatttatttttgtttttgagacggagtcttactcttgttgcccaggctggagtgcaatagcgctatctcggctcactgtaacctctgcctcccgaattcaagtgattctcctgcctcagcctcctgagtagctgggattacaggtgcccaccaccacacccagctaatttttgtatttttagtagagagggggtttcaccattttggccaggctggtcttgaactcctgacctgaggtgatctgcccgcctcagcctcccaaagtgctgggattacaggcttgagacaccgtgccctgcctgaatattttatagatgatgctttgttaaaggaatatctagactttttagtctgtcttttttgattttatggaaaatacttaagtccatgggattccatttgttttctcccctgaattcctccctaggagtgtccaatttttgggaaagttgatccccctctcccagagtacaagaaaattccacaaagagcttatgttacatattagttatttggaactcaataccaataaatccaacatgacttggctaactctggaaatcaggcatacctgctgccatcctatccttgtgtcttgggcttagttaggggtaaagaggattcctgttgtttttgaacaagagatagtagctttttgttttgaaatcactgatcctcacaccgcaggatccagtttaagcaagtaagcggggtgcagtttataaagacgcttcccttttttgagggaaaaggtacagttaagaggagatagggtgaccagtgccaattaataggtagagactgtgtttgctatactccgaatactgtgttgacttctctggggtattgagaagagttacatattgccctcaattcttatatctcatctgtggatgtgaccaaaggtggtaactgtgtcatttagaatcagtttatgtgatgaagcagtttagaggaggggaaggctggtaaagatgtgtgcagtcagtaaagcccaggagaacacaatttccagatcatcttcctccaacaggacacaatggtctggggaggaatgcaattcagatcaagttgttggcagatcaggcatgggaatgcaggtctcctgggtgggatttgaaggacacattaaatggtacattacggagggatctgatgaactgggatcaaatgagaagggcctaggggagtgcatatgccaataagaacaaagagtatattcttaataagaagttacatttattttacttattttattttttatatttatttatttatttatttttttgagatggagtttagctcttgttgcccaggctggagtgcagtgccgcgatctcggctcactgcaacttccgcttcccaggttcaagtgcttctcctgcctcagcctcccacaggcacctgccaccatgcctggctaattttttgtatttttagtagagacagggtttcaccacattggccaggctggtcttgaactcctgacctcaggtgatccacccaccttggcctcccaaagtgctgggattgcaggggtgagccactgcgcccagccagaagttacatttattaccattaagttattagccacttacatagacactgttctgagcacttaatgtgtatacttttattcttcactacaactctgttacatagatgcaactattatcactcaatgacaggaaactgaggcacacaggagctatagaagcaacttacttaagcctacacagacaatggtggagctgagatttgaacccaggcctttcagctccagagtctgtgcttttaaccacgctgtgtgcctgcttcagtagatgagagaggagtcagaggggtgtgacaaccaagaaaagttgttggggagagaggaagttccaaggtcaggattgcagtggagcgggtcctagagatgtagtgttcatttggtggccacacgaaagagtgggtggtatagagggcagtgacaagtcaaccttatcaggcaagtcctggaaccaggatggcgaaaataacagtccagagcccttactccgcgctgggcactgggaatagagcagtgaaaaggtagatgaggtctccgctcccatagcacttctatttgttctagtgatggagacaggtgataggaaagccttccagtagaggagataattgtggatcatggtacctgctatggaggaatgaagagtgtgatggagggatactggtcacggcccacatgatgttgggtgaccagggaaggtgtccctgaagaagcagtgcttgagctgcaatctgaagcatggggaaagcccagtctatgaagagctgggaaaagcccattacagaccaaggggtatggactgtttaaggaatggcaaggagccagggtggccagagcatagcaagtgtggtgggacctggtgggagatgaggttggagaaggcggcctggtcaaatcagagtggagggccttggtaaggagtttcagctgtttcctaagagtagtggggagccactgaaggttcagtaggtgcagggcatctagggtgctaaatggatgtgcctgtttgatcgggaggggcagggaggtggcgagagcagcatgcagacagcacatttaggaggcttctcccccgtatggtagcttaaaggtttccatggcttttctgcctggggaatagcgagctgcacctcaaagcttctcagtggtcaagttgtgatcagagttcacagcaacaagacttcacacccaccttttagccattgactgcccatttatactttatatagagagaagaaccaaggtatatgaacttaaaagattaagcaatttttatttgtttgttgttataggtatgggaatttttaaaacagttactttataggtagtggatgcttttgatattggcagcagaaaacccttcattggatgattttctccttcccaagatggagactcaaaatggagacacaattaattgcccactcactgcccatatcctgttccattgttgctcatagggctatagtttaattcagggtggtgtggagatcagcctcgacagtaaattgtgatgattaagccaatataccagtcctgaaccctgattttccagcattccttgtagcaagtgtggccctgtgacctacttctggccagtgagacctgagaataagtccactgggatgggagtgaggttgctgggaaagcatttattgtctctataaagcctgacaactgagcttgtcagtaccctcccttgctttcccattctttctgccttgaatgctgataagatgcctggatgtacagcagccttcatgtcaccatgaggtgacaagcatgaaggaaagtccaagagcctcagagatacctgccctgaggttgttttcaagccaacacctgcagccctgggccttccaactcctttctttttgttgaatccactgttaggtaggttttctgttacttaaagctgaatggactgttaaattaagcagatatgaagacgcagatgttatgagccttttcctcattattgtgacagccttatacatgtccttgatattcagtatgacctttatcttgtgtgaaaacagtctttgaaaagaaagctctaacttatattaaaagttgttcacagttcaaagtgatgagttgtggagttgtggacttggaaatgtaattttcaaaataaatgaactcctctgtgtgaacttgctgtagcaagtaccgtggagatatacttcatgggcagtatcttccttatggccttttttatgatactcttagttttctggtgaactatattgtgtgtatttatggctttataggaaactatagcagtactggggtaatagcataaatagtctgatttcttgaaaatgttaagctccaacaggctttattggatttcagggtaatggtattattaaattttttgccacttttcaaacttcttgtggctgagttccaagctgctgcttttaagaaatttgggggctggttctgttcatttatagaaaaaagttatcctggaattttctattgctaaattgaggggtagggagaaataatttaactttttttttttttaactgccttggatttgggtataacactcaggattactttccacatggaaggtagaaatggctttgcaatatgtatcatggagataatataaggtatgaaatgaaaattgtcgtctctagtttattgggaaaaaaactagaagtcatagggtcatcaaattgtaaagagaaaagaattttgcacatcatatagtaaaatttcacttttttccctagccttggaaacttgagacctggaatgctttcagttattcatttaaaaaataaaaatatgtgcagttaccctatgtatcctcttctttaatgaaaaatttttccagctgggcacggtggcctacgcctgtaatcccagcactttggaaggccaaggcgggtggatcagttgaggtcaggagtttgagaccagcctggccaacatggtgaaaccccgtcactaccaaaaatataaaaaattggcccagtgcagtggctggtgcctgtaatcccagctactcaggaggctgaggcagaagaatcgcttgaacccaggaggcagaggttgcaagccgagatcacgccactgcactccagctgggtgacagagtgagactgtctcaaaaaaaaaaaaaagaagaaagaaagaaagaaaaattgtcccaaaggaacgagaaacactgtataaccccaagaaccttgacaagaaggctttttaagtcacttgtttcaactacctcattttaccgagaggaagggttactgctttaaggtagaccagccaattagcccttgggcaggtaggaacaggaccacagaaactgttaggtgtgttaacatcctcagtgctgttgctggaattcacgatggcagtatcttatgtgggatcagtgcttgatcttgtctacgagagctgtgagggtttgacagacactgatatgacacggcatcccaggcagaacaaatggaagaggcttgtgagtgggagatgttcagtaacttcagtatagagtgaggcactggtgtggtgccctgcttgggatcaggtaggagaagaacggcttatgtccatgcagattagggacaagttggggttagtttgacccatttgggacagaatatagagggtcataagagcctatcagtgaagtgagattttgttttggtatgtatgtatgtatgtatgtatgtatgtatgtatttttgtacagacaaggtcttgctatgttgcccaggctgatctccaactcctgtcctccagtgatcctccttcctcagcctctaaacgtgctgggattacaggcatgacctaccatgcctggcccaagtgagattttatttggtaaccagtgaaaagctttaagaatattcatgttggtgacagttaacacttacacagcaattactgtgtgccatcaccattctgagtgctttacacacactctcctatttaattcccacaacagacatttggtatagatattctcattatctccattttacagtggaggaaacggaggttagctgacttacctaaagagacactcaaaggaagcagtggagatggaattcaaaccggggtggcccagctccagggtcctggctgttgatagcttggagcgtgtatatgtggtggtgataaaggtggtagatgctcttaggaaggcagctctgcgggagagtacagttggattggcatgagggcagacaggtaatgagaatatcgactgtaggccttcgggacggttaataagagcctggcctagaggcgaccgtggaaatgaaaggatgagaattcacatgttactagcttcagaggatggattagtgccaggtttctgactggtcatggggcaaggaagggatggagtcagaaatgtctgggatattgcttgaatgtccacctaacccagttagggaagttgagagaagatttggtgggagagtgatgatttatttttacagagccctgttttcctactttgtgaccaactagtgcagtggttcttaacctgggactctggggaaaactgtctagaaaagagatccatgtaagtgtgtcctaacagatttctgtgagtttttggagtctgccaagctcacatgttgttttagcatggccttgggcccacagaaggtctccagtgttttgaggcagtttgtggctgaggcacttagaattctatggtggcttgtccccttcccagcttaagaatctgtgggtgtgagctcaggaggaggggatgggtgtgtgtctgcattttagagacccgcctttgttttagcttccctggccctgattcctgacttccgctttccttcctgcccttaagttctgttgaggaaagcaggagactgtagctggagatagaggaggtccttggtgtttctttgtgaacttgcatcctgtgtcgagggaaacaccctgttcctggtggtggcctccgggctcaactcttcctgctgccgcctttctgagaaatgtgaccctggccaggtatgtcttcttggaggcttctaaatgcaggtcccagctgaagggctgagaaggaacagcaggttgttccaggataagtagctgatacctttgtggaaaaaaatcctgacgtggatgagagaacgtagagcttgacaatttggacttctgtttcatgaccatttctccctttctctttccttcctcttctccttccattccttctccctccctcttccttatttcttattagaagagttgctaattgtgcatggttagtaactgtgactgtacctatttttatcttcgactatggttttcaggcttgattttccagggaaaggtaacattggcaacttgcaggtgacgtgtggaatttgtaggaatggctacataggaaagatgaagggaactagaagtcttggctacccctgtcctccaaccccttaaaaccctctggaaaaacaatatgcatgtgtgaatttgaatcctacttcagtcaccagcagaatgtccatgcgtgtgccagttccctaatctctcatctgtaaaatggggatggtgatatttacttctttcccaaagggtgttgtgacacacaaatgaggcagcatatgtgaaggaattctaagcatctctcttatctccttgttcctgtctaattaaaagtttctgtattgtaccttggaatgatcccagaaatactaggagggagggagaatctaagtgctatattaaattgctttttgtatgtttattccatttctacatagtaaccatgtgaggtaaatatttttatttttatttttatttttttttattgatcattcttgggtgtttctcgcagagggggatttggcagggtcataggacaatagtggagggaaggtcagcagataaacaagtgaacacaggtctctggttttcctaggcagaggaccctgtggccttccgcagtgtttgtgtccctgggtacttgagattagggagtggtgatgactcttaacgagcatgctgccttcaagcatctgtttaacaaagcacatcttgcaccacccttaatccatttaaccctgagtggacatagcacatgtttcagagagcaccgggttgggggtaaggcatcccaaggcagaagaatttttcttagtacagaacaaaatggagtctcccatgtctacttctctctacacagacacagcaacaatctgatttctgtatcttttccccacatttcccccttttctattagacaaaaccgccatcgtcatcatggcccgttctcaatgagctgttgggtacacctcccagacggggtggtggccgggcagaggggctcctcacttaccagaaggggcggttgggcagaggcgccccccacctccctcccggacggggcggctggccgggcgggggctggcccccacctccctcccggacggggcggctggccgggcgggggctgccccccacctccctcgcggaggggttggctggccgggcggggctgtcccccatctccttcccggaggggagggctggctgggcgggggctgaccccccacctcccggacggggcggctgccggtcggagacgctcctcacttctccgacggggcggctgccgggcagaggggctcctcacttctccgacggggcggccgggcagagacgctcctcacctcccagacggggtcgcggctgggcagaggcgctcctcacatcccagacggggcggcggggcagaggcgctccccacatctcagacgatgggcggccgggcagaggggctcctcacatctcagacgatgggcggccaggcagagacgctcctcacttcccagacggggtggcggccgggcagaggctgcaatctcggcactttgggaggccaaggcaggctgctgggaggtggatgttgtagctagccgagatcacgccactgcactccagcctgggtaacattgagcactgagtgaacgagactccgtctgcaatcccggcaccgaggctggtagatcactcacggttaggagctggagaccagcccggccaacacagcgaaaccctgtctccaccaaaaaaatacgaaaactagtccggcgtggcagcgcgcgcctgcaatcgcaggcactctgcaggctgaggcaggagaatcaggcagggaggttgcagtgagccgagttggcagcagtacagtccagcttccgctcggcatcagagggagaccgtggaaggagagggagagggagaccgtaggggagacgggagggagagggagggggagggggagggatagggagagggagaatatttttattttttgagaggagagaactgaggttcagagaggtttaaaacaaaatagcttcaccacctgctacatatgtggcagttatttactatcttgctgcctgttatgacatctataaaatgaggataataatagttttctctccatggagtggttataaggattgaagtggttaatatatatgaagtcttaacacataatgcctggtaaatagtgtgattgatatattagcagttacggggtgagtgtctcttatacaagatgtttgcgaccagaagtattttggatttcatatttttgtttttggattttgcagtgtttgcattatacttagcagttgaacatcccaaacccaaaactccaaaatctgaaatgctccaaaatttaaacttttggagcactgacatgattctcaaaggaaatgctcattggagccttttggatttcagatttttggatttgggatgctcaactggtgttatcattaagaaaactgccaaatgtcttctaggccactgtttggtgaaatctggattggctcatatgtataatatgttgaaatgggatttcactataattttctaaactaagagtggatttggtttttgtgcagaaggattgaggaagtgatgttagacatatcacaaaaacttaaaagagatttagagaatgtggggaaaagaggagagatccagggataattaggaggcaggtccaaaggtaagctctgtgttgctgctgagatgtggttgaagagaaaccatgagttggttccttggttatgatacttaaccttctcttggaaccatcagatcagagatagataaactcagcaaatgaggtctttggagtcgccatgttaccagcttcatcccactttctacttcctggaagagacagtggagtagaatgttaaactaaggattctgggatcgttagaccaggattggagcctgggctctgctgcttttcaacgtcccaatgttatgcaagtttgttaaccttgctacagcttggtgtccttctgtgtgaaacaaggagcatcatggtgccagcattctaggatttatgtgagaaatgaaagggatcatgaacactctttgtatttagcccaaaggaagccctcaacaaatgttagatacttaatattacctggagccctatccctgtgggctttggttaggccccataggcaagccacaagtggcaatatttgggggcagtaccctttctgtataaatcctgactataacaataaaagacttgtacctcctgtccctgtttcagttaacaatctctggcatagaatctttgagtttcctttgagatacttttatctgcctctcttttctctcaaaaagcaccttagaccttataggagaacagaaatggagtatcgagtaccttacagttggagtagaacagaaattttttcatcttctactgagttcaaaatacctcattccccttactccagtttttaatttgctgcacagtaggacctttatatctagcaatggagctacttaaacaaaattacattataaaccaacaattttgcaattctgttctgtgctatacagagattttcctctttatctcaactgttctcactaccaaggcaggctaggggaatgaatgatgagtttttctaagaaaaattaacaggtgacaaaattgaaccaggttcatcagaatcacagatcaagaacacaaatcccatgtgtcctgactccccactccagtgctctttcagaaaggccgtgttacccctcagccttccttcccacccctgtgaatagagcctgccagggtgttgcatgctgcctgggaggcagctgcccttgggacggcttcccttgctgatgtagaccttaccaaatgacctgtgtcagcctcatggggaaccgtgagatcctttaaaaaaaatcatgcattcttcttcagaggaaaaaaatcttccttggcccatttagcaagatccttgctccttagtttcctttaattatcttgatttttttttttaaactggagaagaccatctgctttatgaggcagttcatctcttatgttttctctaataggtctttgaaggcccagttaagcatattaaggcttcatctcattcttgtttgggatcattttgtttggtgattttaagtcactgccactggcatctcttggttgtatatttgagataccttgcagtgtagattttacgaagagatgttatctttgttccatgaattgcaggctctgtgagccattttccatatagtgccaaactatcacaacaggattctttgctttttaaattccttcctctcactacaagaagtcctattaacatgttttctgagctatagagtaaaatctgtcaaatatagcatggaaagcagatgggtggttgctgtcatccttttcacaaactctaaacctagtctttcttagtaaaactcagctttgtcaccttcttttaccccagagttttcatttacgaatagaagacgtatgtgagggagagggcacttctttattgtttttttaaagatatatggtatctatatacccagcttcatatacaaacctttttttaaaaattaaaaatctttgtctctgaatataaaaatgtttcatgctcattattaaaaaaaacttagaaaaatagcaacttataaaacatcagaaggccattttctaaatcctgtcacccggagattaccactatgaacattttgatgaactcttctattcattcctttagcagtgatttcttgaacatctgctatgtgccaggcactaggaatatgctaatgaatgaaacggacatagtctctgtcctcatacagggagcgagagaaagacattaaataaattatagaaattatataaataagacattttataaaagtacagaacattaacaaagttagatcccatacaaactttttaagaaagaaatagagtaaaatccctactgacaatgaaaacataccagaagacacgctcaattagaaatgattaagactgccaggcacggtggctcacacctgtaatcccagcactttgggaggctgaggcgggtggatcacgaggtcaggagattgaggctatcctggctaacgcggtgaaaccccgtctctactaaaaatacaaaaattagctgggcttggtggtgggtgcctgtagtcccagctacttggtaggctgagtcaggagaatggcgtgaacatgggaggcggagcttgcagtgagccgagatcacgccactgcactccagcctgggcaacagagcgagactccatctcaaaaaaacaaaacaaaacaaaaaaatgattaaaatcataatattctatttcaaaataattaaaagagattattacaaaattatacaggagatgaaagagcagcgtaagtctgaattagcaaaactcagagacaaggagacagaactcaagaaagaattagaaattaaaaaaaatcatcttagaaataaattcaaaattggaaggagcacaaaatcaactaaatactacaaatactgacctaagagaaatagaaggtgaaaaggaggaaaaagttaaaaatccaaaggaaatgaagaaagaagtaaaatttgggaaaagttgacaaataatgaagatagacaaagcagatccaacatacaggtaataggagaggagaaaaataaagcaaagaggtggtgcaaatgatacattttaagacaagttttctggaaaaaaattgaaactactttttgaaagaaaaaatcatgtattttagaatatcaccttagaacaacccataccaagatattctaataaaactattgggttaaaaagaagaaagaaaaagaaaaagtcctttgggcatctagacaaaaaagggaaaaacagtaatagagaattagattgttcttagactttttgacggaaactcttacgctgaaagaaaagtcatacctaaggtattcaaaggaaacaaaatgtgagccagtatttttatatctagcaaaattgaccttcagacataaagaacacaaacttatgaacatgcaaaaaaatcagtggaggaaatattgctcctcatgagctcctcctaaggaaccttctacagagtgagcttcaaacaacaaaaataactggaaagatgtaagatgagcttgggacatctcaagataataaataggtaacaaggaagctatcaaagattattagggcatgtcagaatgacttaggagccaacttgaagaggctcctactggccaaaaataaaattgcaaatatgtttaaatccatgagattatgatattaaaaaaaatattggttctgcagtatgaagaaaaggttaatggagcaccatttcatcatcttgaaagtagttaggaaagaatcagcttctttcttacatgaactgtaccactggaaaaccaagtggtagatgaaggaaagcatctcctaaaatttttccacccagtagatgaaaatgaaattaaataattggaatgtcactgttttccaacccctgtggatttagtggatttaggcattgaataacaatggctgctaacattagaaatgaatgaaaaccagataccatgtgcttcctgatgaaagatcataccaccacagactgaatttcaatctgttcaagcctctgaatctagctccaatttgcaggcaattcagaggttggagaaacgagttaaacatgcaccaccaaaattcatactgtggaaactccataactcagacagcccagactctttcaacaaataagttgtaaggaaaagaaaaggatagaggcgatgtagattaaataacttaaaagacatcaaaattttaaaaatagacagcactaatggtgactaggattatacactcgggtaacagaatcataaagaaatgccaggaactgattaccataaattcaagagtttgtttactttggaggaagggaagggcatggagggccttctagggtaacaagcaaaagctgtgttttgattaagatggtagttatgggtgttttctttgtagtaagctatttgttttgtgtggttttcttcatctgtgttttattttaccataaaaagattttaaaatatttttatgaaagaatgacactatacatactgcctttctcccaacttttattatgagaagtttcaaacagaaaaattgaaagcattgtgtaggcaatacctatatactcatcatactgttttacagttagtttttttcatttagtgttatttagtaaatatctttctgtgcaattaaatatagaagcagcctcacttttaagtgatgcatagtattccattgtaggatgtgatcctttatttaatcagtttcctaatgatggacatttaacttgtttttgatttttttctaatagaaataatactgcttatttgtccttatgataaatacctaaaatttgctttgtcacagcatattctaatatgcaaagtataaatgctgatgtgctgtgaatgaacagttagcagtagagactaaagatgcagcctgtattaatcaagacagccctgtgtaacctagggagaacataaacctcaaagaaaaaaataaaaaatagattccccccgcaggatcctcacatagcattatacctttcttggatcagtttaggtttcatcccacagctcttctacaatctcatttggttgttgtggctataactagtgtatcaattgtgtattgccacaattaatgctgcataatgaagcaccccaaaattcagtggcttaaacaatagccattagtatttttgggatggctgagtggttcttctcatagtctctgctgagctcactcatgtggctacagtcagctgcaggggtagtagacagatctgctgatctttgcagtgttctttcatgtgtttgatggttggctggcttagggtggtcaaaaatggcctgaccaagaagattcagccatcctacccaagtctcccaacacccttccaacaggcctaggcatattcttatggcagtagcacagatcctgtctttttcaggggagcagaaatgggtccatacattctgagcttctgtgtcatcccatttgctaacatccagttggccaaaacaacacagttgagaccagagccaggggaaagggattgcaaggttacggagtagagggcaaggatgcagagacgctgttgattggggtcattaacttagtcctctatagttgtccaatagcatattttaaattggcacatcttagaagcattaaacattgcagttatttctaaattgcagatgttaatgcctttggaatatgaaagttggggatcaggccgggcacggtggctcacgcctgtaatcctagcactttgggaggctgaggcaggcagatcatgagatcaggagatgaagaccatcctggccaacatagtgaaaccccatctctactaaaaatacaaaatttagccaggtgtggtggtgcgcacctgtagtcccagctactcaggaggctgaggcaggagaatcggttgaatgcaggaggcggaggctgcagttagctgagatcacgccactgcactccagcctgggtgacagagtgagactgcctcaaaaaaataaaaaaaaagaaagttggagatcaggtatatttgtgggggaagcataaagcttttgcttcattgaaaaaatttctgattaagtgttataaagataactcttaaatggaaaaatctacatttaatgttatatcttgaaaatatttcttttccagttgttggtgttttcccctgggatacatttcagaaaataggctttttttctgtctgtgcatatttttctttgtttgatagtgttcttggaactggttttgaaatctcacttggagaacacagaatggagtaagataaagagctaggatcataaatcaatgtccttaagtatttttgcgaaagataaagaaattggtgataggattagttcttggacctttattgccacaacttttttctctctgttttagactatataagtggtaaattaaggatctctcaatgctgtgatttttaacagcaggtatgcagtgaccagctatgtgaatggcaaaaaaattattaccagtaacggttaatgttccaaaaatgtaagaaattcaagtttattcccatagagtacaatgttatatgccaattcagtgtgtacacttctgtgcagaaataaaaatattggaatgaaattttgcattccatatacttattaaatactcttcattatgcatgcattacaagactatacacattttacttgtttaactgaaactgtgtgtattgtactaagcaggcaatttaaaggatttttttttaaatagttgactgttattgaattttgctttattttctgactttaaaacccacccccagagtgagttaaaatttcacacatgtagccgggcatggtggatcacacctgtaatcccagcactttgggaggccaaggtgggggaatcacaagatcaggagatcgagaccatcctggctaacacggtgaaaccctgtctctactaaaaatacaaaaaatcagccgggtgtggtggtgggcgcttgtagtcccagctgctcgagaggctgaggcaggagaatggcgtgaactcgggaggcggagcttgcagtgagccgagattgcgacactgcactccagcctgggcgacagagcgagactccatctcaaaaaaaaataaaaaaataaaaaatttgcagatgttctcaagtgtgctttattttgcttttctcagctgcaagcaacaagaggactcaggttttgcctaccagcagttgagaggccccttttttttagttgccatgtatatgaggatgttggacacaaacttcaaaagaaccctagtaatgtggtgagaattgtcttgtggcattaattaatttaggctatttgagtcaacttggagagaagagttccaaaaaacatggtgtaatgattttgagcctcttttttagaggtgaacagctggtaccagctccatcacttgcctctggtgggatctttggcatgttacctaaccctctgtgcttcagtttcttaatctgtaaaactgacataataaccatatctttttcatagggttgctggaggtgatcagttagataatccttacaaagtacctacttagcacaatgcctggcacataataagcattcaataaatgttatatagcgttagtgctggaaggacccgagtcatctgatagaagtacttcgctttatagatctggaaataaggcttagttctccgggggaaaatgtttaaaaccttaaagtaagagggaatcggtatgtttttgtagatagatctaagcctggaatgcaatgtctactttaaaagtattcatcactaaaataatcctgtagattttcgagagcaagcatctgccgacagtttttttgacagcccttcctctgcttggcaggttacaatgatgatttcactaatgtcagaaagacaattttctatataattatagtttttagctccattcttggactcagcctactatttgtgaacgttttcacaagaaatcaggatggggcagaaaaagaatacagaagatgtgaactacaaaaatttattgggcacttacttatgccaggtatacaaagatctccaggacattgctttttggtccagaaagcttacagcctagttgaggaaacaagtatgggtgagaaaaaaataacaacagcaataatagcagtgagtattttttttttttttttgagacaaggtctcacaccttgtttcacaactcactgcagcactgaactcctgggctcaaccaatcctcttgcttcagcctctcaagtaactaggactacaggcatgtgccaccatgcccagttaatttttaaattttttgtggagatgagggtctcactatgttgcccaggctggtcttgaattcttggcctcaagcaatccgcctgcctaggcctttgaaagtgccgggatttacaagtgtggaccactgcatctggccttaattagcacttattgaatgcttaagatgtgctagacactaagcaaaacaagcagcctatgataccccattctgttgtcatagtaactgtcagatcgatggttaccacaatttacagtccaacaagacagttgaataggcttccagacattaagtattggttcaggatcatacaggatttaagtgtcaaataagttaaaaggaagagataactctgggccaaggtcataattttcaaagttggggtttgggggtggctagaactcccactaggtgagtgtggaaggggtccactacttgaatttttcaggtggagaccagggatgataaatgtcttgcagtccttaggactaccctgtacaacaaagattgtcttattctgcaaagcttttaaataccctagcaaatattcatgtagttaaataacatttttatataattatctgaccctggaaattctaaacatggttttaatatatactatgtattccagaaatgaaagctccttctcatttaaaaacaagtgtatttaacattttttggaatattccaaagagttgttcagcattttgcaattgatgttattggcagcagtgcaaatcatgtctgagttgtcaatacaacacatacctctttcagtctgcatttatagctattgcactaacaatggttctacacataggtgagcatctgatacctgtttattacgactgctggaatagtcatacctgagaatttgcttattgaaatgtttccctcctttttttcccccttttctggaatttatgtgttcagataggttatattatctgtgaatatcactttaggataataaaggggttattataagctatttgttatagaaagggagtattgggttttatagcattgcattgagtttctagggaagtagctatttgaaggtaaagaggataaatgagagattctagaatcagttgggtcttagattgtcagtggttgaaagaacttaattctggagattttagataaggtggtgattgtgaccagagcagtgtttatctggcattgtagatctgcgatagatccgggacaatgtatggggaggaattagactggctgtcaggggaggagttatgggactgtgcaggactgttttaaaaatgggttggacaaagagctaggcacattgagaaggaggaattggtcagacttgtttggcagtatttggggaacataggtaaaatgtaattgtttgtctgatttttatttaaatctttcattcctctttagaattatttaaaggtacatagcatcttttactgaatcaaatgacaagagggcattttatttatttatctatttatttatttatttatttatctgtttgcttaatggtgcttttgtgatttggggttgcaagctctctctgtggtcctgttggatatttattgatccctagtagcattatcataaggcatatcagcattaagaattttcattaacgggacatgtggaaacactgctagaaggaaactattgttgctagactgtttcacctaggtagctttatgctttgccccaaaatcacaactgtattctcagtgtagaacttgtagtggcctgccattagtccccaacaactctaaactccgtatgtcatttttatggaaacaaggactctcctctcaatgctgacaaaatttctagcatgcagcacactggctaatttttgtattttttgtagagatggggtttcacatgttggccaggctggtcttgaactcttaacctcgtaatccacccgcctcagccacccaaagtgctggggttacaggtatgagccatcgcacccagcctagggtaaagttttgaatttgtctacattctctagatcaggacttcgccagtagaaatagaatgcaagccacattaagtaatttaaaattttctagtaccacgttaaaaaatgtggtactagaccttgaatttttcgggtggagaccagggatgataaatgtcttgcagtccttaggactaccctgtacaacaaagattgtgttattctgcaaagcttttaaataccctagcaaatattcatgtagttaaataacttttttgtataattatctaaccctggaaattctaaacatggttttaatatacgctatgtattccagaagtagaaacttttaaaaaggtgaaattatttttaacatgttttatttaacctaatataaccaaaatattatcgtttcaacatgcaatcaatatttaaaaattattagacattttacattttttccacgccaagtattcacaatcagcgtgcattttacactcacagcaatcaacttggatgcaatattcattggaaatacttgatctgtatttaaatttcataaaatttagagttgaggaagtagactcacctacctaagaagttccaaacctacttaaatgttttccaataagagtcaaatatcaacttataaatctgtatttaaattaattgtagttaaataaattcagttgtcggttgcgctaccttttaagtattcaatagcttctaggtactagtagacagggactgtattggacagcacagctgtatattgttcttaaaagccatcatttgtatagtgtttgcctattttccaagtgctgctttgatatcttctcaggttattgtttatgtagaattagtccatgcccctaagttcctctcagaaactgttttaattagatgagattcattcatcaaggatataagtgtctaggggaaaaagttctgcatagttgtacctcatccccagggccaggaaatgccttgcacattctaggtgtttaataaatgtttatctacctaaatcctagttggtcctcaaattgcaccttaaatttgactttctcaggaaagcatttcctgactctccagtctggcctgtggttttttgttgcattttctcttacacctaagttattttcctccagaacttatttatgtgagtaactttgtgattaatatccatctccccaacaactaggctgtaagttccacaagacggtaaatgtgtttttactcactaaagtatcccctgctcctagcataatgcatgacacatggcaggtatggagtaaatatgggtcagataataactcagggctatttataatataaagtcattagcagaatgtctaattcttaactttatagaagttggagtttgtttggtcagggaaacaggaatattttattttaaggattatatacactaaggacagtcatccctcggtatttgagggggattggttccaagactcccttcagataccaaaatctgggggtgctcaagccccttaaataaagtggtgtagtatttgcatagaatctatgcaacatcctcctgtatactttttattttttaattattttttagagatagggtgtcactctgttgtccaggctggaatgcaatggtgcaatcatagctcactgcagccttaacctcctgggctcaagtgatccttccacctcagcctcctgagtagctgggatacaagtgtgtgccaccccacccagctaattttagtatgttttgtagagatagggtctcgctgtgttgcccaggctggtctcaaactcctgggctcaggtggtcctcccacctgtgtctcccagtgtgcatgagccgctgtacctgccccttccgtataccttaaatcaactctagattactgataatacttaatacaatataaatgctatgtaaatagttttgctgtactgtattgttgaaggaataatgacaaggaaaaaaaagtctgtacatattcagtacagatgcaaccatcacaggcctaactttctgatcctcacttggttgaatgcatggatgtagaacccgaggatacggagggccaactgtatgtagattcttagtttttgttcaagccttttcagaatgctcacactagtatgcctttttttgactttctctctactggtattcattttcttgagtatctattacttcatctctttctctgcatagcatttaatgtactgaagacaaaaactaaaatgtaagaaaaggaaaatggaattgtgaaatatgtttaaggaactgagcagaaagttatagggcaaagacagaggagcacagaggaggcatcacttgctgtttcaggacagtttagaataaacccacccttttaattataccagagtaatgagccttacccacagtttgtgaaaatataattaacaatgtatcttggttcagtagaccaggctgtcaggtcattatcagaatcataaatttggaagtgatgcccattaaaggttgctagtttggaaaggttagattagaatttagagcttttgcaaatataaaggtttttcaatttaagttgtgctttagaaaacctctggcatttgatttttttcttttaacttttcatggaagtgcattacgcatatagaaatgtgcacgtaagagcacagcctgatgaatttccacatctcaatgaaaaaaacatgacattctcagtgtcccagaagccacccttttgcttcttccctaccccacccccatcatcctgatatcaatctgtttttcctgtttttgtaattcatataaatagaatcatacagtatctgtatttgacttaatataacatgttatcattctgagtgacattcctgatggcaactcattgaaaataaggtctattttcagttttccttattatgtattattttgttaaactggcagcttaccagtatttctagatctttctattcctttaagaaattttccatgtaaatgcatgtgcatgtgagtatacacctaggtgtgtgtgcacatgtatttatatgtgtacgctttttaaaaatgttactcaaattagatcatgctttgctatgcatattcttcacctcttggtgatgcatcttaaaaccctttttggccaggtgtcgtgactcacacctgtaatcccagcactttgggaggccaaggtgggcggatcacttgaggtcaggagttcaagaccaacctggtcaacatggtgaaacgctgtttctactaaaaatacaaaaattagttgggcgtggtgatgcgcgcctgtaatcccaactactcgggaggctgaggcaggagaatagcttcaacccgggaggtggaggttgcagtgaaccgagattgcgctattgccctccagcctgggtgacagagccagactccgttgcaaaaaaacaaaaaaccaacaaccccttttatataggctcttgtagatccacttcatttttcctaagggcagcatggtacttcattgtatgggtgtattatcatctaatgaaccagctgtgcactgaagaacatctaggtggttactggtcttttgacttcagaagaatagaatccacgttagcttgtctgtgaaacaaattatcagaagtggaattgccgagcagtgggatccatgcattcaaaacttgctcagatatttgtaaatggctctccaaagaattttgccagcttttactctcaccagcaaggtttgaaacttcctgtttccagtgtcctgtccttagattgtggtattatctggcttattaatctttccagtctgatataggaaatccagttagacattgttatttaaattggtattttcttaagttttgagtgaagctagtgatttatgtttattcaacattggtgtttctcttgggacttgtttcttttcttattctcctacagacttgttcatatttttcttaatggttttaaggaactctttctatataaaggaaattagcccttttatgtcatctgtggtggtaattttttcttcagtctgttttttgcttttatcgtgtttatagtcactttttttctaaacagatggttttaatttttacgtggcaaaatgtaccaatttttttttttctgtagtggtgctgaattgtgtgtgtgtgtgtgtgtgtgtgtgtgtgtgtgtgtgatgagaaaaagcattggaaacttgagacagaaaggtaggtaaggcctaccatgaaaaaaatcctcaataaatgtttgtgggaaatgtgacaaagtaggaattcaagtttcaatcaaaagtggtatgaccaactataaacaaacaaaaatttggacattatctgccaaaatttgtttggtatatataacagcttttggagagattttcactgctatgcttttctttcttttatgctttgttatttggagttttaatttctcaaatgatcccttctttttagatttcaaattataacctatttcctgcaccattgctgacgcctggtgatccatgtcagaagtacttccaggtcagatacattttctcatatttcaatgcagagaagcagttgaatattaaaacttaaaaaaagataatgtttaatgttaaacttatgatttgctaaaataacatgttttttaatttcattgttcttcactaatgtaatagaaaaatgaatcttggccgggcgcggtggctcacgcctgtaatcccagcactttgggaggccgagaccggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaagaaagaaaaatgaatctttaaaatcaagtacaagaattagttggacttaaccatatttgtgtaataattgcatgaatacttatatcgtaatgtaaaaatattttagttgactatgacaggagcttaaaactgtcaaattttaccatctagcattgtacattacagcctgggtactgctgaaatgtcaacaaaggagtaggtgttggtgttgcgtttctcaatctgcatcttattaatagcttgtagagtttgcttagacagaaaccccccccgcccccaatactgaatgtattctccttgggtctaatcagcagattaatttcaggccttaggaaaacaaccttaattttattgtgcatcccttttttggtctcatgatagatgctagtctacatacaatgtggtgtgggatttaatccctagcctcacagttacataataaggaaaaagcaattgcagaaacatttcatattaaacatcatataggacttcaagtgacagatctggatagatttcatatttattagggcacatattgctcagcaagttctgagtttttaaataagtagatttaagccattggcaaatagatactaatgtccctaaattctaaacttattattaaatataatcaagctgttttctcctttatatgacatttttcatgttatatttcaacaaagaactaaaataaaacataaacactaagctcagcagaggtatatgagaggcaacaaatattcttttataaaaaacagccaaaaactatgacaaacctgagtttacacaggaatatcagtgtcttagagctgatttttagaagccatataatcatagtgtgatgatttggggagggtatggattttgtcaatacatattttgtcaatacgtattgaatagatatatgaattttggaaaaatcaaaataaatacgtatgttctttagaaaatagattttaaatgttgagaataattcttttagggatcctttaacttttaaaatcatatttttatgagataggttattaatagattattattatagtcttatcttcaaggtactctagtatgaaaacattaaaataaagctggcaagtgtataaaatgatgtgtgttcctctaagtgaaggtggactaatcaaataacttctagaaatttcctgttcttgctatattttgttatgctgatgttttcattcttcatgctggtgctcaaacagctttattctttggtggttataacgtaagagatactggaacagttatctagcctggtttttaaataacagctactactctcatgcatcggtatgacatataacacattctacagggaaagaggtattcctagttcagtggaaaatcctattccagccatttttttcacttgaaaattcaaatggcgactgatgagagagggtcttgactaataagtggggtaaggtttgccttcagctcctttttctaactctagggagctgtgactacagggacatcttttaaaaacaaacatgccagaatttatttatttatttatttatttaaattttttttgagacagagtcttgctctgacacccaggctggagtgcagtggcacaatcttggttcactgcaacctttgcctcccaggttcaagcgattctcctgcctcaggctcccgagtaactgggattacaggcatgtgccatgatgcccagctaatttttgtaattttagtaaagacagggtttcaccatgttggccaggctggtcttgaactcctggcctcaagtgatctgcccgcctcggcctctcaaagtggtaggattacaggtgtgagtcaccacgccctgccaaacataccagaatttataccattgtctgcctctgaaactcctattggcccttcacgattcagctcaggagtgccttctgagcaggccttagcccatgatatcaagtaattaccctattttaaggatcctgttattgtttaacattttttccctttcagaatggatttggggcccagcttatcagtagtaactcaagaaaatatgtgacatttctttatagctcacctacttttttttcacctaaaccaatattctcaagctggatcatcatcaggcttgcccgtaagtctagagctctattaaaaaaaaattatctttgaaagtcactgaggctttattaaagaatggaaacagcttagaaattgagcagggaagagagctaggtgtagtggtgcatacctgtagctccagctacttgggagtctgaggcggcaggaggatcgcttgagcccaggaatttgaggctgtagtgcatgatgactgtgcctgtgaatgcactccagcctgggcaacatagtgagaccctgtcccttaaagtaaaaaagaaattgaacagagaaaatgaccttggaatataatttccaaagttgactactccaaaggtcttaattcttacttgaatatacacattctgcttgtgcttcctaaataactgaccatcacatctgccaggtgttatgttgggaatggcaagctttcccccatctggaatgcctttttctttcttgtccactgctgggctcctttccacccttcaagatccggctcagctcttctttttgttttgagatggagtctagctctgtcgcccaggctggagtgcggtggtgcgacctcagctcactgcaaccttcgccccccgggttcaagtgattctcctgcctcagcctcccgagtagctgggactacaggcatgtgccaccatgcccggctaattttttgtatttttagtagagacgggatttcactgtgttagccaggatggccttgatcttctgacctcgtgatccgcctgcctcagcctcccaaagtgctaggattacaggcatgaaccaccgcgcccagccagctcttctttttgtgggaagccttccctgaacctctctcctcatccctaacatggtgttctcataagaccctctgccaacttcagccattgtgagtttgtgtaatctgattttctgccaaatctgattttcttttttagaaaataacatttcttacttattttttataatcgacaaataaaacatgtatatgtttattgtgtacaacatgttgttttgaaatgtgtatacattgtggaatggctaaatcaagctcgttaagattgagtttattaaaaagtatgtgatacatctgtcttaaatctcagttccacttcaaacattgaacagagtgagtcctcaggcagttaagtttaatgggacacaagaaaccctcaagtgggtaagatctgattgtatctgacactctgcatcagcagtgtgacattgctcgcctagttagaatattctgaggttcaaatcctcccatctccctggcccggtgacccaagctgccttattgataacttttgcctcttttgttcacagagttcttatcatttttgtcacattgaaggtttcctttcatgagtagtttcgggaagccagctttatttagcttctccctcctaaaaggaaaagaaaaatcagagtttatttcatttccttaatattttgtaatctagttcaaacagtgacattcctcagggtaggtttcactattaactcctcagtggaaatgaaattgtatagcagaaaaataaaaatgaagcaaatgtgaagtttcattcaagcatggggcaaacattggtcttcctttggcccatttatcaaccctgggcccgtttgtcagtttccaattttataagcatgtcgcgggagtaaagggagagcagcaggttattgaagagagaagttcttgtcattactcacaaactctttctttgacaaaaggctaaaggtcttagaaaagggaaaaggaggagggggaaagccaggtttaaccacaggatgcagcacaggtttgtattaggatgtggtccgagttacagggccagtaggcctggttgtatctgtgctggggcctttgtggctgggatcgagagaagctgggcaagtcatgaaattagagtgatcctggcttatccagttttgtttaggtttcataaaaaatactttgtgtattaacgagggctcttttagttgcaaaacagagaaaacctagctccaagtggcttaggcaaaataaacacataaatctatcgacctgagaagtccagcagtatcatatttcaggcatgtcttattttagggattcagtcattagggcttgcacattttctctctgtctcttggcttcgctttctttggtacagtcatgctgggcaggttatctcctcatggtgaccccttgaagctctaggcttatatcttctagttcaagaaaaagagaaaacagagcaccactcttaccttctggcaagtctcatggttggcttcatgtgggtcataagcttttccttgaaccagccactagagccctggggatttgctactgtgattggctgtgccttggccatgtgccccctgaaataaggagtacaatcatctctgcctgaaacacatgggcctaatccctagagtgtgcgctctgcgctccataggtatctttactttgttggttttgttcactgctatatcctcagcacttagaagcatatatggcatggagtagtgcacaaaaaatatctgttgaatgattgaatgggtgtaggggaaggctgattcccctagaaaatttgcgaggcttttaacagaaaaggaggaaacacgtgccaggctataatagatgttccttcatcatgcatgcaggagagcaatgacagcagtaatattagctcttgtcacactcttaaatctgaacttatacccacctctggattaggaatcgatcctcttgaattgatgttggagcttcataaatcacactcaacatagcatgatgaatagacgtggaggggatggcagaatcactgggggacccatccacctgccaggaatccaagagaaccacctttatgctaaagactaaccctcattgttactggcattttggttattcattcctcatttagttttgcttattttgttcactgctgtgttcttggccttggtatacatagtaggctcttggtacatatttaatgaattaatgaggaaatgaattaaggagtcaaaaaacatttattgagtcttattacatgctagactttataataaaaggaactggaaattctggaaaatgaaagggaaatgaaaagcatagccccagtgaaataccatttcacaccaactaggatggctataataaaaaagacaataacaagtgttggcaaggatgtggagaatttagaagccttatacactgttggagggaatggaaaatggtacagtggctttgtactacagtctgggagttcttgaaaatgttatatatatatatatatatatatatatatatatatatatatgtaacaatatgtttataaaaatataaaaatgtgtgtgtgtatgtacaaaaaagttactgtactcagcagttccactcctgagtacacacccaagacaattgaaaatgtgttactgaaacaccaggggttcagtctaggtcctgctgctcactgcacagaaagccagatcactgagagggcaggtattgctaaggaagaaggctttaatcgggtgctgcagctgagaagataggagctcagtctgaaatccatctccctgaccaactaaaactaaggttttatatagtagggaagaaatgaaacaaactgtaacaaaacaggatctaggtaggagcaaggaagcaattaggatgaatgagggttcccccatctcattgtctggatgcaatgatctggtgagtttcagttctttgatactttttttttgagagacctgaaggtcatttcctgaggaaggatctcagataaacaaatataaatttcttttaagaccagaagggtcaatttctatgtttatcaaaaaaagctatctgtaggactattgggtcagttttacatatccatagaagaaaaacttgtatatgagtgttaactcataatagctaaaaactgaaaacaacccaaatgtccattaaccagtgaacaaataaaatgtagtatagccatacaatgaaatattatccagccataaagaggaataaagtactgatacatgctacaacatggatgaaccttgaagatacagtaaatgagagaagccagtcacaaaagatctcattatatgattctgtttatatgaaatgtctatcatcaccaagttcacaaaaacaaagattagtgtttgcaggggttggagggagggacgaatgggtcgtgactgttaatgggtacaggatttcatttttggtgataaaaatgttcttgaattagatagtattattggatgcacaactctgtgagtatactaaatagcactgaattgtgtactttaaaatatggtatataaatttatgatataaaaattttttaacttttaggttcaggggtacatgtgaaggtttgttacataggtaaacacatgtcatggggctttgttgttcagattatttcatcacctaggtattaagctcagtacccaatagttatcttttctgctcctctccctcctcccatcctccacactccagtgtttgttgtctccttctttgtgtttgtaagttcttatcatttagctcccacttataagagaaaatgtgctacttggttttctgttcctgcattagttttctaaggataataatctccagctccattcatgttcctacaaaagacattatcttgtgcttttttatggctgcatagtattccatggtatatatgtaccacattttcctttttttctttttttttttttttttttgtggagatggagtctcactctttcgcccaggctggagtgaagtggcatgatcttggctcaatgccacctccaccccccaacccctaccccccaccatcccagcttcaagagattctccggccatcagccttccaactagctgggattataggcatctaccaccacacccagctagtttttgtatttttagtggagacacggtttcaccatgttggccaggctggtctcaaactcctgacctgaggtgatccacccacctcagcctcccaaagtgctaggattacaggcatgagccaccatgactggcccacattttctttatccagtctgtcattaatggacatttaggttgattccatgtctttgctgttgtgaatagcgctgcagtgaacattcatgtccatgtgtgtttatgatttatattcctctgagtatatacccagtaacaggattactgggtcgaatggtagttctgcttttaactttttgagaaatcgccacactgctttccacaacagttgaactaattcacactcccaccgacagcatataagtgttcccttttctccgcaatctcaccagcatctattattttttgactttttagtaatagccattctgatttgatttgcatattctttaatgatcagcggtattgagctttttttcatatgcttcttggccaaatgtatgtcttcttttcagaagtgtctgttcatgtcctttgctcactttttaatgggtttgtttttctcctgtaaatttgtttaattaagttccttatagggttgtgggagtgaaggaggaccggagagatcatggtgaaactggaggatttttattgagtgcactcagacccagcggattaacatccaaaaactgggcctggaacaaagacagcacttgaattttagacacatttctaaaagggggtgggctagcctgaaacaagtttacagtggcgcgaatcgtagtggcgtgaaagcaaggatacagaggcagaacaaagggagttaattaaattgtgacaggttcataactcaggattacaggtgactcttcctgtgcagtccagatggctgttatggaggcttgctctagtgccttgcacaggcttatctcttaaccttcactatggcgcccagatggctgcagcccaggcctgctcaggcatgtcttataatcttcactgtgctgcttagataaaaacagaatactcaagttaccggaaaacaggaatctgtaaactcataagttttactcataggggaaaggaaaatttgttttcttctccctatgttgaaggagggctgggagagtctccagggcacattcctttgagctctggcttcttagataatattattgagacttcacctgggtccaggctttgcctgctactgcctttggaatgagtcaccctaatatagaaggcttgtttttctctttttaattttatttttctttcgttcttcaatttcctccctcaataggtgctggatattagacctttgtcagatgcacagtttgaagatagtttctcccattctgtaggttgtctgtttactctgttgatagtttcttttgctgtgcagaagctcataagtttaattagatcccacttgtcaatttgttttgatcgcttttggtgtctttgtcatgaaatctttatccattcctttgtccaggatggtattgcttaggctgtcttccaggctttttatagtttggggttgtacatttaagtgtttaattcatcttgagttgatttttgtatacggtataaggaaagggtccagcttcaatcttttgcatatggctagccggttatttcagcaccatttattgaataaagagtcttttccccattgctgttttttgtcagctttgttgaagataagatggtcatagatgtatggctttatttctgggctctctattctgtcccattggtctgtgtgttcttgtttttgtaccagtaccatgctgttttgagtactgaagccctgtagtataatttgaagttgggtaacatgaggcttccagctttgttctttttgcttgggcttgccttggctaattggactctttttttggttccatatgaattttgaaataattttctttagttctgtgaagaatgtcgatagtttgataggaatagtattgaatctgtaaattgctttgggcagtgtagccattttaattatattaattcttcctacccatgagcatgggatgtttttccatttgtttgtgtcttctctgatttctttgaacagtgttttgtaattcttattgtagagatctttcacttccctggttagctgtattcctaggtgttttattctttttgtggcaattgtgaatgagattgtgtttctgatttggctccctgcttggctgttgttggtggataggaatgctagtgatttttgtacactgattttgtatcctgaaactttgcttaagttgtttatcagccgaaagagcttttgggctgaggctgtgggattttctagataatagtatataaattatatctcaatgaagctgttatttaaaaaaaatgaatggaatagtcactttcctcaaggcgtttgcaatttagaagaagacatagacataggatctaatcatagaagtctgcaacttcttatctactgaggaagtatgcaagaactgctaactcatgccccccatatttaacaatatgcctgatgcttttcagatcaagaaatgagctttgagctgataggattgcaactgatgaacagtcatgtttgacagggaagtaccccattctgctctaagttacaaaacatatgcttttgactctaaatattccttgttctttcgggagccacggtagagttgagtaagaatttatttgagctgagactgaggagcaagataaattggtctatacattatattaaaggattttattttaactcttgctcagatgctacatggggtaacagctgagataactaactgatcattgatcaccctttctctgatatatcaaggatatcctttcctttttttcaaggaaaggaaagatgaatttcctgttgacttaactattaataacagtggtttcctttcagtgtttaataagaaactctcagaaattctgtctagacattttatgtcaacattttttgagatgttaattgaaacacttgcctttcccgttttacttgaggatttattctccaaacatttatgagtgcctactctgtgctaggcctctgtgctggttggtggaggtcacagtctagtgggaaactcaaacaggttaatagtaaaagtaaaacagcatgagtgatgctgtaatagaaatgcatttatgaaggtgtgagaattgtgagaagtagactccagagggacaagagaaggcttcataaagcggtgacatcttttctgaatcttcaaagaggagtaggaatttgctggagggaaggaagggtactgagagtgtgtggagggacaaggaagatgatgtatgcgatcagagcattccatgtgcctctgaaataattaactccatgtacatcattttattcttcccagatctcacacttcctcttccagtggttctccaaattggccacagattagaatcaccgcaagaacattttaatgccctgactgggcccaatcccagaggaactgaatcagaatcttagaagtatttttgtgggtggggcctaggcatctatactgttttaaaagccccccaggtggtttttacatgtggccagggttgagaacagttcctcattcccttcacatctgttcctctgtgtccggaatttattccttctggtgggttcttggtcttgctgacttcaagaatgaagccacggacccttgccgtgagtctcacagctcttaaagatggtgtgtctggagtttgttcctttagatgttcagatgtgtccagagtttctttcttccagtgggttcatggtctcgctgacttcaggagtgaagccacagacctttgcagtgagtgttaaggtggtgcgtccggagttgtttgttcctgccagtgggttcgtggttttgctgacttgaggaatgaagccacagaccctcacagtgagtgttatagctcataaaggtggtgtggacccaaagaatgagcagcaggaagatttattgtgaagagtgaaagaacaaagcttccacagtgtggaaggggacccaagcgagttgccattgctagctcaggtggccagcttttattcccttatttggccccacccacgtcctgctgattggtccattttacagagcactgaacggaccattttacagagtgctgattggtgagtttacaaacctttagctagacatagagggctgattggtgcgtttttacagagtgctgattggtgtgtttacaatcctttagcaagacatagagtgctgattggtgcatttacaatcctttagctagacacagagtgctgattggtgcatttttacagagtgctgattggtgcatttacaatcctctagctagacagaaaagttctccaagtccccactcgacccaggaagtccagctgacttcacctctcaatccccctctaaacaggacaccccacctgctgttgggaattgggtgatgactgctctagccacttcctgctggataggggcgaagaccgggccgtgcagttgtagtgtcctccagaggggaactctttaggccagtgaaagggccagcgggtcggttcaggggtcctcggtagaagttgttagttgagctcatttggggttccatttgtaagaccatctgtagcttgacggcctcaatcccagaggaaacaaatttgacaaggagattaaaaatacagggcccgaaggcaagtaatagcaagatggctgtcatgggacttagaaaggggagaagccatgttgcttaactccagaggttggtataagagtttgaaaggcgttgtctgatttcagaagccttttcctgtaaacgctgggcggcatctcttactatccctgacctgttagtgtaaaaacaacactcttcccctaagaaggtgcagcagtcctcctttctcagcagtgaggaggtctatgcctcagaggcttcggagtgtcactgctgccagagtctatttgggattgtagagtaaggataggtttcattatttcttgcaaactgagaaatcctttgagagtgtgtggtagtaggataatacatgttacactgttaacttttagcaaactttacttttgttgaaaacgttgtaagtttgggattaccttataacctaataaatttgggattaccttataagttaatatggactgaacgccctgggttctttgctattaataagatctcgttcagtccatattaacttagaattggtatagatggttccttcctgattctgtaagtactttaaggtttggctgagtgcaaacagctggcactggtttgagcagaccaattattaggcaattttcctaactgcttctacaggagttcccttatcacttactgaatacccattgtgtcttttttccttaatcacctgggaggaaccatctattgtcctgtcctgaaggagttcctcctagatctagttggacctttgtatggtaattagttaagatttagatcccctgttaggaaacctgcagggttaaggatttttgataggaaggctatgggttgtcagtggcttcagtgctttcgggttacacccttgtttacactggcaacaaggtggtattggagtgttacagggttacagagaagaccttcaattatcaattataggttttaaatttaccctggcttttaaaggaatagggtacactgttttctctttactgcttctgtctctttctctctgactcctttgtctcttcctctctttccttctctctttgactttctgtctctctgtctcttcctctctctgtctctgtctttccctcctctctcttcgactccttgtctgtctcttcctctctctgtctccttctctttgtctctctgtctcttcctctctctctgactttctgtctccttgtctctttcctttctgctgcctctgccagctgcttatgctgctgttctcccctctccttcccctttttgatggcttcggcagtggaagactgccacctccttgggtttttgcactgcatgcaatacctctaccttcctgggacctctgacctctggccttttccttttctcccacttctttaccgtttctactgtgcagtcccctgatttcctgctttctccaggccagatcccagggtgcaccctcatctgttcatctcaacacgcccgacgacttcatcaccttcccctctgtgactatttctgaacgttgtctccctttttaagtttccttctacaccatacccctagactgtttcctctctgggaaaactttctcttcatagagaaaattaaggctgccagtttcgcttttgctcggttttgtgtcactgtagtgacacacgtgtctgtccttgtccttaccgcctctcttccctcctagcgtgaaggtacccttatcttgggcagtgctgtttccagtccggtcttgtcccttctcttctctcatcacgtggattctaccttactgttctgttactcttttgtgtttccacttttactctctttattggcttctgcttttacagcctttaaacaataaaccataactaagaatctcatctttaaaaagtataaagtccctcccgtaaacctgggtcatcctccagctactgtcctgtctcccccaacttgaataaagttcactctctgcccacctctgcattctcctgaagctgatatgatagaagtcaccagtgtctttctaattactcaattcaccagactcttcaatcctcacttctgaatccaagtggctaatgggaaccttatctttctgccctgttcaagggatgattgaccagagctggaactgtagtagtgggagagtaagactttcacccccatacctaagtctcttgtgactaccttgtcctctcccactttcttgactggactgttgcaaagaacctcccaactggtcctgcttccctttggtaaatggcagagtccactctaaggccagagaatgagcctaaaaatggggccagcttacctctttgttggttcagaagacactgtctgtgtacctctttccactgtttctctgatcaccactgatgttttaattgcctggtctacattacttctttaatgtcttttcatcatagtcatcgccttctcggagaatatactagaggaaaaaggctcaacatatacacagatacaacacacacacactcagaatatacacatcaaccttccattcattcctcctgctgttgcctcagggtcaagtccaaagtgttagagcatgcttcagaagaacccctgcctttgctcttctccatcataccgcctctcctttcatgtcttgatttgttcaggctcccttgatgataatcctcccttccctgaagatcctctccaaccctaggtgagtagcccacttattcctctgcatctgcccacccgtcaccctctgtgatttctgtgactttattgtgtgtttttcttctgcaagcctgaaagcacatagcaggtaggaactttatgttccttggttttccaattcctagcacagtacccagcaagaagaaagtgctcagtcagtggtggcttgaggtatggtggtcagaaataaaagtgtgcaaggaaggagggagctataagattatgataatccctaacatgtattgagctcttacagtatgccagccattatgtcaaaggtttgacagtcatgttttagtccccagcaaaactcaatgaggtgtagatactattataatttcattttacagcaaagaaatgggagtttaagtaacttgttggttgtgttaaagagtttggtcttatttcttaggccttttgattccaaagaaaacagttaaatattagaaggtttaaagaaacattgtaagattttcttttatttaaagacaaacacaaacctctatcctcttaaacccgaggaatgtatatttttttcataattaaatcctcatagacccaacttctttgttccttcttagtctctttcctctctgtgtgtctctgcaacaagaccatttcaatcactcagaccaattagagtggggggtaatctgggggccctggtaggcagccccgcgctatattacttgcgtacaaagtagtgagtggagctcacatttattgttataaactcgtacaaagtggtgagtggagctcacatttattgttataaactccctgtaggcaagtttacttgtcatgtaaaccaagtactattattatccccatttttaaccaggaagtaggttggataggtcttgagcctttctctccttgaccctgagatctgtgcttttaacccttacagcatttcctctcccttggggctgctttcttgtagccttgatctttctaggattttgctaacctgtagctacttcatgacccttttgagcccaaggacttcctagctgatatgtaactcctagaggaactctatagttcatgggattagcttggctgccgtagctctagaattgaactttttcttttgcctccacatgataccattatttaatgtctaagatattactcaaactgtgttcaggctttgatatataaaaacaacatatacaggctgggcctggtggttcacgcctgtaatcccagtactttgggaggctgaggtaggaggattacttgaacccaggaatttgagaccaacctgggcaacaaagtgagacccctgcctctacaaaaagtcaaaaaattagccaggtgtggtgtatacgcctgtggtctcagctacttaggaggctgaggtaggaagatcgcttgagcctaggaggttgaggctgcagtgaggcatgctcctgccacttgtactccagcctgggtgacagagcaagaccctgtctcaaaagtaatgataaataaataaccaaccctgtctcaaaagtaataagtacgtaaataaactaataaatatggcatatacagagctgcattttttcatccagtttgtattggatggtccttttctattcagcctcttacccctcctgcctgccctccattatttctagcaagcagaagagttacatggcccctgatagggtaatgggatcccaaagactgtgaaaatatggctagaagtctttttttttcttttttgttttttgagacagagttttgctcttgttgcccaggctggagtgcaatggggcgatctcgtctcactgcaacctctacctcccgagttcaagcgattctcctgcctcagcctcctgagtaccggcatgcgccaccatgcctggctaattttgtatttttagtagagacagggtttctccatgttggtcaggctggtctcaaactcccgacctcaggtgatctgcccgcctcagcctcccaaagtgctgggattacaggcgtgagccaccgcacccggctgtggctagaagtcttaatctgtcatattgaggatataaaagttatttatatattaaaaatcacctagaaattctgatggtattctttctgaaaatatgtatgattataaacaaagcaaataaaaatatctccctaataacattgctagaatgtataatagtacctagcatcataaagcagcctaatataaatgttttgccatgccttttaggaacagcagatttgcactttctcataatctcactctaaatacccaagagtctaaaaataactttctctcatgtatctatgctctggatatgtgtctcagggaaaacttcatgtaggtttcaggtaggcccttctcatatgaaatgccactcttgagtgaaattaaattataaattgaaacatgtttcccataaaatggtataatagttgtagccaaatggtaataaaaattgtttttttttaatttaattgtcaagagtattgtttaaaaggcagaaaccttccattggactgggtggaggaaaaggaaattttgaaaaaggaaaaaccacactacattctctgtttctgtaaaatgaggcctaagagctaaggtgaggtgctaggtgagaaggaatcccgataaataataactttaaagaatggggcccaagatcctaacccttggggttacagcccttgactctcttatgggccacatggtcatactgttataaaaatggccatggcctagagtggaggattgatgttgccttgcttcctggaagcatagggactctagaatgagcaacttttttctaaaattgcccaacctaagtatttggtgatggagagatacctctaagctcccaaacaaggaaattattgcccttctctcctgcaaagatccctgttttgcctgggggaggaagagggaattgtcagaatataatttcaggaatttcaggagctgtgctttggttcatctgctgctgaggtagagatcaccaaagtctctgtggagggcaaaaggatcagataagaaagaagtcactcctcatagattgagaaatctgaaaccttaggaattcttgctgatgaattttattcccttctagtctaagaaacctttctttcttcccagcgagagacatatagaataaatcactaacggcgcaaacaatatttgagataaatgcggttgccagatagtttcctaggagttctgcagaggcatgtgatgactgcaaacagctgagtctgtattttaattcagtggaatatattcagactcctctgggagctctaacatgttgtctgtagccaagggctcaatgctacagtaatagttttgtgtgcgtgtgtacgtgttcttcagaaattaagccatttcttcaaaatttcagtttagtacaaacagtaagcccaggtcaaaaatgttcaccaagacattagcaaactctaatggagggttagttttccaggcattcagaacacagtttctaaacgtggttgagaaaaattaccttggatgtatggagcatcattgaacaatgacctttcaggttaattaagaaagctgaagccccagaggaatcttgagcaattttttgttgttgcctgaaggaaccaaagaataaaaatgtagtgggaatatttggaaaggggatgatttttcaagcttgtaaaaaatgaagaccagccaccagaagaaaatgcttttatgtgaattcaaagagaaatgcttttttattttaagtaaaatttaggtcctcagacttcttagcttttctataaattggcttttggttatccacgttaagccctttatttgctcctgtttaatataggaacaaatggtgaaataaagaggaaaatgggtccattctatgagaatgtatgtgcagtggaagcatttcttcttttagttttctatataaaaatatttactcacactgtatactaagtagtttaatcatggcaggtgtctaatgactttttttttccccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacaggtacccctggggaaggcgtagcctcagctggcacttttttttttttatcttttcaactattggagtaaatctctagactgaccaaaaatgtccattatgcagagaggaacgtgagcctcttgcggtaaaattgggcaatttatttgcaaaatattactgcattcctcaaccatattttaggtcagtttcattttggatcgtgcataaagttgtttgttctgggaagcatttttgtaaaataaacagatccttggtgttaagtacagtaaaatatcatatatttagaaattacacttccagtgcataggtagatcatttctatatgctatctagaaatactgggttttggtaagcaaaataataaaagaaacaaagttgttgggggaaggatataacccaattaagagaactattttaaagtcctcaaaataacttatttatggtgaagcgcataaaaagttaaaacattagccatctgttcattaaaggcatttctctttttgacatttactgaggagtgttttattagccttaagtaatatttaaaagtgggaaaatcgtatttcttgaaaaatatattcagaagtttagacttttaactagtctaattgagaccagtctttctggacttttgtctatatttgtaatattttggatttgtcggaggtgttaaaatggtgacagaaatgaacaggatcctaaaagtcagctactttaaatatcattttcttatagctcccactatactgattctaagattgaaaaatgtggagaaccttattgtatctgaattcagcgtaaacaagcactcagaaaggctaattttttaaaagtagtccagcagttcccctagtgggtcccagggctgtgttaatatagatataacaaagaaaatagatagaaccaccagggaaggaaatcacatttttacaatcgataaggtagataaattacaaggactaaagataaggaaaagaggagttaagacattaacttgtttaagaagaaaaaaaaagtagcgtttttgaagtgccctttaaaaatcccagtactttcaatgatgcatactactgtggaatgtggcagtagggaggttgagatgaggccatttcatctcataactgtctggccctgcacattattggaatcataattatgttcagtaatgtccctgagttcacagctctctatcctttttacccatttagagaattcatatcctgaagctgatagacattgtcacctgctggagtttgaatctattaatacatgaaagactccttgcacatctttcagccaagctctacttcctgtgtttggcgtttactgacaccttgctgtctccctctggtcatggcaccctttctgctgctcttcctggtatagccggttctgttgtagttaagttttaaactaacctaaagttttgttcaggcacagtggctcatgcctgtaatcccagcactttgggaggctgaggcaagaggatcacctgagcccacaagttcaagaccagtaagaccccatctctcctcctccaaaaaaattagttgggcatggtggacggtggcatgtgcctgtagttccagctactcaggaggctgaggcaggaggatcacttgacaccaggagttcgaggctgcagttaaccatgattatgccattgccctgtagcctgggtgatcgagcgagactctgtttcaaaaaacataaatgtatttttaaatgaataattaagctgcctcttcccttcaccccagccccctttcccagtgatgaccattaccttatgtttttatttcctctcagaaaatgtttgagtcatagatccgcatattaataataaattttaagaccggcatgatggctcacgcctgtaatcccagcactttggaaggccaaggtggagagatggcctgagctcaggaatttgagaccagcctgggcaacatggtgaaaccccttctctactaaaacattaaaaattagccaggcatggtggcgggtggctgtagtcccagctacctgggaggctgaggcacaagaattgcttgaacctatgaggcggaagttgcagtgagccaagatcccgccactgcactctagcctgggtgacaggcgagactccatctcaaaaaataaaaattaggccaggcgcagtggatcaccaggtcaggagttcaaggccagcctgaccaatatcgtgaaaccctgtctctactaaaagtacaaaaattagcttggtgtggtggtgcgtgcctgtagtcccagctactcgggaggctgaggcagaagaattgcttgaacctgggagacagaggttgcagtgaaccgagattgtgccactgcactccagcctgggcaacagagcgagactccatctcaaaagaaatttaaaaataaaattaaattaaattaaaattaaaaaaaaaaacaataataatcaattttaaaatttacccaaatgttgtgatgatgtttttagaatccctatgttttagagatatatactaatataaaatactaatctatgtcatagtataacatatataatacagtataacacatactgatggaaacaatattgtgtatggtattttctccaaaataattgggattagaaggataaaaaaagaaacaaaattgcccataagctgctgattgttaaagctgcattatgggtacgtgcgggttcattattctattctctaattttgtatgtttaaaatttgccacaataaatagttaaaaccaggaaaaagttactccaattagattgttttatgaatgctttgctttttttcacgtaagaacgtattttgtagatcagtccatttttctacgtcagtctttttaagtattatgtatactattccactatatacaagttccacgatttatttagcaagttccctgctgatgagtatttaggtatttctgtccatagccccttggcttattgagtgctggtgtcagtaggggcctgtggagagggcaaagtttgtgcactccagtctacctactgggactcttgaaatgtacacgttaactccctctttccaggaagactttcaggggcccctctgctgtgacacttaccactcatttgctcagtgtcctgacattacttgctgttgggtttccacagaacatcttacagtgcttggcctgtgatgagaactggattagagttttttttacatgttaagaagatatgcttagttttctctctgaaagttggttttgacaggatgatggtggcccttgataagttgctgaggataggtatttcaaatcaaatatgctcgaaaaaatgtattagctgtgaccgaaaagcaatgagattgtgtttttaaaaaatatactagaagccaaacctatgccagccttcaaaatgttcacttgggatctctgcacctgcttcagcatgttgcactgtctcaatattaatagtcataattttgggagtcctcttttggaattgcctcagagtctgctgtggatccccatgaaatgaaatcactttgctttaatcacacttcaggtttcaggtaatacatagattggtgaatgaaataaaataagcagttttttagcattgtatttcttttgatttcatccttcctgtgaaacatactgttagtgtttaaaataatcatgatcagtctaaattaaacattgtatgtttcacttgtaatgataaagttagtgtttattatgtatgttttatatagtatatacatgtgtatgtgtatatatataaaataaacacaaataccaacagttgaaagaaaagagaaaacgagagcaaatatcttgtgacatcttagtatgccatgccatagtacatgtataaaaagggtatagttgtctgttgacttgctgtgtgttaaatacatagtcatcacagtggtgtgtgttttatgactaaatcatgatgcaattatctttggatcgtagactgcactttggggagcctagaaaaatagactcatttctacctcaggggcatcctttccaagttagaatgctatttatacaataaaatgcaatggctaacctagagactgactactttctattttcctttactactgaatcgccccctccagctgtttagtaacttctttttgtacaatcaatcatgtatacaatatgtggctgcccttttcctcctctgtagtctgtcctttaagaaaacaagaggctatttgaaaaaggaaaagcatctgtgaaatgactattttcataggagtttagaaaagttaaagagtgccttggccctgattctaaaagaaaggttgtatcttgctactgcaaagtgagaactttgaatctagttagggtttttttcaaagatacagttccctcagtggccccaggtagtaagcatgatggctcagataaataaatacctgttggtcacactgtatatagtctctctgttaatcacttagtgtttcatgtttgctttatgaaaacgttgaaaagatgcatcattttgaaccttcctgggtacaggtttcagtggtacccacatgtaattttatgtttagtttgggatttaataaaattgaagacacagagtatgaaactagatggatcttgtgtagtaactgtttcaaaatcagattcattgctaaagtgtacaaaagcagaattatacacagagaaaaccaagtcccaagtctagatgggtgtggcaatgcgcctcatgatccattaacttatcattaagagcataggctctagagtgagcttcctgagttcaaatcccagctctgctatatctaggcagttctcatagcctctcatctataaaatggggataagagtgttttggcatagacctgctgtgaagattaagcgagagcatcttcaaagagcttttaggagcagtatctggcatatagcaagagctcaatgaatattcatgattattatattagagacagtatcagtacagtggtgtgttataaaagtttgcttttctcttaattatgaattacctatattttggactctgagttacgactttctggaccttaagagcaagggttggttcatcttcatctttgtattttcagtgcctggaatatggcaagtgagcttaataaataaataatgacacactgaatgaaaatgggagccatctgcatatcccaaaatgaactttatgtgttgaataagacactcgatgttatatcttaatcaatgcctggttttggcattggctacatattttataacttcattgatcctgttgcctcacagtaggtgaagctgaataacccgagttactggggaaggcacactgagattctgtgggtttacaatgtgccaaaccctgttggtggtactttctcactctcaggtggccatgctgagacttgaacctaggttttccgacacagctccagtgttttaccacagaggctaaatatatcagatttcatctggttcaactggaggcatatagtagtatcttgagaatccggaaagtggaaaattatattttaggggatctttccattcctctaagcaactgaggtttagatcaaatgccacttccactatgaaacctttctagaccctccgagctgtataaagtccttataaagtcctttctctgtattcccaaagaaatgtttctaagtttctgctatcatgtttatcttagtggctttcggcattactcaaaagtttccatttagacttagagctccatgaaagcagcagccacgtcttcattatgtgtgtatatgaacttcttcacacggtatgtggcacatagtaaaaggctccataaagttactcatttgctggttggatggatagattcacgatcattaatgcatgctctctgatgtttgctacatcaatatgcttgtagaaatagaaaaagtaataacaatttgtataaaatagttgtttagaacactcagatagggtgattcttatttatgttctaggctcctggaaagaatgaagaattggggccactaattcagtcttccacaaacattcttttattctattcgagtctataggtctatatgttgggagggccagtgccaaggaaaagggccattttggtttcagttgacctcacgctttgccttggattgagattgatccatggttgtcatagattgttttctgttgctataacgaaatacctgagactggataatttataatgaacagaaatatatttaggtcacagttctggaggctgggaagtccaagagcataacaccagcatctagtgagtgccgtttgctgcagaataacatggcgaggatatcacatggccagagggaaagagaatgcatgtcagcttaggtctctcttcctcttctcataaagacaccagtcttactgtgggagccctgcccagatgaccttatctaatcgcagttacctcccaaaggccccacttccaatcaacacataaatttggggattaagtttccaacaacacatgaaatatgggggacacatttagactatagcagtgttgctttagagtttgaatcctttgatgtcttaaattgattggtttccagtcttgaggcaaagtggaactcttgcatagttgatgagagcgagagtcacaaacctaattatgtcaacacaactggcagcacctcttatttctggctttagctagcttaagtgatagagctttggataagtctgtatttttcacacttttagaaacctcttctaactgttcattttagctcagatggcttttggttaattttaactgtaaatatttttcccccttttttcttacaaatactaggcccatggctgggcgcggtggctcacacctgtaatcccagcactttcggaggccgaggaggttggatcacctgagctcaggagtttgagaccaccctggccaacatggcaaaaccccgtttctactaaaaatacaaaacaattagcaggctgtggtgacacgtgcctataatcccatttacttgggaggctgaggcaagagaatcgcttgaacccaggaggtggaggttgcagtgagccgagatcacaccattacactccagcctggacaacacagcgagactccatctcaaaaaaaataaaaaaataaaaaataaataaataaatccctaggcccagtcttcagctggtttgccctgctgcattaattttaatcttttaaggaccttgggtgactcactagccttcctgttatgtcttctcagttgagagttccataatgcgacaggaagaattcaagaaggcagatgtgagatgtttccaaaatagtttaggcatgctgtgttctggggtagatagtgtgttttccgagtaagattttagcacttcaagggtaaaatgcataaaagtattttttattttacccccctgaacttaagaaagaaaagagtttgttcagtttgtgtttttggaaagttctatgcaaaaatatatgttccagtgaataaagtagttttgggttgccttccatcataaggtatcatacgaggtacttcaggggacggaaaggtgattacaatgagatgagtggcagccagagtctaacaatggttaatgagcacaagacagcagatgtattcaaggtggaatcaagggaggcctgtgagaggcttgagtgctaagaaaaggaagaaacgtcagtcagttgggatgtggatgttagggcacttgaagttatctgtgctggagattgaatagattttcagtgatggagatctggggagagcattgtccctcagagctgttgaaaagtaaaaaatctttctttttcaaaaattaaccactaaagaagtttatgattgttttctctctctttacttcacggatattttgaaaatacagattttagttcttagtttggcaagttgtttagcttctggggagagggtcctgtggacagtggcagcttaggaagcaactggaggtaggcctctaggagtcctgtgtgaggcttctcagaagtgccaggtgatgctctcataccttggaggtgggcatgcagcccccaagattgtgaaggagtggctcagtgggatcagagagacaaaaacactactggacactttcagaaattttctggtcaaatttcatcatgagctatttgcccagattagttttcttcaccaaaaacaaaaacaagcaaacaaaaaaaaaacccttaagttggccaggcgctgtggctcatgcctgtaatgccagcactttgggagaccaaggcaggcagatcacgagatcaagagattgagacgatcctggccaacatggtgaaaccctgtctctactaaaaatacaaaattagttgggcgtggtggcacgtgcctgtagtcccagctactcgggaggctgaggcaggagaatcacttgaaccgggaggctgaggttgcagtgagctgagattggcccactgcattccagcctgggcaatagagtgagactccatgtcaaaacaaacaaaacccttaagttaataaataataaaagaggctacagaaatattcagatagcaaactcgaacagctctacatccatggggaattgaaatgcatctgtaactttaccatgatttttcactgagcagtattggtcatataagttaacaatagttcaagaatttgtgaatttgttcatcatgactttgttgatgttcattagttcattcattctttcatttgttacatgtacacatgccagtctttttttttttttttttttttttgagatggggtctcgctgtgtcgcccaggctggagtgcagtggcacgatctcagctcactgcaaggtccgcctcccaggttcacgccattctcctgcctcagcctcccgagtagctaggactacagacacccgccaccacgcccagctaatttttttgtatttttagtggagatggggtttcaccatgttaggcaggatggtctcgatctcctgacctcatgatccacccgccttgcccaaagtgctgggattacaggcgtgaaccatcgtgcccggccacatgccagtcatttttaaaagtcaactctgtgtgctgagctaggtgcctgagacatagaaatagattaaaaccagtctgtgatgtcacatagctcacataaagtttcctgtctctgtgaagccctcaccatacgcagagtgcctgacaaaatgtgtctttgtgttctttgctccattttgcccatcatacctcagtaagtaagaaaagataaagcccactccaaaccttggatagcctaagcaaagaagaggaggagatgttaagatgttttgttggtttcttacggctggtgtaacaaattatcacacacttggtggcttaaaacaatagaaatttgtggccgggcgcagtggctcacacctgtaatcccagcagtttgggaggccgaggtgggtagaccatttgaggtcaggagttcgagaccagtctggccaacatggtgaaaccctgtgtctactgaaaataaaaattaaaaaaaaaaaattagtaataaacaatagaaatttgttcacccatcattctggaggctagaaatccaaaatcaggctgggcgtggtggctcacacctgtaatcccaacattttgggaggccaaggtgggcggatcacctgaggtcaggagttcaagaccagcctggccaacatggtgaaaccctgtctctactaaaaatacaaaaattagctggacatggtggcaggtgcctgtaattccagctactcaggaggctgaggcaggagaattgcttgaccccaggagacggaggttgcagtgagccgggatcatgccactgcactccagcctgagcaacagagcgagactctgtctcaaaagaaaaatccaaaatcgaaatgtcatcagggtctcgctccctttgaaggctttagggtagaatccttccttgcctcttccaagcttctggtggttcccagaaatgtgtgacattccttggcttgtagctgtacctctgttttcacatggccttcttatagggacacaagtcatttgatttgggacctaccctaacctagtatgacttcacctcaatttaattaattatatctacaaagactgtttcccaataagatgatacatgctgaggttctgggtggacatgaattttcgtgggtatatggttcaacccagtacagacatcttacagataattccttaatagatgcaacatggaggagatgtgaaagaatgtttgcgagaattatattcaaaattttcaggaaggaaagctcatagttgcaggtcttgtgagactttgagtggaatatactgtaagggacttctagatagtttggggttacctttgttcaaagtcttcattgtaaagatgaggaaattttggtgtggactgatgaatccgaaactacaacctcaactgagattgggaataagtgtggaaatggtagaaaaacatgataaaaataaaagataaaaacatgataaagacatggcaaagcttaatatttagtagtatggctcagttctggagggtggcatagttgaggggtgctggcatatggaaatggctttattcctttgatcaaagcttagaaacagacagacaagactatcagtaatagccatgtttttcttatgttagttcaagagacatttatttcttaggaaacataggattttattaaggagctatgcagaatataaaataaaaggatatgactctgactttagggcactacaaaggcaatatgatgccataaagcatcagagatcacaaacagcaatactgaagaacgcacaaactcacaggcagattttgttccatggacagtgttacagaaaatgcttaattagatgccagtgcttagaaattgagatattttacataaaaatagaggacctctcattcctcttgtaaattcagaaatctcacaatgctgagctcaaatgccaaagagacaacagtcagcagcagcccctttagatgggtcctgtcccctccagctcaaggcattgagcttgcagccccctgctcccactatcaatggacttagccattgtatacacatggaactgttacggtagaagaaccaggctaatgttgatcttgcctgttacagctgcatacaagtgtgatgccatagtagcagcatccttggatctacagtcttcttttaatcatagtcatcctagtctcagtcccttgccttctggtagaatcaaagtgtgacatgaactgttaagcaaaacgtgcttgaaatttctaaagacatctctagatgacttctcagagtcttccatctgttaatctggttaagaagagggaaaacattagcttttcaaaacctaggatgtgggtggttcataaattttgtgctcaagtctgactcagttaatatgcccagtttgctttcataaatgtgggggtagttaccagttacccttgtaatttatttattgtgtttcctcattagaacccttgggtgcaaaacagtgagataaaagcttcatattcaaacagatttgactggaaaaatcaaataatttgactattagaaaaccatatatggttagcattccatgtggaatggtcagaaagtgagagaatgagatgaccccagccattggtgttggtacctaagaggtgagctgatgcttattgtgtgtaagcttttgtctttttctttttctttttctttttttttttttgaggcggagtctcactctgtcacccaggctggagtgcagtggcgcgatttcggctcactgcaagctctgcctcccgggttcaagcgattcttctgcctcagcctccccagtagctggaattacaggcacataccaccatgcccggctaatttctgtatttttagtagaggcagagtttcaccaggttggccaggctggtcttgaactcccgaccgtaggtgatccgcctgccttggcctcccaaagtgctgggattacaggcgtgagccaccacgcccagcctgtctttttcttgagcttttcatagacttactcttgaatataattggatttcatcctcacaaaaattcatccttagtataattagatgttgttagttgatatttttctccctgcgtgttacttgaagaattcttcatatagaactacactgaattggtatatctgggatatcataaaggtagatctttatcctataaatggcttgttggagaagctggttttgttgtgttgtttattaccagaacatgttttctcatatacatgatggtgtatgtgatggttaaggtatacaaggtggtttgcccatgaaagtctatttaatctctaacagacatgaagagtgttattaatagaacctttccccaaaatgttgtaggggaaaatgtcccagttccatgtggaattgtcagaaagtgagaatggagatgactccaactccatgccattgggaaggggctgatgggaagtgtaccaaaggaagttcaagaactgatggaggcctctagggatacttctcagtaatggactagctctgcagttcctgctttgctttacagtgggggacctctgaccagtgtttccattcatcccttgctctctgtggacaaagaagctattccacagcctgtgctcttccctttctccagaacaagcctcagcctcttccaggatttcaaagtggctttcgtcttttagttgatgtcctatctctctctctgtctccttttttttttaactttgtgtgcttggaacaagggccccaagttagagaatggactctatgcagaacacatcagagagaagccgtttcatctcaggctcattatatctttaatggaagattattggattggtaataatctggaatgtgatatgttaaccttaaaccactcacagagttccttgcagtccatgaatgtctcttatatgctaggaactgagtttagtgctctggacgatttcaaaattgagggacaatatttccatcagggaactcatgggttccttcttcaagattcaactctgatgacatttaccactttctgtggtttagggtcagacatcctgcttgttctagctccatcacttgcttaacctgtgagctccaggttccttaatctctaaaatgagaatagtaatagtagtaatctgctttataagattgtcacatatagcccttggtacaacagctggaccacagaaagcattttttgaaatgttagctgtcactagaattactgccttatttctcctaggagaaggaaagtttcccaggatctaggccagtttgactttgccctttttaaatatttatttatttatttatttatttagagacagggtctcactctgttgcccaggctggtgtgcagtggcgtaatcacggttcactgcagcctcagcctccctggactcaggtgatccccctacctcagccttctgagtaactgtgactacgggtgcacaccaccacacctggctaatttatacacacacacacacacacacacacacacacacacacatacacacatatatatacatatacatacacacacacacacgtttgttttttttttgtaaatacggggttttaccatgttgtccaggctgttctcaaactcctgggctcaacggcctctcaaagtgctaggattatagatgtgaaccactgttccctgccttttttttgttaagccccagaaataagttcttacaataggtatttatgtttgaatgattagcacgacaattaaacaattatttatactagtggtagaacaaattcaaggtaatagcgtacctccaagaagttcacaatagttagggagatgcataaatcctttgcttctcaaactatgcaggagtatgcccttgggatcttactgaaatgcagacactgattcagtaggtctgggttgggacctgagattctgcattttaaaaattctaattttcagttgtagaaatttgcattttaaataaactctcaggtgatattgatacccctgttgcttagacacttgagtggtgaaactgaactgtaagctgcagaaagaaggaatccaatctttgttccctgccatatccttagtgcctagaataaacagtgcccaggacattcttcttatttttactgatttacttttgagacaggttgtctgtcactctttgcccaggctagagtccagtggtgcagtcacagctcactgcagcctcaacctactgggctcaaatggtcctcccacttcatttcctgagtagctgggaccacaggtacataccaccagacctggctgttttttaatttttaatttgtagagacagggtctccctatattgcccaggctggtttcgaactcctgagctcaagcaatcctcctgtctcagcctcccagagtactgggatacaggtgtgatgcagagtagtaggatactgtatctcaggatacctggctcctgagacattccggtgttcaataaatattgtggaataaatataattacctcaaaatatagtagtccttgttcacagtttcactttctgtggcttcagttacctgcaatacaccgaggttggaaaaaattccatggaaaattctagaaataaactataagttttaagctgcacaccgttctcggtagcgcaataaaatcttgtgccatcctgcttcatcccgcccaggatgtgagtcattgctttgtcctgcacacccatcctgcctatgaaaccgacctgtgagttgcttagtagccgtctgtctctgtttccagatcagctgttgtagcattgcagtgcttgtgctcaagtcacccttattttacttaataatgacccaaagcacaagaggagtgacgctggcaatttagatatgccaaagaaaagctgtaaagtgatgttgttttatgtatttgaaaatctctttaatgtacggcttcatcaaaggcagctgaatttgcttatctgcctttatccttagtgtatctcagtaaatttggttttggttgaagtaggtaaagaaaaccctgctggcctaatacagatacataggttaaaaagggacgactattttaatagttgttcaggcaattgtggatattcttttttgatgttacaccaaaattccataatttctaatttcttaaagattagttttaatgtggaatctgaaatgataataataagcttgtttgcactcttatattaaaatctattggtctgtcatacattttgagtggatatttatccatacataattttataacatcatgcgttggttatttggaacatattggttcagtgagttatgaagatcttccaaatgttgaaacatttcattatgcaatatgaaaatattacatctgtgaatcttaaccatctcattagaaaagtcttccattattgggaagctgtcaagctcactgtgatagatacaagttttccaaaattctgatttttgcttaaaagcttgcatttgatcattgccaacaaatagtgtcagttgttttccttgaagtgacaggtccacctcatttatttttgtgaaaatgtctacccaatacccaaatttgaataaccatagtttgtctgtcagttgttctttcacgtaaatgaggtattgtgtggagaagcagctagttcaacttgcaactcaatcacgtgtacttttccttgaaatgacagccctacttcagtatgccatggaagcactttatgtgtaccttcattaaaaacataatactttggggttgagatttaataaaattaataatttttaccgcttcaaggacgttattacattggggaacacaataaccactaatatagcttatgctactgtcttgcttcatgctgagatgccagcaatgttatcatttattttttgtgccctatcacttaaatgtcaacacagtgaaaagggttgtaaataacatctgagtgttatgaaaatagcttcaatctctgagactcctcgaagttccctttgggaacttctgctctaggtatgaggatcagtgctcttagcaatttggttggaaagaagagtctttgaagaatgataactgtgagagagaaagtcaaataggtaggtagaggccagagaatgtgctaatgtacttaactgaccttgcttttgttaatgaaacatgagtgatgcttatgagaaaaggaatgccctttgtaaggtagagtttaaagaaagtatatctgatattggtggctagaatatgtttgtggggtaaagtgttaatgttgctgaaacaccagaggtttggtctaggacctgctgcttgacgcacagaaagccatttaatgagatgagtattgccaagtaagaaggctttaatcgggtgctgcagctgaggagatgggaaatcagtctcaaatgcatctccccgacacactaaacttaggggtttatatagtagggaagaaatgtaaccacatgtgggaaaacaggaattagggaggtgtaaggaagaggagctggtcaacaggaagcaggtggttggataggcaatcatgataggtgagggtgaggggtctggcatctcattgtccatatgcagcggtcatgtaagtttcagctccttcatgctatctgggaggcttgatggttgagttcctgaaaaaggaactcagctaagacaaaagtaactttttcaagttttaagactgggaggatcaatttctatgtttattcaaagaaaccataaatatcagcactgtgggacaattgggtcagtttcaaaaggaggcaggtgattatgagagttttacagtaatttgtttagattatgaggactggacaagattagtagttttaaaaatagagtggaagtagaggaaaggatgaatctctagaatttagtgattgattggatgtgggtggagagggagtgagtagaatcaaatatgtcagattttcaagttgaagactaagaaaatgttagttttcagaaatagtagagatgggaggaggagctaattgttggagaaagatgatgtgtttgattttagacatgtcagttgagatgatgtgggaataatagccaaggactgacatcctcaagatagagttgtcgtttttagggagaagtcagagagattcagactttgtcacctggacaccaaatttctgcaccctgtctgggactcgtgtatgtcctttattttaaccaagattcagaggggtgatcagatgaggatggggtggaaacatgggtggcttaaacagattgggtgttattagagaactgccttaaaaaacaaaacaaacaaacaaaaacagtgaaatacttataatggtttaaccagtcttcgtttttcctcatcttaaatattaaattcaacttagccatagttctagaaaaatggctagatatctcattcaccaatgaactctcaaatacagtgatgacacatcccatttctctcatttctagttctctacagtaaagtgaaggggccacttgtagaaagacaagcatgcttgagcactcacaaactgatgttcagaatctctgccaagtgagacactcaacagatgtaacctcagtgaaataactgtggccaacaatctagctaagaggctctaaaaccaggcattaaaagcagatccatggcggggcacggtggctcacatctgtaatcccagtatgttgggaggcttaggcaggaggatctcttgaggccaggagttcaacaccagcctgggcaacatagtgagtctctgtttctgttaaaaaaatgtttaagggctggcacggtggctcacacctgtaatccccagtactttgggagggtgaggcaggaggattacttaagtctaggatttcaagaccagcctgggcaacatggcaagaccctgtctctgtaaaattaaaaaattagccagacatagtggcacatgctggcgtcagctacgtaggaggctgaggtaggaggatttaactcaggaagtcgaggctgtagtgagctgtgtttgtgccactgcactgcagcctgggcaacaaagtgagtctgtttcaaaaaaaaaaaaaaattttttttttttaaacattagccagatatagtggcacatacctgtggtcccagctactcaggatgctaaggccagaagatcgcttgaccctggcatttgaaactatgatggtgccactacactccagcctgagcaacagagcaagactctgtctcaaaaaaaagatccatttctgacggatggacttattaatcaacttctcgagaaatactaaagccaaaataagaaacactggagccaaaataagaatctattaatttgttatgagaattaccactctcctaggtgttagatttcttggtactgcatgttcagtgcacattctcaatgccagtgtattattttccaaatagaaataattactcaactgcataggaaacccaagcataagcttgtttgcttggggaacatggtttcagccaaaggggtgttggatgaatcaaatatttaaatggtctcaggctgggatagtctgaggcgcgctgtccttctttcccttgagatgatgctacttgggacctagaatccttgaagtgcattgcctaagagtccctcttcagagaaaagggaatgattgcttttttttttaaggtacttacatttttgatcaatacaatctttcttaagatacagtaatattttccttctttatttctttccctccttccctccctccctccttctctctctccttccttcctttttcctttcttcttttcttttctttttttttttttccggagtcttgctctgtcgccccaggctggagtgtagtggcacaatcttgactcactgctacctccgcctcccaggttcaagcgattctcctccctcagcttcccgagtagctgggactataggcatgtgccaccacgcctggctaatattttgtatttttagtagagatggggtttcaccatgttagccaggatggtgtcaatctcttgacctcatgatcctgcccacctcaccctcccaaagtgctgggattacaggcatgagtcactgcacccggcccaagatacagtaatattttctactgagttaaagataagtcatactatgtttgggagacatcttatctcactcttactccatttcttggttttgatccattgactgattcaactatcatactttaacttcaagagcaatcttattttcttcatttgcaagtcttggagaaaatctcgttgcagctagtaagtttggcctgtagtctgtctgcatcagaactcctaggtgtttcttttttttttttttgagatgagtcttgctctgttgcccaggctggagtgcagtggcgcgatctcggctcactgcaagctccacctcccaggttcacgccattctccttcctcagcctcccgagtagctgggactacaggcgcccgctaccgtgcccggctaattttttgtaatttttagtagagacggggcttcaccattcacaggatggtcttgatcttctgaccttgtgatctgcctgccttggcctcccaaagtgctgggattacaggtgtgagctaccgcgcccagcctctcctaggtgtttctttaaatgtagatacctgggccctacctgtgccttacagactcagacgcaggtagtgggtctcaggaacctgcattttaacttcctcctctatgcatcatttgagaagcatggctcagattctgacacaggaactgctttagttagggccttctgttgtgtttgaagtgctgtgttcctattataatggatactgatctggctaacatttaacaagaatcacagccttaatgaaaaacgtggaaaacatttattttcttttaaaaaataatattttcttttgtttttgatagaatcaagtagaagtggccaggcatgatggcttatgctgtaatcccagcactttgggaggttgaggcaggaggattgcttgaggccaggagtttgagaccagcctgggcaacataatgagacttcatctctataaaaaataaacaaaaaattagctgggtatgatggcacgtgcctgtagtcccagctactcaggaagctgaggtgggaggatctccttgagccccggaggtcaaggctgcagtgagccaagatcacaccactgcacttcagcctgggagacaaagggtaaccctgtctcaaaaaacatttttgttaaaaaaaaaaaaaaaaaaaaaaaagagagaagagttcttaattgctcctgtgctccagaaattaaactactggaaatctcttctcttgttcttgtccctaaaatggaatttgtgccataagctttactgcactatgaacactgaatatttaaatcccagctgtgctattactaaatggatgattgtggctgagtcacttaacaccatacgtttcctcctctgtcaaatagggttaataatagtctctgccttgtggggtggttgtgatgattaactgaaacaagacatgtggggcacagaacgtagtgattgccatgtagtaagggctcagcaaaaattggattttataaatattctggtatggaaaattaattctcccactgaaggaaaagcacagagagagagtaaaagagggactacgattgtgtacacaaacagaaaataacttcagataagcagcagagtagactagaacaagtaggcaggaagacagtgtttcacaacgtagagatcctgcacatggcaggccggcctatctccatccggccctgtggtttggcttgttcgtcattgcccatgagcctcggtcttacttgaaggggtgaggaaggtgatgggtcctgagggtggtgcagctccctggcctggacatcgggggtcggtcttctgctcgtgatactcctgctcgctggcttcatacttcccgcgttacttccaggggttaccagcgtttccatccagtcatttcacacacctcattgaacaattttccaagtgttggtttgctctcttccttactacatattaatgaggtgtccaagactgctgttcagcacgtatctaaaatgttgtttaactacatcagaaggtaaatctatagctgctgaagcgaactaaaaagctgtgtcaatctggtgcagtggctcacacctgtaatcccagtgctttgggaggctgaggtgggaggatagtttgaggctaggagtttgagaccagcatgggcaacatagaaagacccccccccatctctaccaaaaataaataaataaataaaattagctaagtgtagtgccgtgcacctttagtaccagctactcgggaggctgaggcagaggatgtcacttgggcccaggtggtcaaggctataattatgccactggcttccagcttgtgcaacagagtgagaccctgtctcttaaaaacaagcaacaaacaaaaaaggcagctgcattgataatcagtcaggtaaagcatcgtcattttcactttcaaaaagttgttctgagtattaagtgttagcaaagatgcttttctctctgtagtatttttagccttaacagttttcactcttaatttcagtgtgagtgtggtgtgtgtggtgtctgtgcgtgagtgtgagagagagagatggggaggaggagggagagtgagagcagtgttctgattgtagaacaccctcacaggtagaattgttataactttctaattgcagaccactctcatagaagattcttaaggaaacctcagcccaccttctgaagggatgagacgagtagcatcttcaagtgaaatgccctctggggtctgaaggttctaaaaaaaatcctagaaaaccaaggaagatggtgaattatggaagaactacccagatgattttcaaagctgtaaattaacaagtgtgtctgttttaggaggagggggtgaaaagtctagggtgtgtgtgtgtgtttttctttcttcttttctctgttcacttgccaaaaacaaacaaaaatgacctcacttcagacacagggataaaagcaggaggaaattgctatagttagaacactataggttttttttccccctgtactttttggatacatatttttaaaaaaataaataggatcacttactctggcctagcacaatttcatctaaagtgttttgaaagttatagtcttaattttagggacagaataggttatcgtaaggggtgtgagggtttttaaatgcaaggcattttccaggggacttttaaaaatcaataccaggaagcaaaataaaaaatttaaaaatcaaaacccagcaaggcacggtggctcacacctgtaatcctagcactttgggaggccaaggcaggcagatttcttgagcccaggagttcgagaccagcctgggcaaaatggtgagatctcatttctacaaaaaaaaaaaaaaaaaaaaaagcaaaacacacacacacacaacaaaattagccatgcgtagtggcacacatctgtagttccagctactcaggaggctgagacgaaagttgcagtgagccaagattgcaccactgccctgcaacctgggcaacagagtgaaaccttgcctccaaaaaaaaaaaaaatgaaactcagtccaaaatgaccagaaatctatgtagttagcagagtaaatcttacccctccctgcccccaacccccattcagggtttccttcctttctttttcctccatttgcctccatagagcatatcaacccaatttacaccttcatgagctgtaacctagagtctttgctctgcttggcagaagaggaagagaagatgccacatacagtttggagtaggatgatgacacagtttttaaaatgatggatgcagtttggtatgaaatgaatcactgtttaatctgtgttactttgctcatatggacacacttggactcagcacccacttcctgtgcaatggcatatttggtctgggttacgttggggtgaagcatttcccccatgagcttgccacaactccatcaagaagccttctggaagtgcgaaaggtttggaatggtaggctgtggaaatcctgagctgtttgctgagtttctccctgccttcctccctttctcctttcttgtgtgtgtgaaaagcggttatggcacagtgtctttcatgagaaatgattggcttgggatgaatctcaccactcctttctggcacttttgcaaaaaagaacactttttttcacggtagacaccggatacaactggaatattcttctgatgtccaacaacagctggagagagaaagagagagagagacaagaggggaggggagaaagagagagggagagagaagaaagagagaaagcctatagcacctggtattctcatggtggtctcccatccaagttctaactagacctgaccctgcttagcttcccacatcagatgagatctggcaagttcagggttttatggccatagaccccttccactttaaagctgagtaattaatattccactgtctgtatataccacgttttgcttattcagtcatctatggatggacacttgggtggtttccacattgtatcactcccgcttttgagaacccttgtggagcagcaacccaggtatcatttaataaaaggctcctctctataagttttagcgttttatatgtactctttagttttcttcttttctttcccagttgagcagacagtttattgaagatctctttgaggcccagagttgcttttcctgaatacccagtgattgttatcttgctgccattggattaggaagtctggtttgcaatatttaatctatgaatatgttgtctgcgacactgcccctaaacaaacacattccccttccgacgaggctcggatgacacagagatcagcttaaagcttgggacagcgagacctggactcagtagggggctgtatcagtctgtgcagtgcatgcacctctgcacatcatgataaattgtttattggagtacagtagagaataaataaccaaacaagcaaattaacaaagcaaataggtagctagtttggaaaactggccacatctgggatggatttgggaaaaaaaaaatgtagtttctccttctactcaagggaaattaaaaactcttgcattttattgatttcctctaagctcatctgcacattgtttttacaaaagctaagtggtgacataaagcccataattttgggaggcatagatttttagatgcagagattttggttttgctcccaggaaatgaacgttttctgcagaggaggcatctacctctggaagccatttctcatgttcaatctagtgtgatcagtgaccagttgagggggaaaacgattctctctgagctttgcttggcttttccttttgccaccaagccactgaaaagtataggaagaggcaaggcattgcaacatgggatagctgcctcctatacgagactgttaatactgtgtatcagtaagtgaggtggaagagggagttaggttatcagtttgtttctcacccactttatgaacattgcaaattctagaaaaaaagtactctggggccaggcgcagtggctcacacctgtaatcctcactcttgggagaccaaggcgggtggatcacgtgaagtcaggagttcaagaccagcctggccaacatggtgaaaccctcgtctctactaaaaaattatctgagtgcggtggtgcataccagtaatcccagctacttgggaggctgaggcaggagaattgcttgaacccgggaagcggaggctgcagtgagccaagatcatgccactgcactccagcctgggtgacagagtgagtgagactctgtctcaaaaaaaaaaaagactttggattgcaaatgaaaactcattatttatttatcattcgtcacagtaatattaattatatttataccgcatagtagcccctggcttttttttttttttgagacagtcttttttttttttttttttgagacggagtctcgctctgtcgcccaggctggagtgcagtggcacgatcttggctcacttcaatctccgcctcctgggttcaagtgattctcctgcctcagcctcccgagtagctgggattacaggcacccaccaccatgcctggctaatttttttgtatttttagtaaagacaaggtttcaccattttggccagactggtctcgaactcctgaccttaggtgatccgcctgcctccacctcccaaagtgctgggattacagggcatgagccaccattcctggcctagcccctggcattttaaaacaaaacagtgggttgttgggaagtagtaaactttaattaacttgaattcaagtacatatgcatcaaaataaagacttccagcacaagtgcaatgggaataacacatttgggttaagtctggatctggtgctgttgggattgtgtgtggctttgatatgactttggaattcttgtgacagaattggctttgagttatccttggggcatagtcacttagtcatggtgaccatttgtttctcaccatatgaacagtctgatcatttccattatctcatttagttcacaaaataatcctgcttgtaattattcgtatatttcagacaaggacagcgaggttttgagagatcaattttatctggtgaacactaatgtttgaatataaaaatctcattttaatatggtggaagaccatgaaatcttagcattcgagggaccttaacttttatttacccttctctcctttctaattcccttctgctccattctagagaggtgaccattcaacacatgcttaggatgaatctgctagattcttagagagaggcttaatagctcacagaatcatttatagtttaaaagagttctagaaacagggcactcacaaacatgatggtacatatctacttaccgaagctcttctgccttttccattttgtggccatcaaccagaaccctcatgagaattctcacgtcctagttcggagagttagacacacagagactgtgtgcagtccttcattttgcagaaaagatgactatctaattttaaatacatttcaaagagttagccattggattgaaaggtcaaatctaaaaaaaaatgaaatatgaaatagaccatcttatcctttaggcacaaatcaatacttaaagagaacgaggcacattaaaatgaagaataggttcagtataatttgtaatcaaaccgtcaaaccttcccgctgatgattgtgtaactttacattttaaaaattgctaaactgagaaagaaaacaacttctgccaaatgctgaagtatgttttgtgcctgttaagttttaaataaatcttttaaactttggcaggaaatcagatatctgagtaataaaagaaatttattattattttgatgatatgcttagtatcatattgtttaactttgaaccctttcttttaaagtgagtaaaatggcaagctgtggaaaagagttaaaatttttacctactacttctcttaaggataatagtaatttcttaagagacactaatttaattttcctcctatactgtgcaaaaagaaatgtcctggtccttttaactgatatgatttttggctttgctttaaattattgattacattttaaaaggggagggactttctgatgagaatagcactctctttaatagcctttcacaaaatcaatttcccccattcctgtcgtactcctttgccgtattgacggttaagaaccttggaaagaatctttgtttcctaaatttatcttaataatttttcattattttacacctgcatgtttattcaagcaatttgaaataaagatctttttgaatgatttcttcagtgctttcacgagggctgtgtaagggactttgctatttaggtggcactcatgagtgatggattaatgcagtagattccaggaccagatgtccctgtttctagatctcagctcttgaatggagtaagtcagatcctgcatcagtgtctttcaaactggaggcagttcagtatgaacacatttttcctagtggcctcgttcccagctcatccagacaaggaagcattgataccatttgcacgtggaacttcagcaatgtaatgtccaggcaaatgagtatgtgtgcattatgtgtactctcccacacaaaatctgattctacttgggctaattcactaaattcttgtttacacatgaagctgtttattttgctttgaatgggaagctgttttggagtcatgtgaagaaggatagaaaactactgagaaatgtagctcaaaaacctggaggatgctggtagcagatgagttgggagtggattgcatggtgacaaccagagagcgtaagtagtctcttattacgtacagtatttcattggttatatcttgcttctggattgttttggaatttttttagccttactattttattagactggcaggggaatcataaatggaggaaataaataattttgagttgatggagtagcttgagaagattgtctcaaattcaagtttttggctttcttgtgtggtcaggtattgaagtttgaaaattgtgatctgtggagcttaaaggtttttcaaatagaactaggagcccttacaaaacttctcttttgttatttatgtgtcacttatttcttctctgggacaacctattaccggagttgaaaaagtctgtacttaagataatttggatcagcaagcttattatcagtgatgtttttcttgcccaatttgacctatatctagaaatgctttgctcaactttctagaaattactgatactcatctttttccccagctttgttctaactcaaatttggataattttgtgtcattatctttctgttgttttaatacttagagagttggtgtggtgaaattgcaacagaataaaaaaatactattttaatttcagtgtttctggtaagaaatctgcctttactaatgactgaaatggacctggtttttgttttcccctttattacagtttgtggattagtcggtgtattgaacatgaaattcaatataactaaagtgggttttaaaagataatgaaatcaatactaacgtgaaaagacttgtcttcatcagagccaccccacaattggccctgtgctctctgttgctgcatacttaggtcctacagttcttcatgtaaccgcctgaaaagctctacttttctactaagaataaataatcctgctgaaatggaccataggtaactcaattaaacatagcttcctaccactgggttgtttaattatttttcaataattaaatagatagattgaaattttattaatttattaactgcatttttttttaagaaaagacatactcattgaagacaaagttaggaaacatagataaacgtaaaatttaaagtcatctggggctggacacagtggctcacgcctgtaatcccaacacgttggaggctgaggcaagaggatcatgtgaacccagaagtctgagaccagcctgggcaatatggtgaaaccccatctctacaaaaaaaaaaattagctgggtgtggtggtgccttgtagttctaactacttgagaggttgagatgagagaatcacttgagccacgaggttgaggctgcagtgagccatgatcacaccactgcactacagcctgggcaagagagtgagaccctgtctcaaaaaaaaaatcatctgtaactacaacagagatcaaaactgttatgtaaatgctaaatacggtgttcaccaagagggtgtgatttaaaaaaatatctagtaccacgtatttttaaaattaatttcatgtactccccacaacatgagaactggggtatgtcagcctctttatgcaaactattctttaccaaaaaataaataaataaataagaataagcaatgcactgaattcccagctttgtctgggcagtttttctttgcccctttgctacttgttagctgttactccactccttgagggttccaggggcctagatagctctagaagaacgcttatcactccatggtgaaccagaaaaccatttctggcctgtattcttttcacagaataaaatgttcttgagtgggagtgtcagggaatttggcctccctgacctccctgaccccccacccttcctttctttggtggaggagttcctttggccagggaccacttaacttctttcaaaatcccaaaattgttgcttattttccatgatcaacttctgtttttctcagaaattaagtcctttaagttccctgaaaggtagaaggaagactctgaactcactcaaaaggtaaccgactctgggctcagtcacatgaacttttgtaagacacacaaatgttaacgatccagacactggccagcttcccaggagtgcagctcctggcatttcatccatgacaaccattgccctgcttctactgagaaagggtttctgtgtctgtgtcgtacagtatgtatactgatgagccctcagcttccaaacctcatccggccatcccttgcacaggtagttgtgcactgctgctttcttttgcttctaaagatcaaaaccaagttttgcatagtctgaggattagtccacccccagcactttaaccagatggttgctgacgatggattctctttggatcatttaattaaccattgaactcactagcagttttgcaattacaaatttttttcccttacaagaaacctcatgattcagggatcaaaaacaccatagtttaaaaaaagttaggcacaatggctcacgcctgtatccccagcactttgggaggccgaggcgggaggaacacttgagttcaggatttcgagaccagcttggccgacgtgtggaaccccgtctttaccaaaaatacaaaaattagcggggtatggtggcatgcacctgtagtcacagctagccaggaggctgaggcaggagaattgcttaaatgcaggatgttgaggttgcagtgagtagaggtggcaccattgcactccagcctgggcaacagagtgagactccgtctttaaaaaaaaaaaaagtcataattaacaggactcttcgttaagaaacttggactccctgtgacattgtactaagtcagctttagctgttttgtccactactgagagaaataatatttacctacctcctagaatgatagggaagagaatttctgtgaaatatctgctatttcccaatattttacatttaaattataaaaatgtgcatttcattcttttttcgagaaacagtactcttcagaatatggatgtgagggtagattactgtaagaacacttttaaatcatctttgctctggtgtctgttctgaagggagaatgaatagtgtgatggttaagagcacaggccgtggagcaagactgcctgggcttgaatcccagcaccaccatttatttctatgaaccgaggcaagtcactttgcctccctgttcctcatttccctggactgtgaaatggcgaattttgagaattaaatgagtaatagacatgaagtacttagaacagcatctagttaattcatggtaagtgctcaataaaatgtcagctgcttagtattttcatagccccaaatctaggtaatgggtcccccatgtctgccttcatacttatccaccttcaccctgcaggtcaggctagaagggcatgacaaagggccatcgcagttccctagagaggacagagtgactccttaaagtccaggtacatggcaggagcctgtcacatgttgagggggaatggtttgctacttttgtacttgctgcatttggataagtgaaaggacttttggaactctgatattcttttttttttttgagacagggtctctgttgcccaggctggtgtgcagtggcgtgatcacagctcactgcaacctcaacttcccaggctcaagtgatcctcccgcctcagcctcacaagtagctgggactagaggtgtgtatcacctctaatttttgtgtttttggtagagaccagctaatttttgtatttttggtagagacggggtttcactgtggtccccaggctggtcttgaactcctgagctcaagcaatccacctgccttgacctcctaagggttttgctacattgggagctggttttgctacattgcccaggctggtctctggtctcaaattcattcattctttctttctttctttctttctttctttctttctttctttctttctttctttcctttcctttccttccttccttccttccttccttccttccttccttccttccttccttccttccttccttctttcttttctttctttctttctttccttccttccttccttccttccttctttctttctttctttctttctttctttctttctttctttctttctttctttctttctttcctttcttttctttcttttctttctttccttttttttgagacagagtttcactcttgttgcccaggctggagtgcaatggtgtgacctcggctcactgcaacctccacctcctgggttcaagcgatttttacgcctcagcctcccaagtagctgggattacaggcatgtgctaccacgcccaactaatttttgtatttttagtagagatggggtttcaccatgttggccaggctggtctcgaactcctgactcaaatgatcctcccttctcggcctcccaaagtgctgggattacaggcaggagccactgcacctggcctggtctcaaattcttacgctcgagaaaccctactgccttggcctctcaaagtgctgggatgcattagccactgtgcctggcaagttgaatggcattttaaggcatattccactttactgcttgttctgcgtataggagaagcatagcccccaaacaagaatgtaactgctgcagtggaagaattacaggggctccaattggagtgagtatgggcagaccacatgaggtacatcatcatggtggcctcattgtctgttggtagcagagaccatgcatacaacccaaatgaactaatcacagacctttgtgaagtggaatttttttccttaatgtgtttgcatattgctgtcactacgaagtcattttatctttaatgcttaattatctgtactaatggaggagaatattagtggggaaaatgtaacaacactgattcattttcagcttcccaatcaacatcagtagattttacatcattctggattcgaattaattctggcttgctctgtctctttttttttttgagacagggtctcactctgtcgccaggccagagtacagtggtgcgatctcagctcactgtaaacctccacttgcctcagcctcccaagtagctggaactacagtcgtgtgctaccacacccagctaattttcgtatttttagtggagatggggttttaccatgttggccaggatggtctcaatctcttgacctcgtgatccgcccgcctcagcctcccaaagctaattctgattctctttcttgctaaccctagcactataaacaagttacttggcctcatgttcttcatttataaaaggatgggcttggccaaggtagattgttggcttgcagatttagtgtgcagaagattcagtgtgttataaatgtgcattccctgagtctcatcccagagagattctgattcagcggggtctttaattgggcccaagaatcttcattgttaacaagaatttctaaatgaatctaatgcaggtggttctctcatcccacttcaagaaacttacttgaaatatctcctagtcaagaaaagagattggaagctggaatagatttgagaaaaagcctgagttggggaaatagtgcctttggacatttcttattgccttctttggtccttatacccaaagctatacaattcaaatttcattttatgcccatgtgcagcagttaagccttgagaccacaagcacaattcattagattgcacaaaataaagaagagatctatctaactttagggctataatttctactgtttttgacactgtcccaaactttcccctccttggtattatgcatccttgaaacaaacagttgtacccaagttggacactcattggctctgcagttggctctgcagtgccccctcgtgggtcctgtgtgggcattcttccttttctctcatgcccatagtgggttggctactgctgctctctccagccagagttgtagaaaagtaaatgaatccaaagtggatgcaaaagaaataatgaggagatggggaatcctttccagaaatgcatgaactagaaaagactaagaaagttccagctagggccaggcgcagtggctcatgactgtaatcccagcacttcgggaggccaaggtgagtggattgcctgagctcaggagttcgagaccagtctgggcaacatagtgaaacaccttctgtactaaaaatccagaaagtcagccaggcgtggcagcgtgcgcctgtagtcccaactactcaggaggctgaggcaggagaattgcttgaaccgaggaggcggaggttgcagtgagccgagatcatgccactgcactccagcctgggtgacagagtgagactccgtctccaaaagaaaagaaaattccagctagtggtgaaataggcaagtagttcctggttttgttccaaaaaacctaggtgtcttatattagttttctattgccgcataacaaataatgacacatgtagcagcttaaaacaacgtccatagcttctgtgtgtcagaactctgaatatggatgagctgcatgctctgttgggagtctcaccaggttgaaatcaagagctcagccttgactgtgatctcttctgagacatggggtcctcttccaagcacacttgtcggcagaattcatttccttggggttgtgtgatgaggtccctgttttcttgctagatataagccaggctcactttccatccccagaggctgccctttggtccttgctgtgtggcctccttttgtacatggcagtttacttcttcagggccagcatgggaatatctgctgctgcttctctcttaggagcttgcctgattaggtcaggcccatccagaatacagaatagtctctttttaaattagaacaaaaacagttgactatggatcttaattaaatatgtaaaatcctttgaagctcagaattcagagataaaaataagtaaataaatacgtaaaatcccttcaccttacaatgcaacataatcacaataggatatttctaggtcttgcctatagttgggggagggaactgttcagagcatgtgcatcaggatgcaggaatcttagggccatcttagaattcttttatgtgtccaaagattgtctgttgtatgttggacatcaagtcttttagttgctagcaactccataaaaatattaatttctagagatctcaaattaattgtacagattctattatacagcttttttgagacatgttgttaagcagaaaaaagtatatagccttccttccagattcttaaactagagagtgttagaaaaactcagagctcatcaagttacccgaactcattgtgcagatgagaaaccatctcagtggaagaaacttcccaaggtcatggagccaggaaaggctgagaatcctttggctccagtattagggccttttctatcattacttttcctgtgtatctcatagttttcttttaaaaaaaaaatcatgagttccaagtactcttattaatctgcagttcattgactttaatgagcaattttttttgtttcccgtaattgtattgaattagaacatttttcatctaatgtgtatacgaattagttactaactgaaatggaatcttggagaaaatgagcttttgcttgtttatttgtaagtataaaatcttcataattttcatgatgactcatatggtcaaggaactgtggaactgaggatagggataggaaggaaccacagaaagcttatatgatccagctaccttgcaaaaaacccttttcgtgattgacggttggattgacatttgttaagtaattttccacgcttttttttcccaaggaaaatattcaggaatgcttgatttaaaaaaaatactaatttaattataaatatgattgaatatttttctctttttttctagagtaaaatcttgttgataagacagtgtttttctctagtggtttgtattcaggcttcctcttcagtctcactaaatggcctcacaggtgggtagatgcatttgtcttgaaaggtgactgttaccaaatacaaatcttgtagatgcacatttatcttgaaaagtgactgttaccaaataaaaatttaagttatatctcagcatggagaccacggctctggtcaggtaggagccaaatgtccttagcctgaatgtgtgactagaagaatatgtgacttagtccagtttcatagctgcctgatttggggcaagcttgctgacttgggtctgggcaccacatctttgacagttgtcaagtatgctgtgggctaaatacccaaggttaagaaaacaatccaggcataggctatttctggccaccctttcttccatcttctatatgagcaccttgttgtaggtacaaaagagaacatttctattatatttacacgagagttgctgaaccatttttccactgcttctaccatgaagcctctgattgcctgccacatcactatgtcacaccctcctgagccttggagctggagtttgtgttttacattctatcttatatgaaactcctgtgcacatttgttttatctccattagaactaaggctctttgaggtgacagcaatgtctccagtgtctttctggtgatcatttttatatctgtcacacactgtagtcattcctagcctcggacctcttgggaatcaggtgatatttcagtctgtatgtacaccatgtgttttatatgtgtgtgactctttttcaaatattaatatatatagacgctcttgagactattaaaacacaagtttctttaaaagtttattgagaccaggtgcagtggctcacacctgtaaacccagcactttgggaggccgaagtgggaggatcacctgaggtcagaaattcgagaccagcttggccaacatggcgaaactctgtctttactaaaaatacaaaaattagttgggtgtggtagtgggtgccggtaatcccagctacttgggaggctgtagcatgagaatcgcttgaacctgggagttggagattgcagtgagctgagattatgccagtgcacagctggggagacaagagcaaaactccgtcttaaaaaaaaaaaaaacaactatattgaattcattacagtatggttcttttcttaattagtatttactaagaataaaataaaagacacctacatgcttccatgttgagagccactgcccttcagcatctagcaaggtgctttgcattttgagatatttcctcatctcaagccttctttggctctgtgtttcttctgtgaggtatgtgaagaagatggacagtgcatttcctttgtatcagtaataaccatttcagttctttaataatttgaatgaaaatctatttttttttgagacaaagtctctgtcaccaggctggagtgcagtggctcaatcatagctcactgtagcctcgacctcctgggctcaagtgatcctcccacctcagcctcccaagtatctgagaccactgccatgagccatcatgctcagctaattttttttattttttataggatggggtctcactatgttgcccatgttgctcaggctgatctcaaactcctaggctcaagctaatcctcctgccttggcctcccaaagtgctggaattacaggcatgagccaccttgccccatctgaataaataggaaattaatgttcacttccagccctagactggaagctcctgagccccagtgctgtgtctgtttaggatctattgcttaacagattgatgaccctcacataggaagttcagtacacattagtggtcagaggctccatgatcacagctgttaagtgtttttaactgctgtttaatctctaggcactttactaatttttaaaagttggaaattcctatggtaatatgattcccaaagaaaggtctccagtcccttaactaaaagatttagaataccttagctaaccttagagttaaagcaaaatgtctgccccctggtgtcagatcaacaactagcatcttagctaattctcatagtgagttccattaattatatgatttagtttttacagtaaattatacattgcacataaaattaaaaataagcaccattttaaacttgccactcgctgctatgaaactgggatttttggcttatattcaacattgttggtttttttcatgtctaaataataatttgaaattaaagtctaattttagtaaattttctatatgctattaactctgtagcactgaattttatagaggagagaaataatgaaggttttatgtgaaacaaaaatagccttaaacattattaatattttatgagtttgtataaatcttcatactgcagatagttttcctaatatttttggccagaaagaaggataaaaattcatttaataaaagtctttgaatatttccatatttctatattgtgtggggaaaaaaagaaaaaaaaagcatttgagtaatgtaaatttactggtttggattaaatgagaatgaaagtattcatgagagtccctagaatcagttaatccaagtcctgggttaagaaataagaaatcagtagagaatttgttctctgtttttgtagagaatgaggtttatataggggaaagtagagtggttgttgtgtgtgtgtgtgtgtgtgtgtgtgtgtgtgtgtgttttcttactacatttaaattctttatttacctgaaagctgtttgtgtgcactgtagggaaggcatcatgacgtgatggttctcttgctaggccaactctaagattatatgagataaagcatgtggagtatttcatacagtgcctggggcagtaaggactcataaatgttagaagaggaagatatttattaataacgtgcagcatgtaccagggattgtgctaatgatacgtccatgaggtttatagcctcaaggagctgaaattctattgcagaagtcagacaataattaaacacaaaattagacaaaaatggttgtgattagtactcaacatagaaaagcactgtggtgcaggggagtgaggggagaactggattagtaatttgaagccaaaaaaagggtgaaagccttttgagaaaccaaagatagattccctgttgtccatatactggaacacgttcaattcacttattgaagactctctgggcccttactcaaggcctgtttactcggatttatgtacatttctaacatggtttcatagttgacaagacattatttgcagtgggttagaagagagtggatggtgggaggacggatcagcagaaaaaataagctgatagaaccaagccctctggtattagggagtgatagcctagcattggggtggggaggaaggagagggacccagaccaaaccctaaatgctgaaaggacatgtcagttagcagtggtagagacaaagggttgaagtgtctcttgttgtagcagttagcagttgtagcagaaattggagaatattctgcacatttgggataaaaggggtatgtaagtaaaatcatgttttgagcactttttttaataaagcagagaaatgatcaatgagcatcaatgcacatgcccctcggcatttgtaatgtaaggttgctttggctccactagaaatgtgagttccttaaaggcagcgactgtatgccattcttactgtgtattctcagaatttatgttagaatccagcccaaagtagtgagtcgttcagtagatattctctgatcatgttagattaaagaggtttacttctccagacagatcttcatggagatattggaattagatatgcctgaaattggatgtataggcaagctgtaagttcagcatcccttcttataattctataacagagaagtggttaggcaacttctgttcttttagtctctgtttactataataaaactataaatctttctccttttaaaaaagtagctgtatatgccatttattaactggtttactgatttgttggtctgtttgagcacacatgtattgctccttctgtgtccttggccctgggctaaaacctgagagtatagtgtggtgaagatttctccctaccctcaaacagttctggtatctctgagtacattcactatattaataagttgaattgtgtccgcccagaaagatacattgaagagctaacctctggtacctataagtctgacattatgtaggaagagagtcattgcacctgtaatcaagttaaggtaaggtcattagagtggtcctaatccaatatttagtggtgttcttagaagaggaaatttggctgggtgcagtggctcatacctgtaatcccagcacttttggaggccaaggtgggtggatcacaaggtcaggagttcgagaccagcctgaccaccgtaatgaaaccccgtctctactaaaaatacaaaaaaattagccaggtgtggtggcgcgtgcctgtaatcccagctactcggaaggctgaggcaggataattgcttgaacttggggggcggaggttgcagtgagccgagatcgcgccactgcactccaacctgggcgacagagtgagactctgtctggaaaaaaaaaaaaaaaaggaaatttggagacagacacacacacagaagaaagagaatgccaggtgaatccagaggaagatggatatgtgaagacaggcagagattgcagttgtgctgccacaaaccaaggaatgtctgggactaccagaagctcaaagcagcaaggaagaatccctccttaatggttttgcaggggagcatggccctgccaacaccttgattttagactttttgccttcaaaactatggaacgatagatttctgttgttttaaaccactcagtttgtgatactttggtacagcagccctaggaaataaatacaactgtaatacatttctgtgtgaatcagagacctggtgggaaataggtgatgactccagtgagacacaggggtgagagcacacttaagaaaaacttccaaggtatggggaaggcttctagggttggcagcggcaggttttcattagcacgtccaggcctgaagggctaagtcaagagaaagttcttggaacccaggtagagctagattgacacctgtgaatttgagaagatggcctgactagtccaggctaacttgtgccatggtagagaggaagctggggtgttaatatcctgaccttcttttcccaggctctctgatcacttgctgagcctcttattggtcgaacctgccaagagagctcattgatgtagtccatagagtttacctcaggatacacagcagggtggaaaagagggagggtcgatctggaagggaaattggagaatattctgcacatttgggataaaaggggtatgtatatgtcattcaaatatatgtttatgggaaggaaagaatctaatgtgtaagacagtgtttattgtacataccactggttctcaacaaatacttctgattaaggatataaaatatctagaaatgtttatgttgcagtctaagattcaaggctgtggaattcatttagcaaattcttattaagcactcactgtagtgccaaatcttagacaggccctggggataagtactgagcaaaattgactctatcctttgccttcattgagctaatagtctaatgtcaccaactgtattcactagggttaaaacttcatgggattcgttacttctctcatgacacacaatgtaactggaaattactaactggattccactcttcacctgtggactgcaagctttgtgaagtcagcagtgtggttgcctctgtttacttctaacacctagttcaatgcctggttcctggcacatgtgcattgaatgaactgatgaatgaatacatgaatgaatgaatgagtgccttgtatttactatttaggagtttctgaaaattagtggatgacttaaagtatataaaagtggacaaattaaatatattagggattttgctattttatttatttatttattattattttttttttttttgagatggagtctcgctctgtcacccaggctggagcgcagtggcgccatctcggctcactgcaagctctgcctcccgggttcatgccattctcctgcctcagcctcccgagtagctgggattacaggcgcccgccaccacgcctggctaattttttgtatttttagtggagacggggtttcaccttgttagccaggatggtctccatctcctgaccctgtgatccacccacctcggcctcccaaagtgctgggattacaagcatgagccaccacagccggccaggattttgctattttaaaggattgttggattaatcctgtataaaattgagcagtaaaaatagtctataatttatctaagtgtggatttttatttgtgggaattttattttttgttgagagcacttttgttcgatgttagagattgaaaccaaatattatattttagttttctctggtcactcttcttatgaattaattgtcccgtaaggatacgcgctaaagttgaagctcaaatctgaacatgaaaggattcattatgcactataggcttttcatacctattaataagtcaatggtttgaatgtagatcaagaatttaagggattactttcactaattttaatgttaaagcaaaatatctgccacctggtgtcagattaagactcaaaaggtgtcaaaagaaggggatatatgataggttttctttctctacttttgaaacattttctagtactaaattagagatattaactccttcaggcctcttaagttctattgctaaatagagatcagtgctcctttgatgaccatataaggaaaacgtttctgggaaaaatattgcagaagccatgagcggttatgttatctaatagcctcagaatgggaaaatttaaagagaatggaaagcagctgacataaccattttcccagagaaagctcctcctgcttctgcataaagatgtataatgtaatccttagagatctcacttcaattattgtgtcctttattcgaatgaataagtagagaatttagtttttgcacttgtcagtactataacatgccttctcagcttaaaagtaatggaggaaattacttgtaaaaaaattaatgaaagagatgaaagataagagaattcaggtttaaaaagtcactggtttgtttctcagtatgtttaaattttaggattaattttttttcttcctcctagagttcgagtctcataagaaagaatcgtgttaatagcccccgttatgttttgctggagtttatcagtcggtagaaatctactgagcaataagaagatgtttcatagccttggtataggaatcattgcgagcttgaaggttcacccatactaggaacttctaaggttacaagtatgtatgaaggaaaatgcttcttctcttgagacataaactgtaaataaatggcacagtcagaaggggactgtttagttattggaccttggagaattcttagaagacataggggcaaatgtatatgtactgtctgagagagaggaagccctccaatgtttgggaagggacagtctttggttttgctggacttaaggtgatggtttgcctgggactgaggggtttcctggcttgtgggacttgcagtgctaaaactggccaggttccaggaaacgagggcagtgggttacccttaactaacgtgacctgctcattgcaggtcacttagtgtgcctggcctctacctaccagtggtgcctcattgtgggaacccatcactcccatacattttcatgtgtcccgagataggaagtacccctcgggagaactactctgagtctagcccgtggtgtcagagcattctagtctcactggcaagaccattgctgaagtagaatggatgcatgaagctgtcttcagtcttaaaacaaacaaaacccaaatgcagttagtttaaatgcctttggttcaaaaaaaaaggaggagtggggagaggttgcaatgttaatctaaaatcaatgcttggaaaaaatgaggaaattgattctgaggagaatgagaaaaaaaatgagattgaaaccatactaaacggggcatcgagtgcagtgccatgcgaaaggaagtctttcattttgttcataaacgtttaagtcaagttctcacttattcatgatccttattaaggagtaattagtggttcccatataatcttcaaattaatttatatagtcatgccaagatgtccaacttttagaagatttgggagggtaggaggattaagggacttccaggataatgggccctcatccctcttccccatctcctttgaataaacggttgcttcctaatgagaaaacaatcctgtagaagggatgaggatgagggcagaaaaaagatggatcccctctgacgtaggcaggtttagggtaatatcaatacatgtaagggcaggatatgttttgaaaaatccctgactaattacagggctgttatacagcacttaagtatgtgttatcattatatgtgaagaatatagatgcaagcacaattttattgattgaaaaagcccagcctgattctattacttaaagggattttaaagatattatattgggtaaccttgggttgaaacatgttccctttacaatccaaaactggtcaatgtattctttatttaacctgattgattcttgtcctctccctttaaacataagcttgttcacagagatacagctggaagtcatgttgtcatgacaacagttacacgctgggaggaaggactctttaaaacatccagggactgggtttttaatcactgatttatattgatagcaaaattaaatggggatgcagaattcataattatatgttactttggctccatattttcacttattgacatgtaatttttgaacacgttaggataaatagctttttacacttatacaaattcatctcatctgttgtctatgttgtcagtaataataatctgaaaacatatggatttccctgctccaaactcttgatagcattgtgttgcctgtataataaattctaaactcatgaatgtggtacatacagtcctgcaaaaaacagcttccacttttcattagattttcttcttaaaagcatttattatggatctcacacatgtaacttcagggtccttaacttcagggtgtaggagctaaaggaggtgggtgtgtcacactagaaactataatgctaagttgaaatttgccctgaataatttgtctctaaatggagatggtagtacagagatgtattagtctgttttcacactgctgaaaaagacatatctgagactgggtagttgataaagaaaaagaggtttagtggactcacagttccatgtggctggggaggcctcacaatcatggtggaaggcgaaagacacgtcttacatgacagcaggcaagagagaatgagagccaagcgaaaggagaaatcccttataaaaccaccagaccttgtgagacttactgaccaccatgagaacagtatgggggaaacctcccccatgattcaattaactcccaccaggtccctcccagaacatgtgggaattatgagagctacaattcaagatgaggtttgggtggggacacagccaaaccatatcaagagaggaacaggtttatttcaacagtgggtgattaggaaaagttttgtggaggaagtgacccttgaagaatgaacaagttttagtgtcagatagaaaaacaggagattccagcccataggaccagcaaaggcacagggatacagatatgtaaggcatgttgtgagaccagtgagtgtccatttggatactggattggaatggggcataaggaaatgagatggcaaagagaggagaagccatattgaagagggcattgcatgcagtgccattctaaaggaaatcttactttgcacaggaagaggaacaagaattggttgaaatggatgttcatgagaaattaatagctgtagtatgattagaggaagcactgtagtcacaacaagcagtcataaagccagttttgaatccaagcgaggccctggaaagtgtagactgaggcactgttaaggaggttagcaagcagagcatgcatctacgagcactgtacttttctggagtcagtttctgaaatacaattttatatattgactaataggtactcaggaacataggttctggtatatgactgcctggctcaaatcccagcctactgttactagctctgggaccgtagtcagttacttccctcctctgtttctgctgtaaaatggggagaagatgacaccaaccttaaagggctgctgatacacagtaagtgcttagaacaacagtgcctggcacactgtcagaacttcagtaaatgttagtgtggctgctgctgttgatgaaatgtgaaaacactgctcagtgtttggcactttttatgctttttaaaagctatctcaagaatgtaaattatcggactctatttctacccagcatctcagcctacccctctaaaagccctcccttccacttgatgggtagctgttgtctaaccattatgtcccaggcactgtgcttagtgctaggggtacaaatgtcacaggatccttggaggtgtagctcttctggcatgaaacctctggctggttgcacctttgcccgagttttgctcgggcctgctgggctcattccacccacttggcctgggagactgcactcggctcacgcttctagcctggatcccacacctgccaaaagtgagccagacacgagtggcaagggctgtgtgagtgagcatggggtccggccactgcacacagccaggcatacctagctgtggtggggcaggcagctccaggtgctggcatgggtactggctccctgtgaggctgtggctggaccaggcatactgcaagtaacttccatggctggcaccagtaaacgcatcggtgcccagaagcttggagatgccaggaaccacagagccccaaagagggagtcatagccctggctcagggagctcctaggcctgggctccccaaaaggctgcagctctttttctcattgcctgcaacgtggcaagcaaggggcgtgtttcaaccctgtttgtgttacagctctttcagccctgccattctgcaggtcccgagttcttgtcctacgtccaggaagaatgaggtatgcagacaagtagagggtgagcaaggtgaagaggtgctttattgagtgacagaacagctcagaggagacccacagtaggtagctcctctccacagccaggtcatcctgttgtctgcccagctctcagcagagaggaaacccactgggttagcgcctctccacaggcaggtgatcccatcatctgcctgagtctggctgaacctggggtttttatgggcttcagaggggaggaagtgcatgctgactggtccatgagtgaccatgggcaggcctaaaaaagcaccataaattctcaccctggtccatggaactggcagcccagcccctaggcctctggttgtccctggcctgaaggtgcggtttcactgtggacctgaccctttctgcccaggagcctatctgcctcctgccgccattaacctgccattcacagtgcccatggtgcccaggctgttcatgctgaggggtgcctgcagacctgtgccgagccacccttaacctcccctcagcctctctgctgtgcttgttggtgcccaaagtttggagggggctgaggcagcagggggctggtatgccagcactgcctcaagcacgcacatgcccatccaggttgtgacagtgcccaggctcagccacaactgctccaaaattggagtggggagaggccaggcagcaggaacaggcacttctgagcctgcaggggcagggggctttctaggcccccaagagtacagagatgcctgggtccacattagcagctgggtggctgtagctgcgcccaggagggtagtgcccccctccctccaacttggaaggtggggcagcattcacctgttcccaactccctctggctggtggagtccacagccctggccatgcctcctccactgcagccagcatcatagcagcactccagatgggctaccgctgccatcacaaagacgaaaatgcaaggatcttgtcataaaagagtgtggcagcctttactacatagcagttcgtgcatacaaaggagtgtgaggaaaatagtacacatgtgacagagagaaagaacgaggggggaggaattactgaatatataatctctaaattgttaatacaaaggtcattttgattataaaaacacctcccagtagtagatgcttaagtcacatatttgtgcatctatattggtaaattatcagttttttccaatttaaatcatagtttcagtatgagttatattaggatattctttgtgtttagtttcaaggattggacttgaatttctaaagaacagcattaattctagagaagggtaaaagtgttgaaagtgagagcagtagaacgttatgagtgcttcaaaattgttggccattccttacctagaattttaatatttaattcagaacaagttttgtatccttccagtcatgggaccacatgatgttttccaggaccttccaatttgaggctccaaataaattttataaaaagaatctctcttgaacctctggctcactggaagcctctaaaatactgccattcattagaaatacaatgtgagccacatccctaatgttaaatatttaatagccacattcaaataagtaaaaagcaatagacgaggttaattttaatcatctattttatttaactcaatatataaaaaatatcattttgacatagaatccatataaatattattattttatatcctttttattgttttccaaattcatgtgcgttttatactgacagcacatctcaatttggactagacacgtttaatatgctcagtagccccatgtggccactgactcccctattggacagcacagctctagaacttggggcttttcagagccttgggcccctccaataattatttaaacaatgtctgtatctttggtgacttttcattagtatttttacagttaaggaaatatataaatctaaaaatgcaagtttgttttggacttaaattgtaagcagttaattatatgtcataattcgtgatatattttcatccctgctccacgcatgcaaagcatccctcttatttaatggacttacttgtttacttgctgttatttccttacctagctgccacgtttttccacccatagtcaaccatttttttttttttttaattttttgagatggagtcttgctctgtcgccctggctggagtgcagtggagtgatatcatctcactgcaacctccacctcccgagttcaagcaattttcttgcctcagcctcccaagtagctgggactacaggcacgtgccaccacgcccagctaattttttatatttttagtagagacggggtttcactgtgttagccaggatggtctcgatctcctgacctcgtgatctgcccgccttggcctcccaaagtgctaagattacaggtgtgagccaccactaccggctactattctaatgtgtttaatgggtaactttttgttcaaaactatacttgcaatgtgcattgttgtgtgtgtgtgtgtgtgtgtgtttattcaatgggtattttcccccgtgtactgtgttttggagatgtatccataggctatgtgtacatgggctgcattgtttccagtggctggatggtgctccattctgtgaatccaacacattttacctttcccctggtagagtgatagacttgcaggttgcccccattttcccagtaccacagggagcaccccgcacattcctctaattgaactgcatgagaaggcatgtggcatacactctcgatattgctgggccatagggtgtatgtcgtttacttcttttggggaaaaaaatgatttgtttatcttatttttattgatgaatgtatggatataattttacgtggttttgctcagtgaaaaacacagcattgcaattgttggttgaatcagatgacaggtaggtgaatcagttatggactgtttttttagggatagcttactagttcaatgcttgtaggtgtatttctcaaacagacccagtggccacaaaagagggtcaagcttttccagggtgaccagttgaaatctgggccaagtacaagtgtatgtagcctttagtcacagtaagaaaatcttcagttcttgttctatcagcagagcagaatttattttttttttaaatgagttagtcatggaagcagaaagttggtggggggttggagggataaaaaaaggtattacccttaacaaaaagaaagcccatggaaaattcatgatgaaactgcattcttgcttttaaaagtaacttgtactgttgcattcttcaaaggaaattttttaaactctgtattttctttcaattcctttctgttttgggctccatggttgggtacttcccactgtaatattttctaaagagaagggtaaatgcactcagttcattcatcaaagcatgtctgcaacacaggaagacacgcagtgttttcttctatgaggaagaaagcacaaacagctgtctaggacaaacttcttgacacagccatgcacttggtcccactgatgtttgccaaaataggcgattattgtcagtatttttgtcagcagtgaggaagactttgatatagcatcggattcatttgcttccaaagaatgtttctctattcccacttctgagagctaaggatcatttatgtgtgatgagcagagtcttctctcaaaggcctttcatttatagtaattcctttcatagaaaaagtaatagaggctgggcgcggtggcccatgcctgtaatcccagcactttgggaggccaaagcaggaggatcgcttgagcccaggaatctgagcccagcctaggcaacatggcgagaccctgtcttgctagaaaatcaaaaaacatagttgggtgtgatggtgcatacctgtggtcctagccactcaggaagctgaggtgggaagatcgcttgagcccaggagtttgaagctgcagtgagccatgtttgtgccactgcccaccggcctgggcaacagagagcaataccctgtctcaaaaaaaaaagaaaggaagaaaaaaagaaaaagtaatggaatgagtttgaggaggaagatgcttagaacatgccagaattcaagagcagaaagaccatcattaacaaatggacgctaactaccagtagatccagaaagaaggaactggagctagcccaggacaaaaacctggtataaatcaagattttcacaagcgagaggcttagattttgcaatgaggaaggggaaaaaaagaaccaaagtatttctgtagtgtaacaaatttggaaaccttcccagagaccctgcagataagaaacctctaacgcttcaagagcgtttttctcataggaaaataattttagctactggctggaattcgaggcctagtgggttaactggtacatttgtgggtgaataaaaaatagcaaacagcatttctgaatcttttttggatgtcatagcaaaggaggactcagattccccaggcaggctgtatggtgatatgtactccccaacccccacctgaatccctcccttcctccttccctcccttcccccacttctttgtcctcctctttcccattcatatagatactatctaggcaacctttgtagtttctcagaatgagataggaaaaaaaggggaccactcctaaatacattctcttatattcagaaaacttacattgcccacctatgacgtatgggacatgtttgcggtaccttggttgattacagtaaaaagaacaagaagtctggtctttgctttaaggaacttagatctgttcaatttgtgattaatagcatcgataagagacctttttgaacattttgcaaccgagaattcacaatttagacaccaaatagttctgtgttctcatctttacagaaaggaggatgtccttctaaactttgagcatgaattatcgtttgaaaattttgagaataattatttcatttactggttctttcctggaattttggctcaattacctaatattgtcttatgctagattctatttttgagaagcgttaaaaaaaatggcagtttctatacatgcatccctggcagatgggatccacaaatacccctgcctcctttctgtcaatagcccctgcatctttgaaaaactcagagctctgcatatcactttttcattgctgggaaagaaaaaccaagctattccacaggtgtgtggcagctaattggttttgccattttgttaaccctctagagaacgtttgctttcctctcttgacctagaattggagggtcttgaggaggagaatggcatagatcaaaaattgaaaaccttgagtcagattaatgactggatgttgcttgtggttggctgaatcctgcaggtatttcttgaagtttgtgaaaaaataagcccaatgcagtgtctgcatttggtctgcatttgtctgcatttttgacaatacttggaaatgaggttaagatgcttggattggtgggtggtggaaaatgaatgaatcataaccgatgaagttatattccaacaatatgatgtttcagaaggagtcttgggccagatgagaatcaggaaactggtttctttttttttttttttttttttttttttttttttacatcttttttttttctttcattattatactttaagttttagggtacatgtgcacattgtgcaggttagttacatatgcatacatgtgccacgctggtgcgctgcacccactaactcgacatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcttaacccaactctataatttagatgtctatatgtttgtgtttgaataggagattgcaaagctaatccattagaagctgtttctttcctagactaggcctggaatttagttttttgctgtgagatgaatgaaataggatgaatttcaactattagtaatacaagaccccaaaataactgtgacttattacaataaaaatgtacttccctttcacatagaagcctggcagtagcagtccactaatatgatggctctgccctacaaagacctcaggaaccaaatttcttctgccttcctgctctgctgtccctaggctatgtcctcatagtccaaggcagcatctctgttgcaggcagaaggaaaaagtatgcccgactgctttttttttttttttaaaggagggctcttggaaattgccatacagtccttgagctcacacttcaatggttagaatttacttgcatggccacacctagctgcaagggaggctgggaaatgtagcgtttatatcgggtggccatgtttccaactaaaagtttatatggctgtaggaaagactggctgttgatgaacactggctttgatgaacatcaaaaacagaaaaaaagtggcggggcacggtggctcacacctgtaatcccagcactctgggaggccaaggtgtgcggatcacaaggtcaggagatcaagaccatcctagctaactcggtgaaaccccgtctctactaaaaatataaaaaattagccgggcatggtggcgggtgcctgtagtcccagctactcaggaggctgaggcaggagaatggcgtgaactcgggaggcagagcttgcagtgagccgagatcacaccactgcactccagcctgggcgacagagcgagaccccgtctcaaaaaaaaaaaaaaaaaacccgaaaaaaaatttctgtttttgatgaacttcttttattatataactttgtaaattttttgaccagtaatttaaatatcttaaccccatgggtctattctcttgtgttatttattgactgaaatatatttatatgttttatatagcctgcctcaaattctttttttaatgtaggtagaggtactcctcttattactgagaggagtaataagaaagaagcttttactctgatccctttaagtatgttttcacaacataatctcagaaaaacgtttttctctgtactcctcctccccatccatagtctaaaatccttttttacatcaaatattaaagcttgtccattaaccactctgacaggctgaacaatttacctccgttctactgatttttttaagggcacttaacctttaaaatacacttaacgaataggatggctcccaaataaaaatacaccaagatttttctgcagccaaatgataagcattttcctaacctcgatcaagttatttaacattgctgaaatctgtttctttagtaaaatgggaataatatctgctctgcatctgtggcaagattttgtgggatcaagtgagattggattaattatagctctttggaagtcctgtagtgctctggaagtgcatgctatagttcttatatcagaaataaaatgtatatggtttatgcatatgtataatataatattcattctaatctatgagagtgtagtataataatgttcccacacacagatttggattttacaaaacatgacgcccacttcagcttgtaattgtaatatgctgataaaaggccaaattgtcattgaatactgtgtcaattgcccaaattctccataatgatcttttgttgaagtatctaacttaagtgggaaatcaagtcctggcatgccaccatttagaagaataatgacgttggagttgatcaaggccacttctaaatagcttccattttgtgatcgttgctgttgtatactagccagaggactgcagctctgagagaaaagcatattgaagatcctgccaaaataacagaaaagaaaattgtctccatttaatatattttcaaacctgcctaccttgaaagagtgtgatgccactagtaattctattctgtttaattgtatggaagccaaagaaagattcatgcccctggttgtattttgtcttctcttctcctgctgctcactctgaaataagaataaaattaagttgaaagattaggttgacagaggatgtggcagcggggcacattctctgaatgatgttgtgcagttacacttagcttaatgtccatataatcatagatctttctggaatactgtggttaggacgagtgactaggtagtcttcctgccaaacctaaataaatcctgcctggtattgaacaggttgtattgctgtcactcattaggtgggtgggataggcagacagctggaggagaaagtaataaagcctgcctagctattttatctaaatatgatgtgatctctactttttaaaattataaaaaattaaggctgagtgcagcggctcacgcctgtaatcccaacactttggaaggccgaggcgggaggatcacttgaggtcaggagttcaagaccagcctggccagcataatgagaccccatctctacaaaaaatttaaaaatcagctgggcatggtggcgggcaactgtagtcccagctactcagggggttgagacaggagaatcgcttgagcccaggaggtcaaggctgcagtgagttgtgatcatgccactgcactccagcctgggtgacaaagcaaggccctgtctcaaaaaaggaagaaagggagagagatagaagattatcaaaaattgctgatttcaagaccattctcacctacacccattctcctttcattattatgcttaggcttttggatttttaagggttgtgatctcaatgcagtttttttcccagtacttctcaagaaaacaaaattgagattaccataattgtctctagttttcttaaagtaaaatacaaatcttcactcagattttaagtttttattaagcttttttggaaggagcacccttaagcctgaggttctcagtagtgctatgttgtatactatgtgcacactctaaaaggaaatagtgttcttaggttatacttcatctcaagactttaatatcactagttagaaaatacgtgttttattctgtgtggaggtatttagaattagacattccagtgataaaatattaaaatattttactacatctaaaatattctataaccaggtcatatgattaaccttaattatatataagtttatggatggatggaccgatggatggttgaatatttacaaatacagagtttccttctaggtaatttttagctgcttacatttcatgccttttagttttaagtttgtatgcagagtcctcctgactatgttgtgtttggttttggttaatagtctatgaacggagatgtatacttttatcttctaccaacctctgatcatatcctatctgcatacttttatgagaatatgaggtggaggccgggtgtggtggctcatgcctgtaatcccagcactttgggaggccaaagctggcagatcacctgaggtcaggagttcgagaccagcctggccaacgtggcgaaaccccatctctactaaaactataaaaattagccgggcgtggtggtaggcgcctgcaatcccagctacttgagaggctgaggcaggagaattgcttgaacccaggaggcagaggttgcagtgagccgagatcgcaccattgcactccagccggggcaacaagagcgaaactccgcctcaaaaaaaaaaaaaaaggaatatgaggtggagcagaagcagtcccccatcaagaatgtcttaaatagaaaacagatttaaactattttgttctaacttcctttctgtttctttaagggctcaactacatgacagaaaacagccacgtgctaatgaaagaggcatgatgtactcaaacaagtgtgttctcacatgatacatcatttctaaattgacatgtgggtggccagtgttattatctagttttcttgatctaagtacaaattacctttttaataaaaaaaaatgtgattgttgcagactctcagaaatcatatttttttaatgaagaaatacactgtggttgatggcatttaaaaaaatgttttgaattacagaatatttttttccaaagccacatatgaatgtagcaattgatagctaatgataataaacatttactgagtgattactatgtgcccggctttgcgccgcctttgttccacatccaccctgtgaggtaggagctgaaatcagtcctgtcttacaaagagcagatgggtcattagaatttaagccattttctctgaggtcacacaactagcaggcatcggggctagattcaattccaggctgttggtgtggctacagagctcctgttcctgatagtaatacagccccgagaaaatgtagttgagtaagcccagcagagactatgcctccatgtgtttaaattaagaaacttttgtgttgattttatgccaacatgcttgataaaaatagacaaagtatgtaatgttaaaaagcccaaatttaaggaccttttaagtattgagttcttggaatatttactcaagaatcttcaacagaaaaatcctcagctacaaatagcttcctatttcaaagatactcagaaatcttaacattaattttttaatgaaaaatatggggaaaggtgttagggaattaacactcccagaactgttaaggtttttttttttcttttttttaaacaactgttaaaataatgctaccacagggaagttcaattgaatacaaagtgtaatttttctgaggctgtggtagacatttcaagacctaaattatgtcttggaaagacatattaagaagtataagggccttgaaactcttcaggcaggctttcctcccctccagcaggccagtgggtcaggattctgggcgctcccaaattttggacactttggggcctgtccctttcttaccatagtcagtgtttctgccgattcctttggttgaagacaatttcacctcagattctaagcagcctctgtttgctgcctggaaccctcagcaaacctattcatgatctaaacccagagtcctggctctgggctgttgattgtcttccaaagttggtggtgaagctggaggaagtgaagagccctgcttgctatattctgacaacacaaaccttgggccagaaaaaataaagggactaagtagtgagagagaaaaaaagagagaggcaaaagaggagggccaccgtgtgatcagaaaaatattttttgggctaggtgtggtggctcacacctgtaatcccagcactttgggaggccgaggtaggtggatcacatgacgtcgggagttcgagaccagcctggccaacatggtgaaaccctgtctactaaaaatacaaaaattagccgggcgtggtggcacacgcctgtaatcccagctactcgagaggctgaggcaggagaatcacttgaacccaggatgtggaggttgcattgagccgagatcatgccattgcattcagcctgggcaacgagagcaaaacttcatctcaaagaaaaaaaaaaagaaaaagaaaaatatgttttggttaggggagggagatggaatctttttatgttgctcaggctggcctcaagctgttggcctccagcagtcctcccacttcagcctcccaagtagctgagattacaggcacgagccactgtgcccagcctgaaaaagagttttaaggctaaattcaaatagtttggattgaagcgttaagctccgtcgagaataacattgctccaaagagtcagtagtagcagctgccactaagactttgtaagagatcagaaagatcccttcaagaatgggaacattgtgcagattattcctctgatcttttcaaaatacaaatcacatcacataatagcttcagataatcctttgcataaaggatgaatctttagccagtggggctttacgccttatcacagacctctcacccctaatcgagtgacctttctgttgtaatgacatacagtctttttccagccacatgaccttgcccttgctgttccctctttcagaaatgctgttctctctttcagaaatgctgttctcttgtcccttcccaaggctggctccttctcctactttagggagacctcactcccttagaggccttcccagacatcctcttaaatagcccaccctatccccagacatgattgtttgcctctcttatttattgctgtattcccagcttctaaataatatttggcgtttataggaggtcatcggtacagaagaatgagtaagtggatgaatgaatgactgagtacacacgtcacatttcttcttctgtggagcccagtagttagatagagtttgatggaaaagaatgactacctggccgtacagtggtgcatgcctgtaatctcagtacttagggaggccgaggcgggcggatcacccaaggccagcctggccaacatggtggaaccctgactctattaaaaatacaaaaaattacccgggtgtgatggtgtgtgcctataatcccagctacttgggaggctgaggcaggagaattgcttgaacctgggaggcagaggttacactgagccaagatcgtgccactgcactccagcctgggtgacagagcaagactcaatctcaaaaaagagaaaagaatgagtaccttttcttttcctaggccagtggttctcaaaagtggggactgttagaaatacagattcctgggccccactccagagtgaccgaggctccccagcagtgtacgttctcacaagccctccaggtgactctcatgcttgagaactagtgtcttaggccgggtgtgcagttccccatctattgtcatcacctctgcacccctagctttaaaccagtgtctggcacagagtagacaggaagcatttgttgaattaattaagccaccttccctctttcctctccaccccgtgcctttcacacccaaagccctgggtgcacaaatgttggggaagggagcgattgccttcctaaggacccgagggaaatcttgtgctctgtagtacagaccttgctaaatttagactttcagctcaccccttcctccttcctgtgccctccgcagcaggagaggaaatttccagctgctgctagaagcaaatctattttcatttgacccttggatttctgcaggtgagcctagggggaagagggttattagaagtgggtttgcttcacacactggccccacccgggagtggtccttgttcagaagccaggcccctagccctggcgcctgaggtggctggaaggagccggtccttgctgctcacagatgggcttgttctcaggccaagtattgcttttggcccaagaggctcccagcacaagagagactttgtggggctcttcgccttgctatttttacactttgacttccaggccctgcttcctgttccctcacaaaagaacaaaaagcacaaattacgaagagccgcagagcccctttgaaaggacaccgatggctttcagctcccactcttgacctgtcccctgtcagcaggtgacagtgccttcagtcagaggcagtgatgacaggagactagaaaggagggaaggtggagaagcatgtggatctcagcctctgcagcatgtggagagaggaatttgatctttaaggcttctagcacgagggttttagaaatatatgggccagctggagtggctggcctggatttactggagcagaattcgggggaaaggcatttaaaggaggcccctggatagaggcctgagttggaagtgttctcatttttaatatccccagaatgtcggggtggattggggctcagggccagtctgcgggcgaatctcggtgcaatgacacaccagttgaccatggtcaagccagctgtggatctcatagcctcagccttgtagccattgtttggttatgttgtcatccttatttattcatcttctaatttcccaatgctgtccatctgggtttttctcaggtctctgtagaatcctttttttttttttttttgagatggagttttgctcttgttgcccaggctggagtgcagtggcgtgatctcggctgactgcaacctacctcccaggttcaggtgattcccctacctcagccttctaagtagctgggattacaggtgcccaccaccacgcctggctaattttttttgtatttttagtagagatggggtttcaccatgttggccaggctgatcttgaactcctgacttcaggtgatccaccctccttgacctcccaaagtgctggaattacaggcgtgaaccactgcacctggcctaaaatccatttttatatgaggacatagtttacctttttggctgtaaacccatctgctgtcctctctgagccctagaaatggggataaagatagtgcctccttcatagggcagctatgacaaaccacaagctcctgcaacgaaggacacagggcgcgtgatacagcacctagtggcgtcagtgtccttgcagttgttgctgttactgttactagcttttataacatcccagcgggaagatagcacttgcattcaagacctgaaggacctggattccacccttgacttctagctgggattgatgtgagcattaaatgcagcgatatgtatgaaaacatgctttgttttatggatggggaacttttttccaaataaaggcctcacacccagtcagggggaagctcagaatcatgtacaaatgcaaagcaagtttattcatttggggttggtttatgtttgagagaaacctagaagtttcacaagtctacttaaaaatggagaatgagggcatcaatctttattttaaaaattatgaaatatttaaattaaaaattatgaaatatttttgcttcctcattaattgagagagaagagagatatttggagaaagagaagatgtcttgtcacagtagaggcgtcaccagccaggggcatacacggtgtataataaggaagacagtcagcaaggcaggtggggtagaatctggacttgccggacctcctcagatcctggaagtccggccctgctgagggagcctaactgaccttcttctcctatgaaagtcaccataaaatgatcttttgtcctttttttttttttttttttttgagacagagtctcgctctgtcacccaggctggaatgcagtggtgcaatctcggctcactgcaacctccacctcctgggttcaagtgattctcctgcctcagcctccttagtagctgggattacaggtgcctgtcaccacacccggctaatttttgcatttttggtagagacaggtttcactgtgttggccaggctggtctcaaactcctgacctcaggtgatccacccccccttggcctctcaaagtgctagtattacagagatctttttgctttgaaccatgatgataatttgaccctagagattctgtagtgagcattttccttgggacctatgaaaacatgttcttatattgtgactttagtgactcgaatgtgctgctgtagtattggcttcttgagacctccaatttctagtgatggtgatgataacactaacagtgaccatccatgcagtgaacacggctgctgcatgccaacctttattctaagtgttttatacactacccagtgaggcaggtactattatgatccctgttttacagatgtgcatctgaagcccaaagaggttgaggaacttgtccaaggacactcacatagggagtggctgagccacgatacgaaggtccctaccgcattgacacttcagttgccacgcagttgcaccaagccatggctgcactgagccgtatcgcgtcttcgcagactctcctctggtttcctggtctcattggagccagcaggcatcttgaatgaatccattctttttgcttggattatcttttaggtactgaaaaatacctcgactaggccggctttctattccggcatatctctgtttaagaaacaactgaaacttttgatctcagaactccactgaggtatttttttttaattgtgcaaaaaaacatacatagagaaacacccatactgtaaacatacagcttaacacataattataaagggagcgtcgatggtcctgccagcccagtgaagaaataaagcatttctaatactccagaagtccttgagaaacctctctgtgagcttcactgtctctcccccactccaggtattcatcctccagtttttggtgatgactgtatccttgcatttctttatagttttaccatctacatctatatgcctaagcaatgtagttgagttcttggacttggcatggacacttaatatattctgttttgtcttccttttgatcaatgatatgtttgtaaaatacatccatattgttgtgtatagctcatttttgttcatttattctgctgtaatttattcattgtcttttttaaatttaattttaatttttttaattattttttttttgagacggagtcttgctctgtcacccaagttggagtgcaatggcacagtctaggctcactgcaacctccgcctcctgggttcaagtgattctcctgcctcagcatcttgagtagctgggactacaggggcatgcaaccacactcggctaatttgtgtatttatagagacggggtttcaccatgttggccaggctggtctcaaatccctgacctcgtgatccatccacctcagcctcccaacgtgctaggataacagctgtgagcccccacacccggccaattttgaaaaatttttagtagacatgcatctccctgtgttacccaggctggtcttaaactcctagactcaagcagttctcccgccttgacctcccaatgtgctgggattataggcatgagccactgtgcctggccaattcattctgttttaaatggttgtctaggttgtttcaaggttttggttatttcagtgctgctgatatgaatatgttacctggtgcacataccgagtgtggaattgttgggtcatagagtagagatatcttccactttactagttaatactattttcttttctaaaatgattgtaccaaattacccttctacgagcagtagtatctacaagatcctgttgttctacatgcctgccaacaattggtattgtaatactttttaatttttgccgagctgacaggtatggaaggaaatctattgtgttgtgacttgaggcattttaagatgctctgcaggctttttattagatttctgcagtttctgtaaaccttgccttcagtagcccccgcagttggtccgaattccagtcctccaggcgagtcgctctgagttgggttcccacggtgcgttttaggctgtccagtgccgaatctcaccccctaagaggactgttgcacatgacacacccaaatagaaaaacattctccagggcggaggttttttaggtattcccacagcaaactaagaataccacattgtgatttcaaagctctaagcagatccgtcaaaagggggtgcgtggcagacgctcagtttaagcaaattgctgagagtcagaagggcagtgaagctggcagccactgtttcctttccagttttcagccgcttgccttgtctccagcaaagcttcactaagtaattttctgagaacaaaagagattgaaactttctcctcaaatcgcctggtgttgtcgaatactcctgttttgttttgttctgcttgtgctccctctcgtctcgttggtccactgtgataccgtgataaccatcggagggcggccattaagcggctttgcagtattctgaaaatcttttacagaagcagctgcttggtatttcgataacttgaccccactgttctcttggcttagctatggttttaaactttattgtaagtaaacattttaaagaaaaactgacgcttgttttcaaggaaaatcatacataaagaccaatgtgtaatgacggacaaaatgggtgctgctgtggttgaaaagatcaggaaaggtctggacttccacctacctgcaccactatcttcttcccctccccccgccttttttgagacagtctcactctgttgcccagactggagtgcaatggcacgatctcagcttactgcaacctccacctcccgggttcaagcaattctgtgcctcagcctcccgagtagctgggatcacaggtgtttgccaccatgcccgactaatttttgtaaagatgggatttcaccatattggccatgctggtctcaaactcctgaccttgagtgatctacctgcctcggccttccaaagtgatgggattataggcatgagccaccgtgcctggccttcttccccagtttgataacagttgaaaaccactgactgataaaattaataaagtccaaagtacttatttaaatgtgtaattttttttttttttttttttttttttggagacaggatctcacttctgtcacccaggctgaaatgcagtggcatgattatggctccatgcagcctccacttcttgggttcaggagattctcccacattaggctctttttttttttttttttttttttaagatgggagtctcactctgtcacccagattggagtacaatggcacaatctcagctcactgcaacctccgcctcctgggttcaagtgattctccttcctcagccttccgagtagctgggattacaggtgtccaccacaacacctggctaatttttgtatttcagtagagacaggatttcaccatgctgaccagtgtggtcttgaactcctgacctcaagtgatctgcccgcctcggcctcccaaagtgctgagattacaggcatgagccactgcccctagccgtcctcagcctcttgagtagctgtcactacaggcacgtgccaacaagcccggctaattttttctatttttggtagacacggggcctcgctgtgtctcgaactcctggactcaagcagtctgtctgcctcagcttcctagagtgctgggattacaggcatgaaccactgcgtccagcctaaatgtgtagttctatgtagaagaacaaagcagattgggctatgaaggttaaacaaaatgaattatgatggtgctgagagtcttcactcggcatacttcctgcctttccttgtggaacttctcagtatgaaaaataaacaaaatctcactcaagatttcttggtctccagcccagtactcttcctaatttattgtattatatttttttttatccatgaggacgttcacatatgccatcaagggatagataaatgttagtaagtcttgggagtcatgaagttgctctgttctgtgaaatcgcatagaactgatttctttagaatttctcttttgctaagtgccaagttccagttcccatcattgaaagacctaattgatttgctcatttcttccttctttatttattctttctttccctccctctctccctccctcccatctctccatccatccaattttgattgaatacctgccatgctggatgtcgaatatgatggtgaataagacagttatggtatctgcctaccctcacaaggcttaaatcccttaaaccaatgtgagataatatgaagggattctataaatgattgtagacctattaataataccgtaggtgtgcccactttgcatctgtcaccagcaccattgttaccacctatttctagcaacagaataaacctcctctttttatttcaacaaaatctcagcgtaagcttagtaaaactagggtgggtttaattgaagataaacagtctgattcgtgccattcagcataaagttcctctcatgatacctctaggtacctccttatcagcccaacttgaaagccaccaaccttggcctctgccgttggtctgacatggtgtcatattttgataatgtatgtagctattcttcatacacgctaatgtctcagtggtaaagacaactaggctaaatgtgtaaattcaggcctccagtcctcataaaccacagaaatggtaactggcagcttctttgtatcttttcagtgtctagttccagagctcgctgtctgtgagccactagaatgggacgagggaacccacttgctagggttttctccaactttatcccaaaacctatgtatctaaccttatgtgtcccagttgagatgccgaaaacaaaataatagcagaagtgaccccttcgtcccctgaaaaggagacaggacaaagaaatgtaaacacatgtttgattagagttgtttctgcaaaatttggttaacttgaaattatttaattatgcttcactccctgtggggacagggggaaattcccagcataatttgagactagtggcacttttgcttctggcagatttaaatgaggaaagtgactgcatgcatgcacatccgtggccacagtcttcatcagcccctttgtttgatttctctatttctcacggtggctctgctcccgtgatgcctgcgcacgtgatgcagcgacacttgcacagagccaggcccactcgtgttctcctttgaattgccggaaagcactccggttgcttttgtatggccacataggaaacagcctaatccttagaataaaattgatccctgggtttagagctcaagtttttaaagtttttcttcctacatacattgattcagctgcctgtgattcccttattacccctccatctcggtggatgtctcattctacttcctctcccctctgttctctcttctctagcactgttacccatttcctagtcaactcaaggccaaaaatgagatttttaaaagccagcagatattcagtaaactgataagatatgtagaaaggccagatatgatgggaattgtctagtagacgtattttatttggccatcgcagtgtttaaaggattattttctggaattgggatgactggactttgcaggtgcttgcccattttccagtcacccacctttgttgtctctcacactctgcttcacatgtttacatcactggcctgtctgtagagtcagtctggtccattgttgacttccgaggcttttccaatctgctttccttgggaatgttttttttttttttttttttttggagatagagtctcactctgtcgcccaggctggagcgcaacggtgtgatctcagctcactgcaacctccgcctcctgggttgaagcgtttctcctgcctccacctcccgagtaactgggactgcaggtgtgcgccaccatgcccagctaattttgcatttttagtagagacaggctttcaccacattggtcaggctggtctcaaactcctgacctcaggtgatccacccacctcggcctcccgaattgctgggattataggtgtgaaccaccacgcccggccttccttgggaatcttttgcgtgcaattagaattctagagtattggccaggcacagtggctcacgcctgtagtcccagcactttgggaggccaaggttggcggatcacgaggtcaggagatggagaccatcctggctaacatggtgaaacctcgtctctattaaaaatacaaaaagcctggcgtggtggcaagcgcctgtagtcccagctacttgggaggctgaggcaggagaatggtgtgaacccgggaggtggagcttgcagtgagccgggatcgcaccactgcactccagcctgggtgacagagcaagactccatcttgaaaaaaaagaattctagagtattataaaagactactactattgctattttgtaggtgtcccaatcaaatgagagagattcttaaagcacatgaaagatataaatacagcactcatttacagaaagcattttaggaaaattaagagttatagctgggaatgacatgatgccaaccaataaatcttaataattgacaaaagcattcagtacactgtgtataactatgtgaattttgtttgggaaattgattctggtttggagctttagcttgttcatagggttcttagagctataggatgacttgatagtgaggattttgtgtccctgttctcaggtgttagccttcctttccaattcttatacttgtttccatattacctgttttaccaagtacagccacacacatcagtatggatggatttcacaaacataccaggaagaactaatcatttggactatggacacgtctgcctttggggttcacctgacgaatagtgctgacattcttttaataaaattctctctttctccccccgccccgccccccaatttttcagcagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgaggtaaaacggagtgtctttttaccagcttagtagaatagatgtaacttgtggtttctctttacactggttgcttctgccccaacaggtcatcaaggtaagctttttgattattgtgcatgttgcatttgaaatctcagtaatgcttcctcttagtaaatagtgttaatatccatctttcagggatgtttttattttttaatggcttttggtctcttgaaacagcattccaggtacagaaagcaagaggggctgattaatgagaagtggttaagattccctagggctcactgaggcagtactttactctgcaggtaccattgcatggtgctggctccataaaatatttacacacagaagaacatctcttggccagacgtattataattactgcgtatcttattagccttgggctcgtttgatagcgtggagggaatgtctgcaagaataaccctgagagccctcagatgcttaatttctattttaaaaaatctgtttatttagtagaagtgacattattttagaaacgattaacagcataaatttctgctgtccctgaggaagaaatctggatgtttaaacaaagaattgaggcattaaaaaaatgtcattgtggtgtttattagtataaggatccccacagtgaacttttgtgaatcccgaaagcaaactgttcaagagaattagagttggagaaggtcacaattaagtaatgacttcttttgacccctgacacccaggcatttctgcccctttctgaccacagtccttggttctttgaacaagcccatcttcttttgccttgaggcatgagggcattagaactactgtggaagcttctttatctgtttgcaatagatatcacccttcctgtttttaaaagtagacaatgtcttatttcctaaatctttgattatgtacttgttcttctctgggaggtggtaagccttatattctcatcacattcctgctgttagagggctttggcctctcatttacccagcctggacctcagattctccaacttgaaagtgatgggctggggcagccataccctcattggtaggcaaggactttggtttacctgtgccatgccgtggtcatcaggcacatgcttcaggactgctgaaccccatatagggctttgttgcttatcactgggcagttttaacaactttttattgaagcataataattcctactccctgggcaatttttgttcagccttttgttcatcttgcattaggtgtgctgggggataaagatgaaccaacaccgtctcagccctcaaggagtttggtatggagaggagtcctcttcctgtccccacccagttggatcctgggattccccctgtaccacagtgggggcctcctagaagctgagccggccaggatcaatctctgttctcactaaggcacagacgtgctctccctttcttatttgtacaccttttctcttggcatctcagttggcaagaatctttctccattcctctattccaagcctataaccattttcatttccctattccaaacctttagccatcttcccagccagagagtgccctatagccagagaacaccagggtgtgaaggcaccatttggtgccagcattcatatgttacagacagggacactgaggttgtagagaggccagtgaccggtggcagctctgggcctagagctcagagttcctgaatcctcccagatcctaggtcagaggtcttctcacttagctcccctggctttgagatttcaacctgctctgcttcctcactgtcccagattggggagattggactgactttgagagacagtttttgtgccatgaatctccagtcctctgcatctggcagtggtgaagtcctttgtaaaggctgcctgcagaggcccaggcgggggtgtgtggactccaaggagggcatcctgaggcttacggagctcagagttgtatttctttgattaacacgttagccttttgtttccgtgatttgggcagaagtcttgggaagaatgcagcacaggtgggtgctggctctggggaaaactgccaggtagcagagtgcatctctccccttcctggagcccatttttgcctactctttcccctctctgtgcctgcatcgtaccccttgctaactactgcccagggcccctcccaggctcagaagggcacacccttggcacctcctgccctggagttcagtgttcccccccaacagccccgctgctcggcctcctcactgctcttaaaaatctgttgtggttttcagggtattttcctagacatcatttcatctgatcttctcaggagtctcctgaggcagaaaagtcagctggtatgttctccatttaaggaaagaggtaactgagactcaatgagttaagtgtccctcagctggggttagggtgggatgtatccagttccctgactccagaccccaggactctagagcccgaggactctgagaatctccaccttctatcagttccattcctctcttctgctgctcactgtaccatttgtattgacaaaggcttatccctccgtggaagctggttaaaggtgcatatttttagaagtttcagagacagggactcatatccagcactctcagaaagcaacagggcaaaagtcttcaggctgacctttcagttgttcccataatacacgtgtttctccccctacataaggtcctccgttaagtcaaagaaccaagcagatttaaaaggaaataaataagtcatagaggcaaagagttgagcagatagaagaggaataggagaactggggaaaagacttagcctgccacatacgctgatgtgcagaccctgtcaccaatattaaaccagaggcactaagagaaatcaaatatttacagtccagcctaatgccttaactctttactccccataaaacccttatgtggtcaggtgctgcagctcacgcctgtaatcccagctctttgggaggcctaggcaggagaatcacttgagaccaggagttgaggagcagcctggacaacatagcaagaccccatctctacaaaaaaaaaaagattttaaattagccaggtgtggtggtatgtgcctgtagcccaagctacttaggaggctgaggcaggaagatcacttgaacccagaaatttgaggctgcaggtgagctatgatcacaccatagcactccagcctggataacagggtaaaaccctgtctcttaaaacaaacaaacaaacaaaaaacacaccaaaatccttatgtatctggtactatagttgtctttctcattttacatttgacactgagagacagagaggttgaggagtttgggcaagacacacagctaatacatggtagagtcaagcttgagttcaggtctcctggcccctatttccaccccgaacttcacaatatcatatgtctgggaggcttggagactcttgaatccctttaactcaccctaagggaggctatgtcacatatggagccttctagaaaatgacctttcttaatatcattgtctcaggtgctaatgacagttgaagagaaatgattatttttctaacaccatttctttggttcctaaatagaatctatttcaaccaatttcaaagcatgagaagagagcaaaatcttaagggacagaagaagcttgtaatatgttgtgttagaaatgcatattttattcagcttttttctgagctggcttcaaaaaaaaaaaaagaatcaaataactaagtgctaaatctgttgactaggcttcacaaaagtttagaactgaaggcttccttacagtttgaaaattttacatttcacattccaaagttcacttgggaggtgttaagcgcagtggataatgtttccgctgcatatgccagcagtatttttgaaagtttataaactggccaggaagcatttgctgctgaaatttagcacgtggtgctcctccccgcccaaaccatttatttgttccaaattaccttgcagactgcttggatattgaattttagagagaacggagagccacacaaaatatttttatgaatatccattggcttgtggccaagtcttcccatcttttcaaatgaaggtgttttggtcttcctacagaagaaagtatggagaaggcgggtctgaagctcgagaaaatgaattgttgctcaaactgtggtttcctcttggtcctaaatcagcctgttcttatgaagtgctcacagcctcacgggcgtcatgagagcctaacccccccaggagggtgcccagtggaataccttaagcctgtgtattctcatatacatgtagaaataagatgacaacataaaagggccgttctgccgtcatttttctgaacttcttcactcagtcaagtaatcatgacattgagtgctggaaggaatcttggagcagggcctgttgaatgtgcaggccgtatttctcagccagtgagccgaggaatggtgccaggagaacctctggggatcacagaatgggatggggcctgggaacctttgcataagctctccaagtgatttacgctgagtaagtaggacagcaggtcctctaatgactatagcctccctatttttatttgcatgtcccttcctcaaaaattatttggcctcaccccattgtctccccagagctactgctcttaccccattgctttgaaagccctgtattctatcatgtcccattgtagtgttgttacctgtggtatgtcactttcccactaggaagctccttggtggccgggacctgttctcctcatcctgtgcacagggcccagtacatgacgacattcattaactatttgctgaatgaaaaaataaatcagctgcatagccaaggaagctgttagttgatctgttgcaatgacaaagccagccctagagccctcattctcctggccccctctacattgtagtttctgcattgcactgctgctcacagagactgatttaattgcacaaaccagtttactagtttgatttttttttaacttctctgaattatgtttgtgtgattaaaccataatgctgtaatcttctgatagggtgggcagatggcttgagcccaggactttctctactaaaaatacaaaatttagctggcatggtgatgcatgccctgtagtcccagcaacttgagaggctgaggtgagaggatcagttgagctcaggaggtggaggttgcagtgagatcatgccactgcactccagccttggtgacagagcaaggccctgtcttaaaaagaaagaaaaactgtacacatataaattgataaaacactcactgacattgcctgccgtagtccttggaattccaggttttctgccatttactatcaaggccacacttaatcaagggtcaagccttgacaaaatggcattgagagacatgattcgtaaccctttgtattccccaaactgctttttctttcgtggaaagactagatcgtaaggaaactcatttgcagggcaccctcgggcagccagtccctgtgctaagagctaacattctgaatctcactttgtctgcacattgatgggaggccttcttagtcctgtttgatatgggagggagttgaggtcaaagagcaagtaagaacagaggcagaatttgaaccccagcattccagcaggcaatgtgtctttattcattttctgatgcttataacagaatacctgaaactgggtaatttataaagataaggaatgtatttcttatggttatagaggctgaaaagtccaaggccgagagactgcatctgatgagggccttcttcctggtggggactctctgcagagccctgagtgggtgcagggcatgacatggtgagagagctgagcatgccagctcaggtctctcttcctcttctgataaagccaccagtcccactctcatgataacccatgaatccatgggtgaattaatccactcatgagggcagcgcctcttaaaggccccacctctgaatactgcaacattggtgtttaaatttcgatgcgagttttgtagtggacagacattcaaaccattgcattgtattagcttcagaacttctcaagtgcacacagagatgatatgattttagcttctgtcactgccactgtggaatgttttagtgcttttcctctctacccagttctcagcaggttcaaccctccactcttgccccctgctttgcattttgctaccacttcgtagagattttcttagcattgtagagaaagtcccctggtagggacatacccagcccctgagacttagtctttaagagcactctgttgatattgtcaaagaatcaactccattgttggcctttttccagctgaaagataatgcgtcatttttgtttgctatgtggaattgctttccaagaccccagaagagaaacatggaagaagaaaactctcagtagtcaaggttatatgatcggattccctccttactgggtccagcctcacacagcttccgtgtggtgctcaagggttttgaggagtgccataccccgggcattgggtcagtccccctagacacactgtctctgaggagctaaggctccaaggctctcccagaactgagcaggatcaagtaatcagagaaagggaggttgcagcctggacaaggtcaggacaagcaccaggagggtgtcccagctatgactgtggtaccagaatgtcactcagctgtgcaaggctttagctgcattgcctggagggttaccaggctcatggaagcttgttgctcatagaagatggtccctgttggtccgttaccacctctttccccatctttgtgtttgtcttacctgaggcatattgtccaacttgctttttccccttttaatgtttttctctttgtctctcctcttcctccttcatctctcccacccctacgggggtggatacagactttctgtagaaccaaagaatctctgttgggttgtgcttttttaaaaatttgttaactaaaaattattagcaaaacttattagccaaatatagaaaatattctctcttcttaattaaaaaagttagatgaatagaccatgtaattcttaaaatttaagacaaagtgactttgtctttcattgactttaattttttaaaaaagaaaaattatggtcacttatacattggagaaagtttgtcatatttgatgtaaatgaatagttgtaaatataggaggggaaaaaagatctttggcccagtcataacacatataatgccagtttccatttccttactgagttttgtgctaaaggatttccttaagagtgcccgtgttaagtttttgtaaaatcactatacagagcctttgtttatttaaatctgtaaaaggtgattgttggacatttgccatctaactcatgtttccataacatgagagctggattctgacagtcttaatactgtttttagcttttgctttacagatacccttatgtccaaagagtaaatgcattaaaaattttaaaaaccacacacacgcagagaactgttttaattaggtactgaagacttttctgagtacttgttttagaaaatactcttcttttactttctgtagcctcaacatatagggtcccttggggataatttctgaaattctttttgtgaggtaactttgtttttcttgtttctttataaatttctccacaaagacacaattatcttgggtcttcctaattcatcatctgattatccttttttaaagttcaacttaacaacaaatattgctcacatgtaaacagtgatgacaatttgaggccatataagcttgttttctttttgaaaaagaaattctagcttaaaattttattttgtacttgatatttcaggtcctcatctcacatccatattagtagccctacagtggtccaaaccgaaattggtcactggcccatctggaaatatgagaaaaattgggcatctttctctcaggaaaatgtacatgtacaaaaccccgcacccatttcaggggttcatagctcctccgagctaacaggttaagattgccctaggttattaattttctcttcataaagactgaacactgcttctgggggtagagtgaggggaaaggtaagggattgggcaacattcctgccctttattcattaagagaaattattttttaaaagtaaatatagtggtctaagttcccattttattttgaaaagctgcagtttaggtgcctagaccaaaaatgaaaatgacaccacatgtgcaatagtaataatgggtctaaatttgaagtgtctttgctctcagagaggcttgcagagtttggtaagtgcatgttgcaccaggcgccatggcttacgcctgtaatcccagcactttggaaggcctaagtgggaggatcacttgagctcaggagttcaagaccagcctgggtagcataatggaacccccatctcaacaaaaaagttttaaaaaattagccaggtgtagtagcatgcacctgaatagtcccagctactcaggaggccaaggcaggaggattgcttgagccaggaggtcaaggctacagtgagctgtgattgggccactgcactccagcctgggtgacagagtgagaccctgtctcaaaaaaatttttaaacaaaataaatgcatctttcgacgcacaagacatttaagcttagtttttttctgcttttagtggtttttaaaactgtatcaatgttgtgagtaaaagttatgggtcattattcacttctcattttcaaagaacttcagttgaaaagtgatttagctgaaaagttttgatggttgatttcttatacaaacagatttgcctaaccagtcagtaaagcaattcacaagactgtccctgagttttattagccttgcttgcttatttccccaaatcttagatgaaaaatacttgaatattcactaggcctagtagaaagaaaagacattttctcattgtctgaggtggatggagcagttgtttagatttggaaatcagttattgcaagagctctcgcaacaaagccaggcttcatgccttgcactataattacgtttagaaaatcatttcatgatcaagtattaatttgtgaagaagcttttgaagcaaaaaaaaaaaagtagagcttttatgaattagagaaatttatgttagactgtttagagttgttttttgttaggttaaatttccgccaagtgttgatgtcagtctgtgttcttcactaaccctctctccccatcattctcctttttttcttttaagtgaaaatatcttgacccccaacttttggggccctcagccatgggcattccctagtttccaaacaaacacggtacccgtccctcattccacccccaccaccagaaaacagttctgtttggtttatagggaggaaaatgattattatggaattaggtatgctagttattgaatacttggaattatattgtttgcttttaaaattaccttaaggaaataacttcactgtctgcttctaataatgtttagtcatttatttggtaagtaattaaagcaccatcactctcctgccctcgtcttcaggtgataatctagacatagagggagtgagccaacaagttgctgttagagttaacttgttccctaacccatcttgtgaatatcaatgctaacaacagtgtcttgtgttttttttttttcttttcttttctttttctttaaatcaatgtgcttttttcctatgtgaataattatatgtctagaaacagccatggagtgattttgctgttctgaatgggggaaagattaatagtgacatttggaaggcaagtatattgtcagatcttagatcatttaatattttatcctttctgcatggctgtggctgtatatttttcttctttgtgaatatcatgcattctgcagggacacagtgatcgggcttcttgctaggggcattcagctcacactcctgttgcctttttttggtgtctcccattgtgaatgccctaggttccccgttgttttgtaagaacaggagtttgcaccagtcagcattcaacagtccttgcatgcctttctctgcctaagctcacgtacactctctgcctcttgctgggaagacgtttctcccctttgatatttgaggcaatgaatggtcttctcccccattgtacattaacaaggttctattttcctctaggatttgcatgcagccactgttaacccggaccccagtttaaaagagtttgaaggagcaaccctacgctatgcatctttgaaactcaggtaggacattagtaggatcgacctgctgtcaatgtatggctttgtgcagatagtttgcaatagaattctaagtccacttttctgtttttctgcctagaaatgccccacaccctgatgatgatgattcttgtagtatcaacagtgacccagaagccaaggtttgtaaagacttgctttcagccaccaggttatattcttagatccaaataatgactttggatcattgtccagtttttacaaaccatcaacccagagccatttaataagtaattatccctcaattttctctttcctaatctccctgacacttgaagaaaacccctaggctaagttaggtttggggggatttctagaaccatcaagactctgcctgtatctcactacgtcagctctttgcacaatgtaataaattaccattattgttcaaatgggtgggctttagaagtctttaaagatacaccaggctctgccttgcaaagcaatgggagaggaagctaaacaggtagggtgtgagacccctcccacctaccgccaccagagcagcctcatatctgtgcaaggtgaaatctctttgccattcctgtcataaacacagattggataattaggttttatgatggaaaactgggggcagttggggcaaacttgtgtccattttgtttctggacttctggtaggttgctaacagagccagctttctgggcatgtggccagtgcagctgcacaggccccacaatgagaaggcccctgtgtgtggggatgaatgcttcaaggttgctgtcaggaaattcttaatctttgaatttgtatcttataagtcaagtccaatggaatgtccatgagagggctgggctttggattgcacacagtcctgccacctcccagcgtccctgtgcggttctcaccttctggccccccggcatctcaggccctgccagacctccctatctccctccctacgtagagacttctactgccctctaccgcggaagagacatgggtgtgagcacgggagggttggggtcaagtgcacactccctgggtatcttgggattggagcgtggtggtgaccagcccagtctgggctggcaacactgctgtgtgttccacaggcgactcagtgggggtgagcctcttgcctacccgcagtccaggcacctagcatgtcccaacactgatgttgcaatacatttatgggccacccatctgctgtgggttgagattgtggggccatgggaagagagggttcctggcttgatttacccgcccctgatcagtgcatggtgcatctgtccagcagctgatgggagagggtacccagaagccaatggtctgtgtgcaggtaccaagatatggacagggccctgagtgtttgtaagggtttgcacttacaagtatccccatgcctgagggattgtaacattaaatagcaattaaaaaacacattaacggccagatgtggtgccttacgcctgtaatcccagcacttttggaggccgagggcggcggatcacctgaggtcaggagttcaagcccagactggccaacatggtgaaaccccgtctctactaaaaatacaaaaattagccaggcttgttggcacatgcctgtaatcccagctactcagcaggctgaggcaggagaatcacttgaacccaggaggcagaggttgcagtgagctgagatcgcgccactgcactccagcctgggtgacagagcgagactccatctcgaaacaaaacaaaacaaaacatcttaacaagccaagagaaagcatacggaagaaaggaaaaacttttatgttttattattgtttgtagcgtcttccccctgctttttgaacggggcgggggcttgcattttcgttttgcatttttcatttacaagttatgcatctgatcttcggtgctaacaaccatggaattccaccttgtctacttcagcaccttcccctcccctccccttcaccctcctgtgccatggagagagaaagaatcttcccagattcttttttatttgttctgaatcccaaagcagatctgtgtctacaagtaacatcgcaaataggttttcttagtagcacttaagaggggaacaccatacaggttcaaaaccttgactcctttgccagaaactgccatattgccagttggttctgtaagtatcttagggcttgcagtgaaatctgtgctgcttctggtcaagtcagctttgttctgagcacagccagtaatatcatggccactctagagccagtggcattctgaacaagtccttgggctgcttctaacattgctggtctttaaagataaattttatggtaaggaacgcaggttgtgaacaatttgctttgctacttgatgttttacaaattctatcagcaaaggctggaagaggagcagtgaatatctctgtccaccactaagggctggggcagtgatgtatgtggagccagggtgtgaaattgacaagagggaaagcatggaatggagatggaattgtaataggaataggaggactggttccattaaatccaagtcagtgggttgggctttctctttttcccttccggctgtgttgcttactgaattctttatctgccacctttttattgccagcatgtctatttcaatgcctgttatgagtctgttcacgttagtaaggaagctcagctttgtcttacgttcctaaagctgtgcttagttttaaacaacaacaaaaaatacatgcattgtattattcatctgtgtcttactttgttccatagaagatgtgaggagacttctaagaacaaacactttaaaaaaaaaaaaagggcacagaaaatataagagaataatcagtgcatcagtctgggctggaataatatagagagtaaggaaagatcagcctagggagaatgaaaaacctacagcttttcagatctcaagatttgcacagctgctaacatggacctgcaggtggggttttctgtgtgtgcctcctggtgattatttaacctgaggatttttagcatgaatggaatgaatgcctagaagggctcatcagaatcttgaaaggacttttgcaagctggtacagtggcttgtgcctgtaatctcagcacttcgagagcccaggagtttgagaccagcctagcaacatagcaagaccttgtcgctacaaaaaaataaaaaaatagctgggtgtggtgtcccatgcctgtggtcccagctacctgggagaccgaggtgggaggagcctgggaggtaaaggccgcagtgagccataatcgaggcactgctgtccatgagaagtccatgagttcagagctgacttcagtgaagacacattggaggagcttccatcccctatcggagtcattcctgcctgttttgtgttgcctgggggccagagccagcacctcagagggaggagtggcaagacctaggctttctggatgttccagtgcctttgtagaataagttactcaccttacatgaccctttacattcttgcagtccaccaagaaccaaggaaccaagtggtcccctcccccgaaaaatcctgactttaaaaataatatttgggctgggcacagtggctcatgcctgtaatcccagcagtttgggagggtaaggcaggcagatcaagaggtcaagagatcgagaccatctgggctaacacagtgaaaccccgtctctactaaaaatacagaaaattagctgggcatggtggtgggcgcctgtagtcccaggtactcaggaggctgaggcaggagaatggtgtcaaccctggaggcggagcttgcagtgagccgagattgtgccactgcactccagcctgggcgacagagcgagactccgtctcaaaaaataaataaataaataaaaataatatttgatatactatggaattctaaatatagtctgtgaggaatgattacttaaaagttattatagaaaatatcttccttactccctacttaaaacttacatgctgaaaaaaataaaaattatttttagactgtcaggatggggacacttccaaatcctcttcagctactactctgaatctgggcaccttaatcagttgttcagtgaaacctctaaatagcaatggcaacacaaaatcaccacacacatacacacgcatacgcgcacgcgcacgcgcgcgcgcgcgcgcgcacacacacacacacacacacacacacacttccccaaagagcaaagtctttttctaactctgaaaatgttttttgaacctaccaaaatttttatgcagtaaagtctttgtacttgatagccatatatgtgtgtttgtatataattctgagtctcctgtttaactttttattttgaaataattacagatttgtagaaaagttgcaaatattgagttctcctagaccccttcacctaactttccctaatattaacttcttcataatcatggtacatcggtcaaaactaagacattaatattgatatcatattatttgctataaactttattcacattttctcattttttccactaataaccttaatctgttccaggacccagcctaggagactgtgttgcatgtagtgagctcttgaaaaattatttcacatgctcctctgtgtagtcctcggcctggtcactcctaattccatggtaatatttcatttaattaatagcaccgtaatctgtctaggcaccagtatccataggaggagtttttcccccactacagagcagagctacaacttcataaaaataggtgacttctttttcttttaaattattgctttggtataggttgctaaaactggtattactggggcaaaggctatcggttttattgcttctgtcacttattgcaaaattactttccagaaagcctgcagcagcatataatcccatcagtaatatcctagagtactcctctttgtccacgtatcagttcactctaggctttgtcatttgtatttattcatcttagtttattgtgtgtgagctactaccccctagttttaaaatttccccttattggcccagtgcggtggctcacggcctgtaatcccagcactctgggaggccacggcgggtggatcacgaggtcaggagatcgagaccatcctggctaacatggtgaaaccccatctctactaaaaatacaaacaattagctgggcatggtggtgggtgcctgtagtgccagctacttgggaggctgaggcaggagaatggcatgaacccaggagacagagcttgcagtgggctgagatcgcatcagcctgggcgacagagcaaggactctgtctcaaaaataaataaataaataatttccccttattaaattatcatagacacaggacatttcctctgaaactctctttctttccattcctggctgttttttcctcttatttttctatgcactttaaaagtaaatttttattcagaaataattttagatttacagcaaagttacaaagatagtacagagttctcatagccccttctccagatcgccgtcatgttgtatcctacagaatcacagtacaaacaaagaaattaacatcaatagaaaattattaataaacactgtattctgatttttaataaacactgtattctgattttaccagtttttcttctaatgcccttctctgttccaggatctaatctaggatgccatattgcattttagtctctatgcatgtattcattcgttcgttcattcattcattcattcgttcattttgagacgggagctcactctgtcatccaggctggagtgcagtggtgcgatctcggctcactgcaaccgccgccttctgggttcaagtgactctcctgcccctgcctgccgagtagctgggattagaggtgtacaccaccacacccagctaatttttttatttttagtagagacagggtttcaccatgttggccaggctgacctcgaattctgatctcaagtgatctatccgccttggcctctcaaagtgctgggattacaggcatgagccactgcacctggccacattttttttaaaattatttatttgagacagagtgtcgctcttcttgcccaggctggagtgcagtggtgcaatctcagctcactgcaacctctgcctcctggttcaatcgattctcctgcctcagcctcccaagtagctgggattacaggcatgtgtcaacacacctggctgattgtgtgtgtgtgtgtgtgtgtgtgtgtgtgtgtgtgtgtgttttctttagtagagatgttgtttcatcatgttggtcatgctggtcttgaactcctgacctcaggcgatcccactgcctcggcctcccaaagtgctgggattacaggcatgagccactgcgcccagtccccttaacttcagaactatctgcttctgtaatcttagacattttcttcagtcagttctttttctattttacgccacttttccatggaaaatgttttaaaactttctatatccaaggcttttgtagatgattgcccttcaggccgcatttgttaagaagacaactccttggcacgttttaggcggccaggtagcttgcacttctcaatccccatcacccgctgtgctcatgttactttaatatcttagatttggaatttagcccttttcccgtggcacatggctgaccaaattcttgattaacattcaaataaaaaccagttacaatcaaattgtagaaaacttaatgctttgaaatatatataccgttttgtcagagttcttttctgtcctttgtgtaactccgctcagacttctgtaaaggagatgttctgccacctggtggacaatattgaaaattacatctttaaagaagaggggctgggcgcggtggctcatgctttaagtaatcccagcacctagggaggctcaggcaggcagatctcttgagcccaggagttcgagaccagcctgggcaacatggtgaaaccctgtctctacaaaaaatgcaaatattagcctaacgtggtggcatgcgtctgtagtcccagctactcgggaggctgaggtgggaagatcactcgagcccaaggaggtcgaggctacagtgagccatgatcggccactgcacttcagcctgggtgacagagtgagaccctgtctctaaaaaaaagaggggcaacatttcatctggaatcagaatttcttttgcttggaagtaacattagagcccatctaatgggcctttattttagaggtgagaaaaatgagtcatagagttatttgtgataacaactagttcttggtggagatggcatttgaagatgggtcttctgggcctctgaccgctccatcctgctgtctctgtctcagtgtataacacgtcattttcaatatatttgtcaggagaggtttttggtactgtttttagaaccttgttctttgaaacacataattaaggaaacgggtaaggaagattgtgctgccccagagattaaattttctgggtttcagcgtcctcatctttcaaatgaatgtgtcatcaaattagaagtcatttcaggttctgagaaaatttcagatttcaaatgaaatgtagtagccctgatctgtggcatctggagatgaaatagtctgatctgtatttaagtctggagaaggaaagagagagcgccatgaaccagggctggctcttctttcctgaacactcactgtgtgtgtgccctcccctctgccaggcacttacgtgcaattttcctgcaaaaacaaggcattatagttatgtttccatattgtagataagaaaccgatgcttagaagacgtcaatttatcacacagctagtaactaatggaacagggactcaaacacagatgcatttgattccaaaggccaggaaagtgtcacgcccacctgttcccagttatcgcttctctcagctttaagatcattttggggccaggcgtggcggatcacctgaggtcaagatttcgagactagcctggccaacatgacggaactcttgtacctactaaagacacaaaaattagctgggcgtggtggcacatgcctgtcatcccagctgcttgggaggctgaggcaggagaattgcttgaccctggcaggcggaggcagaggttgcagtgaaccaagatcgcgccaccgcatgccagcctgggcaacagagcaagactccatctcaaaaaaaaaaaaatcattttggcaatttgggattggagtagcagagttgttggaggtgggaatgggtgaaggaattggaaggtcagtgcttgaggacagactccttctcaccctcatccagacttgtggtccaatcctttgcggtgcttttcacacgttactgtacctgtgggcaaattctgattcatttgctctggggtgggacatgaaattgcatttctgttaagtttgcaggtgataccaatactgccagtctacaaacaacacagagtaataacattatacagttggaaacatgataaaaagaaggcaccaattttgtgcagcttctgcagcgaagtagacatagtctttctatgcagtatcttctagttcttttatggccatttgcaaccagttcgcagctgctcaggaactttttttattggcactggattttgtgaaagctttgtgtgcctccttactcttttgttataacttacctcagatggagaggaagaggaaggagatgaaacaaaccatcgggtagtaggtttgacggagctttctgaactgaatggcgaatggacatgagattccaatattcatctgtgagctttatttatctgtgccctcccttggttcctattagcatagattttcatgaagtaattatattagcagctactgactagattagcactaatagataagcaggaagtagtagggaagtaccttttctcattcagatttatttctggtctgtgtagcaaattcattgtcattacttagcatttatatgggatgttacagctgcatgtagttcttataattgatttttattcacgtggtacaggtttctttcagaaatcctgatctgtgtggaagtttgggtttgatttgcactgttgattcattcattgagtcagagacgtttattgaatgctaagtgcgaaaggagcatacatacttaatgtatggtgtggttaagagcatggactctggacccagactgcccgggtttaaagccaggctctgctgcttaccagctggatgaccttgggcaagttacctaccccctctgtgcctcagtttcttcatctgcaaaatgagggtaatgatggagccaacctcacatggctgttataaacattgaattgacatactataaacactataaatatacatgtaaaggtcttggaacagtccttagcacataataagcattctttatgcattcgccattatactgttcctactaccagaaggaatggatatggcccctgccttcaagtaatggagaagaaacaagcaaattcaatgcactgtaccaggagctgagctactgagtcacgaatgggggttgttccgggggcatattccatggctggttgaaaggggtggctcgggtggtttcccagaaggagacgataccttagctaataagtatatttgaattgtcactggagttagtgattccctctccccccgccaccatacttttcaaaaaatgtaagtgtggaagctttgaaaatgatttgatatgtaaatttgtgttcattttcagcaaatgcttttaggaacagatctgttaagatgaggtccatctgtatttgcccaatactgtggataacattgtttctgttatctgttcctgcgtgctatgtagcaaactgcaccaaaacttcgtagcttaaaacaattatttattttgctcaggatttagtgggttccagagtctggggagggtttggcggtgcagttcctgcctgatccacatgggggcggccggagctggaggatcctcttcaaagatggcttcttctccaacctgcttcctggctcagtgctcctcctcacgtcctccagggcctctccatgtggcttggtcttctcatggtgtggtctctgggtaggcagttgtactttttacctggtgtccagcttctaagaagcaggaaggtgaagccaccaggtgaggaaaggctcttcttggcaatggcagcatgtcacttccaccgtattctgttgttcagagttgtcagactccacttcttgatgagacgtggcaagttcacgttacaaggagcgcataggacgggaggttttaatgcagccatctttgggaggtacaatctgccaaacatgtcattcccacatttcagtcattcaaaattagtgccttcagtacagggcagaaaatagcaacatggttgaatcacgaaaccaaggtccagagccagtgatggatatatcaagtcctggctgaatgagattcagcctctcatgcatggcttttaggttggcattcacaaggggaaaataaggatcatctcattccagccttaggaaaagcagaaggcgcagagaaagtaacctgcccaagcttgcacagctggtcgtggcagagcaggacccgaagccaggctccctgacccttgtccatcctgcttttccgttgagtggtgcagacactcactgccattggccttggctgctcattttgcctcctatcccggaggacagcttttgtgtttctaaaactgttttcctccctttatttgccaactcggccaagcataatgccgtgttcctggcagaagcacggtgttatttcccttattaacttctggtcactacacttgcctgaatgagcggtcgaggaattggcagccgtgtgtgagtccccgagttttgaagggtgctgttgaaacaagatgcattgttgtctaactcttggcagctgcgccctctgatgggcagatgcctggaaaagctaatgaaggaaaggcagacttccctcttcccctgaaggaatgaggtaggaaacaggtgaggaaatgggcaccagccagccgcggtggcagcagccgccatcctgatggcaccagagcggcaggtgtgtgaacctggcctggtgggttcttggcacagaattttgggccatgaataatcacagaactgaacagcctcgggcaggagtagccatgggacatccattcagcaggtctgggtgctccaggaaggccagctggtcgagacctgggggtcctgaagctggcattccaaggccatctggaaaagagccagcacgtctcagaacttgttctctcaggcttgctgcctgagagcttaatgccagatactggtatttagatagtgatgaaaacatttctgctttatttgcagtttaaaaattgatggagaggctgggcacgaccgtggctcacgcctgtaatcccagcactttgggaggccgaggcgggcggatcacaaggtcaggagatcgagaccatcttggctaacacggtgaaaccccgtctctactaaaaatacaaaaaattagccgggcgcggtggcgggcgcctgtagtcccagctactcgggaggctgaggcaggagaatggcgtgaacctgggagggcggagcttgcagtgagccaagattgtgccactgcaatccggcctgggctaaagagcgggactccgtctcaaaaaaaaaaaaagaaaaaaattgatggagaactgatggtttttcctacagaacaattagattaattcagatgctggctgggtgcagtggctcatgcctgtaatcccagcactttgggaggccgagcggggtggatcctttgagctcaggagttcaagaccagcctggccaacatagtgagcccccttctataaaaaaaaaaaaaaatacaaaatttagctggatgtggtagaatacacctggagtcccagctactcaggaggctgacgtgggaagacgacttgagcctgggaggcagaggttgcacagagccgagattgcgccactgcactccagcctggccaacagaaccagatcctatctcaaaaaataagtaaataaataattcagatgccaagccatttctagctaagccacaatactttgtcacttataggattcctatttaaaatctcatccaattgtgaggccctatagctaagtcacaaagatcaaggtctgagttctccctctgcttctgactcgtgcttataagaaaatcatttcagtagtcagccttccacattttcagactctaaactgacaccaagagtggcagctctcaacagcagtctgcagtagattcatctgttcactcggcatgtatgtattcaatagctagtacatacatagcagggtagtagatcagtcagactggggaaggaaacaaaataatgcagcagagacaatgctaatatcatttaagaatgacaattacagtgctgctggaattgaagaagtagcttgcaactgcactgcaagttggatttctgttgcttcatgttgaagcagttcggttagatgagttcactaagccctaacacataaataatttcacttagctttaggagaccctcagactaatgatcgcttcatgaaaggtgtatttagttgttgaatccacacattcctaccccagatctctagccagacatgcttagttccccctctgttgttggcaccaataggatatgtgtccctttcgatccatgatggtctcattctctcggcagacacgctgctcaggaaggggcagaaaggtctccaccagggtcccacttttctgccccagccacattaccaatggtcaggttgaactgcaagcgacccttgtctctagcaaagctggaaaatggacccgtgtaaatgacacatggaacccagagccgaaagcatgtgatttctcaaaaagtgcttctcctgagagccatgcttttttcagttacgagctcagatgagattgcaacctagagcgtatttgtagaaagtacttagtttttttctcctcttcaccaatgcagtgggccagtgtcactaaataaataaagcaaaatgctacatcaggctcatctcttctcttcagatattcttatgcatctcaccgtgttttggttgagagctagaaacaatggaatgaatgggcatccagtgtcgaccttcatcatttggcaagagtagaggatggatggagaaggaaatgaacatttcttcaggtccagccgtgtgctggtcgctctgcatgcatctgtctgattctcagaaccaccatgcaggggagatgaagttattattcccattgtacaaacgaagaaactgggattccgagaacctaaacaacttccttaaaatcacacatatattatgtgggtgaactgaaatttgaacccaaggaggcaggctctaaggcctgtgttcttccccgtagtacaataatgattatgttagccgatgttcatagagcatttagcatgtatgggcacaaatacaaaaaggtggtgtgaggccattatggacaagttcagttttctgtctttcagttttatcaccacttctggaaatgctgccacgagcctcacagtgctctgttctcccacaagccttgtgagggtctcttattttgagttgagggagccgaggcacagagggttcggtggcttgatcactgttccactgctaaatggcagagctgagatttgaacccaggcagtctggttccagagtccaagcttttcattgctgggctacccttcctctcagtgtaggtcagcccgtccctggccttgttttttgttttgtgtttatgagatggagttttgctgtttttgcccaggctggagtgcaatggtgtgatctcggctcacagcaaccaccgcctcccagattcaagtgattctcctgcctcagcctcctgactagctgggattacaggtgcatgccaccatgcccagctaattttatatttttagtagagatgaagtttcaccatgttggccaggctggtctcgaaccactgacctcaggtgatccacctgcctcggcctcccaaagtgctgggattacaggcatgagccactgcgtccagcccggccctgccctgccctttaaagcctgcatttggtttggtcccctgattccctgtggggttgttgtggtgggagttctgttccttaagctcaggttcacctaaagacatgtaactgttttaaagatggagaggtaagagaaaatgcagttttgtgtatgtgtgtggtttgtgtttgtgtgttattagtctgttctgatgctgctaataaagacatacacgagactgggtaatttataaaggaaaagaggtttaatggactcactgttccacatggctggggagacctcacaatgatggcagaaggcgaaaggcacatcttacatggcagcaggaaagagagagggtgtgcaggggaacttcctttataaaaccatcagatctcgtgaaacttactcactatcatgagaacagcatgggaaagatccgcccccatgattcagttacctcccaccatgtccctcccatgatacgtgggaattataggagctacaattcaagatgagatttgggtggggacacagccaaaccatattaatgacatacccgagcagttgactcccagtgaatgacaaaagaggaaaaaacagccagagaatctttgtccccagtgcagggccgtggtacaagtggaaagatgatgaagcaggagcagcaatacctgggttctagccccctactgtcagcaatgagccgtgtggctaaacctctctggacttcgcttctctcatctgtaaaatgggatgacgctattgcctagtctgggaacctcacagtgttgctgcgaagatgaaacaagacgtgttgtagagatgctttgataatctacagcctactctaaacatcaagtataatttttgtcttccaaaactgtcctcaaaatattttcatgtaatgggtcccagcagtcctgccagtcggggtgagttagccgtttgggcggctgtgtggacagagtcacctagaggcaatgtggggcttagcccagtcccaagtgtgtaccatttctaaggccacctcattctctgagcctgggaatcatgatgttagcagtgttttacagtatgtcatagcttaaattaagcagcatggatttctttttttccagagaaatttaaagtgggaaatgtctggcaataaactggttattaatgaggatgcattaaaatgtagatagcacctgatgacgtgagaaatgcacctgatgatgtgagaaagttttcacgtaacttccagataggtgaccgtgaggacatgtgtaaagaagttcctatatgttaatgggggtgtttgtcgcctcctcttatggacaaaacaagccttgaaacaatttttcactggttatatttagtaagtgcatgtgcgtgcctgtgtagattttttacttaacgtagaatgaattactgtccctttttctttactctggagcacatttacgtaaagcacttgccagttcagacttatttagtggttcagccacaatggaaaggatgcctcttgagtttatcttaccagccttcctttccttgtacccctggtgaaagcccagtctgttctcaacctccagaggcctgcttgaaaagacttcagctttagtcacaggggttttatactagctaaaaaagaaaaagaaaaagaaactcacctcaaggctctatataaatgtaaaaatggaaattgcagccaggcatggtggcttatgcctgtaatcccagcactctgggaggccgaggtgggagcattgcttgagcccaggagtttgagacctgcctgaacatagtgagaccctgtctctgttaaaaaaaacaaaaacaaacaaacaaaaaaaaaaacagagaaaaaataaggaaggagggagggagggagggaggaaggaaggaaggaaggaagtcgtccgaaagaaggaaggaaggaaggaaaaagaaagaaagctgcccccattttacaggaaaacatagctcctttgcatgctccttgagttcctctgctgcttctccccccagtgttcgtgttgttattgagagagtgacaaggactgccaaaaatggggattgccacagaatctggcctgctgccattaacggcattaaagcactcttactgtccaagagataggctgtgggtaaatagtgtagtgcctataaaacattttcccccaaatcttttaacttaaaaagttaatactggggacaaaattgacacagatagctcagaggttccccagtggcactcaagcatgtgttggtgtggcattgcctgcaaaacaccttcacattcctatggagttctttgtgggcctctctctttgaaagatgtctgtagagatgagcttggccagtgctcagtaactgtgtactagccagtgtggggatgtgctagttcaagctagtccctttcccactagattaagctgcatagaattatgatagagtggtttggccagcactgggatacgtcacattgtaaataagtgaaaatattcataatattgtgttctgttttatgtgctaaagtgtgaactgccatcctctccttcaaaagcaatgtgagaaatgggaagctgtattgcattgtcatggaataagtttcacagagattgcgttttgcatgtggaattataacctagatacagaataaacctgagtctctggtccattcatctctgttaaaacaagaaggttcatagggagagttaactgatcactctgtttttaaacctttgccctgtggataaaaagcacacagcacccttggtagaggattccttgttttaacatctctttttcttaagaagttcaccattactgttctgcaaatactcctcatcattccaaagcttctacttctttgatatcctgtagaagggcaactcttggttgatattttcccaactcattcaaatactttaagataacccattccctctctgataaaattgacctcaactccctctacctttataattcacagaactcatgttgctttaattatttttggtgtttttttctctggatagtctaaattttctcattggatgaaaaaaattcattgagagatcttaagtactggttatctgcttagcacttacctaggtattgtgggatatgaaaaaaatacacatggggaccctgacctcagtggcttgtcaggggaccgtagcaggtggtgggatgagtactgtggacagaggaccccactgttcacccgtctctgctgcttccagcccgggagaccttgggcaagtcacttccctttctttgatgggcctcatccatcaagctgaagacaagaaatcttggagttcagctctaaaagccaggttctggggctagctggggagctggagttcacttagagaatagcagaatatgaaggtgaagagatgagctaccatctgcagttggagttcagatttgggatcaataaacttctgcagggcctcaaatcactagacccaccccaggtccattcagaagacagtcccagttgtcccacaggtggcagtaatgagccgcagtcaacacagcacaggagttgccgccctgacttgaccctgagtgagagccctggccacttgaggaagcctgcagaagtctgcggtgcagcagagcccagggacgtggtatcatggcctgcaggctgtgtaggctgcatgatacgaagtcctcccctcttccctctgaccttccccaccacagactccacactcaggtctcccgttcactgcatacttctgccccgtcaccatctcaaggcttcacaacaggatctcacctgcggttgcttctcttggaattttgggaatccattgcctcgcaacatcctctgggtccctccttgtttttgtgtgatcaccagggtcggtcagtcatgctcgctctcagaatagtttctagtttctggacctcctgggcttccttcagtttctccctgtctgtctttcctggtggccacgtacacacagggtaagacatgattgcacagagacacgggtatgttacctacttggaacaaaatccaaccacataagtctacatgggccaaattgtttctttcaaagggaaacatatcttcttgcattttgaaaatcgcagctcagccaatactgaggaacagttgccaatctccatgtgcagaacgggtgggaagtgactatcttaggaacatgacacatgcttctggaacaggcttgccaatgacagcatccactttttgccttcttgtgagcagaagccacaagggagcacttcattctgtctgtctgtctgtctgtctgtcttcaggtctagcctgagagatgtctcctcctcagataccttctcagctctggggttaggtttctagccttaattccagtctgtggctgactgtggtctcctttttcatgtctcagctctgtgcacatacattcctccccgtaggaattcatcatatctaatttacagcaaattctttagaacaactacctaaaatgttttctcttctgcaattaccatgcctatcttggcagagagtttctttgtatttacttcacctttgcattacacactgagttccagtcggtcagggaccatttccctgagtgttgggcagttaccaaagaaactctttaaagacagacttcactcacacagggcccaggaccctgcagtgccagctccactccctcaaggcagagcttccttcttattagtcacaactctggctaatgctctcaggacttggatttactcattcgtgaaatgagatggccgggttccggggtcccagagcccttgtgttctgggtctccatgctgtggttaaatgctcctcccccgagagcacagtgcagaatcccaggagtcagcctggagagctcagacttcataaatcttctctctggggttgggaacagccgtgcttttaattgaagtctttgtaggtctttgcacgttatgaactcactgagttcatttcagacactttgcaaaaagttgcagacttttcatttcttggtgactggtacagtaaaacctttcttagaaaacaacagtgaaaagtgaaattagccctgaagatagttatcagtaacttttactgagtaccaggtattgttttaaggccaacttcgcagatatacattcatttaacactcactaggatcaggctctgcgctccggggctgaggatactgcagaccaagtccctgcctttgtgtaacgtacattccagggtgtggagagagaaccacacaagtggaataaaagtacatcaggtgaaaagacttactatggagaaaaacagcagggaagagtgtgagcgagtgccaggaggagtagcagctttaagtaatcagggaggcttcccagaaggtgacactgagtacgagatgagagagggaagcaggtagattgggagggtggggggagcccatggtgatgagtccttagtggatgaaggattggcctggaggccactgtgcctttaagccaaaggaataaccagtggggacaagagtcggataaagtgtttgagaggtatttcacagcaggcaatgtcctgagttatcttttagcccaaacccttctccctcctcaactgcccccttcccctctcttgtcagatgactaaaatgaggtctgagtaaatcaggtgacatcctgaaggttctagtcagtagcagaactaggacaaaaacccagggactcatggtttctagtgcctgcaactcactacaccaaaatctagaaagcttaagagtaattaagcaccaccccccaccctgctatcctatgcccctccattcttgctctgtgaagaaggacagatactgctgattctcatcatttgcggcaattgaattctataaagtcaccagcaacactgaattagtgaatactgaagcattgctcctagaggaaatacagagttaggttcctgcaagcctctggtcacaacattttcatcacctgatcagtatctagccttgttttatgtgtttccatttatttgtttatctatctgtctgtctgtctatctacctatgtatttatttgttgagatggagtttcactcttgttgcccaggctggagtgcaatggcgcgatgtcggctcactgcaacccccgcctcctgggttcaagcagttctcctgcctcagcctccggagtagctgggactacaggcgtgagccactgcacccggatgatttttatttttttgtttttttgatttttttgagatggagtctcgctctgtcacccaggccagagtgcagtggtgtgatctcggctccctgcaaactccgcctcccgggttcacgccattctcctgcctcggcctcccaagtagctgggactataggcgcctgccaccatgcctggctaatttttttttgtatttttagtagagacagggtttcaccgtgttagccaggatggtcttgatctcctgacctcgtgatacgcccacctcagcctcccaaagtgctgggattacaggtgtgagccaccttgcctggccaatttttgtatttttagtagagatggggtttcaccgtgttggccaggctggtctcaaactcctgacctcaggtggtccgcccatctcagcgtcccaaggtgctgagattacaggcatgagccaccacacccagcccccttatttagtgtatgttattgatccgttgaccttcaactcatggccaccagcaccataactcacccctgaatgacttacctaacataagtatttctccataaggcacctcatagccttctcgcacttaaaagcactttagcactgttctcgggagccatgttaaacagcaaaatcactgctaaagggcacgaaaatgtgaaaaaagtggtactaaatggatcgcaaaaaggacacctctttacagtataagaactgaaacaagataggggaatgtcacttagctcaacctcagctaggaacatgtgcattgggcaactcaagtgttttgccaccctgtacatgtccacaaatgaccgcaaaagcaccaggagtatggactttggggttacaaataaactttagcaagtaggtgaacttgcagatatggaatctgcacatgatggggatggagtgtatttgcacttgagctattcggaggaaggactttattcaaggctcagtggcattattccgagtggactcatgtgcaaaggcacattttagggtagagagtaccaaactagttctgaattgcctcagattccgcctagggagcatgcttacggcaaacagttgttaaaaaccatacacttgtttatttatttgagaattacattttccatattgcaaatatacctgttactatttgagactgaactgtgtaacttcaccattggcccacagcgtcccagctctgaccccccagactggcgggtacagcctgactgctgactgcaggctgtctctgctcctttcttaggatcagcgtttcccctagagctcacgtggcctagagctcatttcccagcgaaatgcaatgttccacttcatgtgcacagtttggtgtgcattccgattttcctctgtgcttactctgcaaataacgtttctcagctttgcagcagcagaaacgtaatctgtagtgtaaatcagccatgcggacctcaggacttgctttccaatcttttccaagactcctgcaggggaaaactaaaataccactcacactttcagggagtaagaatggtttcccagtagcgcagacatctgctgcgtatcagcaggaatagaagcgggattctgccagccgagcttcttggcctcgacttccatgggcccttactcagactccgagaaggtgggatgtgaatctcatgtttactgccacacactcagatttgcttggcatttgagcatctccagcagcagatttgatgaagttcccttttgtgtaacgtgttcactgttcctccaggggaatttccacagtcactctcagagcattcttagagatacttttgcaataactgagctgtcctttttttttttttttatgagaaggaatcttgctctgtcagccaggctggagtgcagtggcacgatctcagctcactgcaacctgtgcctcccaggttcaagcagttctcctgctgcagcctcctgagtatctgggattacaggcgcctgccaccacacccagctgatttttgtatttttagtagagacggagttacaccatgttggccaggctggtctcgaactcctgacctggtgatccgcccgccttggcctcccaaagtgctgggattacaggcgtgagccaccgtgcccagccattgagctgtctttgtaggccttaggctgcggtgggttaggggtatctaagaagcattgtgattgggagtgtggctatggggatttgacagcagccctatgtcagactgccaggggttggatttaagatgtctttccacaggttcccatcccactcttccataagacaatctctatttcctattaaataaaaaagagtattttgcaaaagcatttggctttttgaacaaactaaatattattgcattctgtgcttgtcccgtatcgctgagtgcaggaatagtccaaaccatactctccaaagcttctgcaggcctgttccatgtctagccggtccgatttaatgagcaggcctttgcagcatcccagtgctctgaagctcaaagtctgtgtaggggcagagggaggagggaggtgatgtcatgacaatgagttatctagatcccactggtacctagagaagaaattagcacaaagctctgcatggaggctcggctccagcacaggaatccgtgtccccctaggtgttggtctgggaccagctggaggcccacttatgaggactgcagacacattaagagctcaggatgcacctctgttgaggtgtcccaggacccttggatatgggctccagtctgcaggttccaggccccagcagcttatgatggcgctcctgataagccagacatggattggattgggcagagtaagcccacaggaagaactggccctgtggcctacagtgtaagacacctggagttggacatgttacctgactctaggtcccccgactgaatcgatattttatatgacttttatatcactaggcatggcttagatcaggatttattgataatttagagctaatcataataaaggttgacacattgtatgcttaccaggtaccattgtgagcactttatacacatgataccatttagtgctcccaacattccttagaacataagcacagtcatcccccagtacatgcggaggattgatgccaggacccccgagtataccagatccacgcatactcaagtctcacagttgtccctgaggagcccacggattcgagaagtcaaccctctatgaattctgcatcctgcaaatactctattttcaatctgcatttgcttgacaaaaatctgtgtggacctacacagtccaaataatccatgttgttcaagggtcaaccctatgtctgtcgtttccatgttagaaaagccaagacacaggggaaggtcagcaacttgccgtgtgtcatacaggaattaagtagggagctgagattcaaactgcaatctctggcttcagagtccaggctgtgtacaattttactattattccaataaaaacaactgcttcccataggctgtgctgggctggttgccagggttcacagccccttgaatccacagcagtgcctgcaaaggcaagattatccctccggtgatgcagatgaggaaactaaggacgatgaatgtgctgaaggcacaaatagggagtggtagtccaggactgccagtcaggtctggcctagccttgccatgatatttcagtctgtctcaagctcgagtgtcttcatctgacaagtatttcttgagcatgtggcacatccggggccacttttgggtggtgggtatacagaggtccacagaacaggcctgatctcaaggatccccctttagattgagcatttctgctaatagaacagctaatgtagagcagagaatggggaatcaagactagggctgggagctgggcccagtggctcatgcctgtaatcctagcactttgggagactggagcaggtggatctgttgagcccaggagttgaagaccagcctgggtagcacagtgagaccccgtctctacaaaaaaagaaaaaattagccgggtatggtagtgcgtagcctgtagtcccagctactcgggaggctgaggttggaggatcacttgagcccagaagattgaggctgcaatgagccatgatcttaccactgcactccaacctgggcaacaaagcaagacccctctctaaaaattaaaaaaaagactagtgcactttaggaggccgaggcggcggatcacctgaagtcaggagttcgaggccagcctggccaacatggtaaaaccctgtctctactaaaattacaaaaaaaaaaaaaaaaaattagccaggcatggtggtgggtgcctgtaatccccgctactagggaggatgcggcaggagaccatcacttgaaactgggagacagaggttgcggtgaacctcagatcaaatctagctctgctgtttatttacattgtgacattagacaattcaactaagttccctgaacctcagtttctcatttagaaaataagaaatacagcacctactttgtagtgttgttgtgaaaacatgttgtgctacatgttgtaaagcatgcagcttgtggcaagtgatgtgtaaatgtcagcgcccaccttcatgctttccctgccaagaccagacttgtatataaaacactcagcacagagtgagccctcgataaatagtcactgctagtatcatgatgattataagtgattatcagattacatatgtctaatgagatatgcctgcaagttcatctttaagtaaacatacacttaatttgttccatgacattctggaaacattgtgctacgtctctcggttgaacccacctctgctcaaattttccattgataaaaataggactcataatgccagcctggttcctgggcaggaaatgactaatgcaattaactgtttctgtactaaatcacaacccggaggcgtgtctctggcatgagtgaagaatcgtcaagaatcctggctgttaggatgctgattgtcaggttcctctgcctgcatcgttgtttgtcagcctgcagtggcctggggattgaaaactggagtgggtttcctgcagagagcaaaccctttcattagccaacctgaacatgcagtcgactgacacttggcgtttctctccgtaaattaataagttggcatttctggttgatatttttagatttgtatgacttgttcataacgtgctgatgattgaacctgctcagcaggttaatgagagtcgctgtggggcaggcattgcaaataatggtgattgcatggtgcaccggcctttctttagtagcagaagcccttctgtgtaagggcaagagcagggccactgtgacaggggaggcccagaggcctcagccccacactgggctcctctgcaggttgcccctggacctaagagtgctacacctctggaaaacagtgtggagagcagtgctgtggcctggagggaggaggacgcagctagcaggcagttagtcggttccctgggcatttcctttgcctccataggcctccttgcctccagtgatctgttagcaggtgttgggtgatggtgccccctagtggacagtttgcacaagggcacccacactacctcagggcttttggttcctgcagtggcgggctcccccattgtcggctctgaggtacttctgagaagcctcgggaccagcccaaagctataaacgtagagctggtgggctttgaagtactcactccccattgagggattattttcttctcctcagggtactcctaggaggccttgaattcttcggggcctctttagagtggggctggcctccctgggctccggtgccagccgggtgtagctactgggtgcacccaagattgtgaggaggggaggaggcgtgttgtgcacacgtgtatggggtgagaggcattataggtgtggcctggggatgccggcctccctctctccgtcaggaaagccagcattgttgccgcacctaggaggcagcaaggcgcggtgacaggaatgtgtcaggacacaaactcaggcttcactgccagctctgccatatgctcatggttacctgaagtgtatacaccaccgtgtgtttgttggctggggctgccataacaaaataccacagacgaggtggcttcaactacagaaacgttcttttctcacagttatggaggctgggagcccaaggtcactgtgaaagcaggtttggcttcccctggggccgctctcccgggtttgtgctggccgcctttttgttctgtccttacatggcctattctctgtgtgggcgcctccctgctgtctcttcctcctcttataaggataccacacacacacacagacacatacacacacacatatgccacacacacaccacacacacccacaccatacacatatgccacacacacacaccacatacacatacacacatacacacacacacaccacacagacacacacctgggcacagtggctcacgcctgtaatcccagcactttgggaggccaaggtgagcaaatggcttgagcccaggagttccagaccagcctgggcaacatggtgaaactccatttctacaaaaaaaaaacccacctttttttaattagcaggcatggtggtgcacacttgtagtcccgtctactcaggggaggctgagcccaaaaggtgaaggctgcagtgagctaagatcgcgccatttcaccctagcctggaaaacagagcaagaccctgtctcaaaaaaaaaaaaaaaaaaaaagggtcaggcacagtggctcacacctgtaatcccatcattttgggaggccaaggtgggcagatcacctgaggtcaggaattcaagaccagcctaaccaacagggcgaaaccccatctctactaaaaatacaaaaatcagccaggcttggtagcacacacctgtaatcccagctacttgggaggctgagacaggatcattgcttgaactcaggaggcggaggttgtagtgagccactgcactccagcctgggtgacagagtgagactctgtctaaaaaaaaaaaaaaaaaaaaatatatatatatatatatatatatatatatatgtaatatattaaattaaattaaataaagcatatcagtcctattggagtagagccccattgttagagctcatttaacttaattactgcattaaagaccctttctccaaatacagtcacattgggggttaggacttaagcataggaattggggaggggacacgattcagtcttaacaactaccctgtacctcagtttcctcatctgtgaaatggcaataataatatctgcctcatgtgttgatatgtggattaagttgattgaacaagatatgtaaaaggaagtctctagctgagtcctttgcatgtatgtctatctgtacctagatccatctacatatacacatatagacatgcatatatgtgtgtatatatgcatatttacatatacatgcatatatacccgtgtgcacatatatacatgcatatgtacatgtatatacacacactctcaataagtgcatgtgtgggacactcctttctgccacctctgttttaggaaaccttaaatttgccaggagtctgtttgcttatctcaaaaatgggagagaggagaccatgtggcctaagggaaaagacatctcactttgggtcagaagattgagggttcaagtcctttcatggtcaaaatgtttccaatgttttgtatggacacttaaaaaagatgcagagtccctctttcactgggttcactgggttgtgaaaattgaactaaattaagttaggtaactaataataaagcacctgtggttacatcagagcgctggaaatggaagtttcctccctcctcattgggactctgaaatccccttaactaagtactggtgggaatttttgttttcttttttcttttcttttcttttcttttttttttttttttttttttttgagacaggtttcactctgtcacccaggctggagtgcagtggcgcacctcagctcactgtagcctctgcctcccagtcaagccattctcctgcctcatcctctcacctcagcctcctgagtagctgggactacaggcgtgtgccaccatgcccagctaatttttaaatttttttgtagaaacagggtcttgccattttgcccaagctggtctcgaactcctgggctcaagcagaagccacctcagcctcccaaagtgctgggattataggtgtgagccactgtgcccagctgagaatgcttttaagttaacaatgaatacttagaatctatgcttagaatacactgaagacattatttcattgccatgcaaaaatgtgtatcttgtgtcttaaaaggaaagcatgttgatgtcatgactttaatgctacacaaatgtatatcttaaattagaagccaaatccaggcccctccaggacagtggcaccctccccctctccagcatggcctcagaccactgaccttcatcaaactcattctcgcttccccactcgagccacacaaggggtcaggaaggtgtctaggctgctgttctggaccatcgtacccttaccaaagagatctctcagtgcggaggagtgaggagctttggcctcccctgaataagcgtgaggaagcaaagattccccagcaataaagtagatgctgaatccccagcaataaagtagatgccgaatgtcatctcagcccccactggagtgagactgcctttgtgcattctctccagcacatcagtggttcctataaatctcacaatgattgcttttctcaaggttgcttcgtggcaagtctgcaagtgcgctttctccaacagagggaggaggttaggaatagacttcgcaggcaggagctgacttgggaatggcccaggggagaacaagtaaagatgcatctgctttgaaagaatcctttcgttttcatttaaggacttgacatcagggaagttttatatcctgggaactcgcctggctccgtgttgtgtgtgaagaaggattgtgaggccgctgctcaactgcgttgcctctttctccttccttgtgtcaaataatgtagcttttattttgtatgattgcgtgtgcgctgggtgtttcccaactgcaggggatggggttagtattcctggccctgtgagcagagacagaggtgacccaggctgggaactgcccttcatgaagggaccagccattagtgggtggcgggcaggcaaggagatggatatcgtgggcgatatttcaattatggatcaacccttagtgcctggcacatggtaagcgctacatgggggttagccatgatcatgaccgtcctctttgtagaagggcctgtcagaggttaacatcaggggagcttttccagttatgtgtcttgctctgaaaaataggaagggggaaagttaagttaatggcagtagtgggcccagggcttcaaagggccatgcatcgtgttttctacctgagtgctcagtgtattgtagacagtctgggggaaatggcaggaacagctggagcgctcatggggaccagtgtagaaatgctctctgggtcctccctggccaccgtggtctctgccatgctgaataatgaatcaggctgattccttgcttcagccggatggagaactgggtcaagcttcactccagagaatccccagacacctctctggcagaacccactgacatcctagctttgaaaagcatttcagtatttaaaaaaaaaaaaaaaaagcaataacaaagcctagttatatttaaaaccatatacataatgacagtgatcgtttctgcctgtaatgaccacaaatgccagtttactaaaaacttctctattatggaggcaacatccaagaggtattttgaatcttgaaaagcttgcctgttttttgtatggactctgtgaaagttgttttaggtcatagccctttgctcactggctgccttattatttatttatttatttatttatttatttatttatttatttgatggagtctcactctgtcacccaggctggagtgcagtggcgccatctcggcttactgcaacctgcgcctcccaggttcaagcaattctcctgcctcagcctcccaagtagcttgcactacaagcttgtgccaccacgcccggctaatttttgtatttttagtagaaacggggtttcgccatgttggccaggctggtctcgaactcctgacctcaagtgatctgcccgcctcagcctcccaaagtgctgggattacaggagtgaactactgcacctggcctaattgccgtatttctcagtgaaacctgggtggtgaaaagaccctgggctgcgggcagaaatcagacccgttgctgtctactggctacagtaactaggagatgacagagggctgtacttaactcttagggaaatatcacaaaacatgcgctatcaaatgtaacaaatgtaccctaagtgtacattattctggccaccaatgtgaaataaatagtatgtgggctatatgattattaaaaaggttcttcttcatagtcacatatagcaggaatacatggcttttttccacctgacccccagaacatagatagaaaaggtctccatagagcagctattgcagcataggcagcagccgggatcaccatgttcctaggatctagcaagacaggctggaatcccatatcctgcagtggtgtgtgtatcctccccaaaaccctgcctgttccctgtggcttctatttctcttatgttgaatccctattctctacgctgaaacttttgcatgttcctttttctctgccaacgttctcctcagcagaagggtaacacccttctcctttaattccccctgacaacatcagccatctctgtaagaggccctttgctggtgcatcaagggtaatatcaagggggcttacatcaaaatcagtttcttgcatcattttttatctatttatttttttgagacggagtctcactctgttgcccaggctggagtgcagtggcacgatcttggctcactgcaacctctgcctcctgagttcaagcaagtctcctgccttagcctcccgaatagctgggattacaggcacctgccaccacactcagctgatttttgtatttttttttttagtagagttggagttttgccatgttggccaggctggtcttgaacttctgacctcaggtgatccaccggccttggcctcccaaagtgctgggattacaggtgtgagccaccacacctggcccatttttaaattttattactgttttttttagagatggagtatcgctctgtcacctaagccactgctggaatgcactggcttgatcctagctcactgcagcctcaaactcctgagctcaagtgatcctcccacctcagcctctctagtagctgggactacaggtgtgcaccactgtgtctggctaattaaaaaaaattttttttacagaccatgtctcactttgttacccaggcttgtcttgaactctcggcctcaagtgatcctcctgcgtcagcctcccaagtagttgggattacaggcatgagccactgtgcctggccagtttcttgtattaaaaactgggtgttgggtccaggtggggtggcccatgcctgtaatcccagcactttcggatgccaaggtgggaggatcacttgagctcaggagcttgaaaccagcctgggcaacatggcaagatctttactctacaaaaaataaaaaactagcagggtgtggtaggcacctgtagtcccagccacttgggaggctgaggtggaaggattgcttgagcctgggaggtcaaggctgcagtgagccatgattgtatcactgtactccaacctgggtgacagagtgagaccccatctcaaaaaaatacaaaaacaaaaacaaaaaacctgggtcagactttctcactttcacaagtcattcagtcctgcctgtcagctccagccaccctgaagttgtgcagccctttcttgcccctccctactttcctatacccatttcttctgttagctcttaaattcctgatcatttcctatgtagagccatttaaccggtttcctcatccactaaccaaaagaggattgtgatgctaactagaaagctttcgctagccctgattcacgtacacacatacaatacgtgttgatgtcttgacggtgagcactctgctgtctaacctccttggaactcttttaaagtacagtaaatccttacttaacattattagtgagttcttagaaactccagctttaagagaaatgatgtgtaaggaaaccagatttttttctcatcaacattatagcaaaacaacattgaaagaagttgaacaaaaccttattcgaggtaggtcattttgcttaaagtcacagttttcaagaacctatcaatgatgttaagtgaagatatactgtactttgtatttttacagcttttagaaaactggtgagagctttggaccatctttccatcacacacacacacacacacacacacacacacacataattttggatatattttcagggtgtttagaacttcctgaagctcatccatggatctcccaggtccgtggacccttaataaaatccctgaagtgtggccgagcgcggtggctcacgcctgtaatcccagcactttgggaggctgagctggggtaagcggatcacttgaggtcaggagttcgagaccagcctggccaacatggtgaaaccccatctctactaaaaatacaaaaattagctgggcatggtgatgggcgcctgtaatcccagctgctcaggaggctgaggcacaagaatcgcttgagcctgggaggcggaggttgcagtgagccgagatcgtgccagtgcactccagcctggcagacagcgagactcagtctcaaaaacaaaaaacaacaacaaaaaaaaccctgaagtcagctgatgagtcagcctgcccttctgaagaggacagagcaccccccacccccaccaggctctgcatctctccctgtcccccaccacctaggggtatctttattgatgctcagtcattaattgtaaaaacaaaactagattggcatagctggctatgatatgtcaggattgggggatcagagaccttgagaaaatagtggccaccttttctcacctatttcctttgggccaggccctttgcaagattcttaatctaagtcatcccatttcatcatgccaggaccctatgaggtccatcctgttatcctcatggcaacagatgaggaaactgaggctcaccaagattgagtaacctgggtcacactgctaataagtggccgacctgagatttcatcccagagttagtggcttcaacatctgggccccaagccacactgtgctgggccccttctcccatagttgcaccttactcttcttgatccatgtccacagagctgtgtgaccttggatgtggcagccaaacgaatatgcccttccagttttttgaaatactacctagggcagagtgtttggtctgtttgtcccattgataataagtctctggtgcctagcacatggtaggtgtcataaatatttgttgaatgaatgaattaatctgtcctgtaaggctcagctcaatttcatgtttttaagaaactgtccatcactaactctgaattaaaaaaaaaaaaaaaaaagcccgggctcagtgactcacacctgtaatcctagcactttgggaggcccagatgggcgaatcacttgaggtcaggagttggagaccagcctggccaacatggtgaaaccctgtctctactaaaaatacagaaaattaggtgagcgtggtggtctgcgcctgtaatcccagctacttgggatgctgaggcaggagaattgcttgaacccaggaggcagaggttacagtgagccaagacagtgccactgcactccagcctgggcagcagagtgagactccatcttaaaaaaaaaaaaaaaaaaacctccttccgtgagctcccaacccatgtttgtgcctcagtgtatccttcattcatggtccgtgctatagattgctgctatgtgtctgctctgtcacaagcttctcaagagcacgaacttatctactctcagatactctcaggtaactcaggtgtatctacagggaagaataggcactcatctctgtagtcctccaggacctaacaggcactcaggaaatgttatcatcgcgaatacacagttgttattgtgctgcaggataattaggcttgagtggtaaatgattcccatagatgactgttaattaggattacatttgtagtgtcgggccacattttagctttttgatgtgaactcttttcgttttctaacatctgtaacttaacgttgttatatgttctggtaccatttaccttttggtcactgtctctcaacagtcacagagcagcagctgtgccctgggtgtcggatatgctccttcatggacatgagctcattttaccactgtcttctttggtcctgtaccccgaggctgactttcctggttacaggcaaggcctgtatcccacggctcactggctcctggcccctggtctcacccctcactgcatcccctgccccacctggtccctgaaggagatcccccagttttctgacagcatgctctcattttgctgcttgcattaaagcccagagaaaggaaaaggacagaaacctagaaattcagcaggagaaaagagaaatggaagacaggaaaacaaaaattgaaataatagtatcttgcggaaccagagagaacgaagtccatatttgctgagggcctacaatgtcccagccacttgcccttcttcatttccttatcactgttcaactgagtaaccttagatgcctggaggctgagcatccactgattggaatataattcgaacccaagaccatctggtcatagatacccaggctttgctctgtgttctgctccacgacacatgttttagggagaggtcctctgcaggtagatggctgtattataaaactcagagatagaagctgcacacaagatgagtgttccaactaagataggatgactcaattccactgtggaagaaaagagaacaaatgggagagaagggggcccaggtcaaaagctgtgtcccttctgggtcagccatgacccagatcccttaaatgcccatagtaactaacaacaataacagaagcagcagcaaactcgaatttagcccagttaatcctgacaacatttgttgtgagacaagttatttttagtacccacattttataacgaggacattgagacacagacaggttaactaactcacccaaggtcaaaaatggtaagaggcagccctgggatttgaacctagattttactttcagtctgaggaaccacataacttagggtaaagaaaggagccatctgtctatagcagtggttctcaaggtgtggctcccagatcacaacttcagcatcatctgagagcttgttagagatatagattcttgggtcctacccagacctactgaatcagaaactctggggaaggggcccagtgttctgtgtgtgtgtgtgtgtgtgtgtgtgagtgtgtgtgtgtttcttttttctttcttttttttttgagatggagtctcactctgttgacctcaagtggtccgcccaccttggcctcccaaagtgctgggattacaagcatgagccaccatgcccggcctgttgtgtgttttaagaaagccctccagatcatatattcgtatgtatcgtggtctacagtacatctccacgtgctggctttggctgaaatctgttaaactagagaaatccttaaaatccactaatagaaaagagtaaaagtttatcaataataataataaaagccggatgctgtggcaaatgcctataatcccagcactttgggaggccaaggtgggtggatcacctgaggtcaggagtttgagaccagcctggccaacatggtgaaaccccgtctctactaaaaagacaaaaaattagcgaggcgtggtggcgcatgcctgtaatcccagctactcgggaggctgaggcaggagaatcgtttgaacctgggagacggaggttgcagtgagctgacgccacgccactgcactccagcctgggcaacagagtgagactccatctcaaaaataataaacaaacaaaaaataataataaacatttgcgaagttttgactgtctgccaggcatgatgctaagcattttaccagcattatcttctttgggcctcgcacatgctgtaaagtataggtggcattattattttacagatgaagagactgagacttagagacctgaagtgacttaactcaaagtcaccagccagaaagtagcaaaatcgtgacttgaatccagactcctctgatgacacggttctaccctgaaccattactcttttgcccttttggttaagaactattgaagaatgggcataagtcaaagtgtatatgttgatttttttttgttaacttttttttttaagtggcagatgacttgattaaatactttgagctcttcccatgctccaagatgagcatttattcccagaactgattacgcccggcatcccttcctgggtttaagggaaagtggtggtggttatgaaccttcctggccacacgggggcagcaccaaacattgcaggttgctcgtttctgctcccttctttgggaagaagccaagctggcccctcgggcggagctgcctagtcccgcttacacctgtttcctctcacttaagccacatggaatggggtgaaactcttcagatgagaaactaaattaaaacaagagcagggttacccaagaaaaatgattttaaataaactcactatagtaatatgtcaggcttatattcatcagtatgacaaaacaattttttttttttttgagacggagttttgctcttgtcgcctaggctagagtgcagtggcgcgatctcggctcactgcagcctccgcctcccgggttcaaacgattcttttgccacgattctcttgcctcggcctcccgagtagctgggattacaggcatgtgccaccacacctggctaatttttgtatttttagtagaaacggggtttcaccatgttggccaggctcgtctcgaactcctggcctgaagtgatccgcctgccttagcctccaaaagtgctgggattacaggcatgagcctgtttgcccacccggcaaaaacagtattattaatgtgctggggtgaggtcgggtgatttgcatattttagctaagaatgatactctgggtgttcagtgagctgttagatcaaaatatttgtcatcttggattccaaggagagaaaacagccagtattcttttttaccttctttgttgttactgaattcttttgagcagtcctaggttgtaggattttatagtagacagctggagacagtgggaaaacgcatttctgacttctggtttgaagagtattatctcacagtaacattgctgtcttagggctcactccagccagggtcactaagatgctctcctggtggcagcttctgtgggtcttgaaccccatttccacagtaccctgtccaagccccagtttccatgccagaagccgaattcaccagaattttgactgaggtgatcatatgatttattgtctaacccaggacactttttgagagtaaaaggagctgctctgaataattttgccagaatgacagggataccccagaactattgaggggaaaattgggacatgtggtcaccctaatacaaatctctcatttttccttcttgattattcagttaagagttacatgacactgtatttatttgctcattcattcaacaaatgttcaagtgttttttattttctaagttcactacttatattattttctcctcatgaaaaccctctgaagtaattattattattgctcccatttttacaaacgagcaaaattgggacttagtaaatgacttgtccaaggtcccacagtacatcagagagctgagattagaatgcaggctgttcctactcttgatccacatacgctcagaactgtattgagttctgggtgcggtggcttacgcctgtaatcccagcactttggaggccaaggcaggccaatcacttgaggtcagcaattcaaggccagcctggccaacatggtgaaaccccatctctaccaaaatacaaacattagccgggcacggtggtgtacacctgtaatcccagctacttgggaggctgaggcagaaggatcacttgaacccagaaggtggaggttgcagtgagctgagatcatgccattgcactccagccggggtgacagagcaagaccctgtctcaaaaaaaaaaaaagaactgtattgaggtcaccggctgtttatccagccttgtttatcatcctaacaccatctgacattgtcccccaacaaaaatctcagaggcatatagcaaagtggttaagtgtaggagcccagaagccaaactgcccaggtttgaatcctggatctaccactcaccagctttgtgctgaacccagtttcctcatgtataacatgggtacagtaacttagtatcaacctcaaagggttggggtgaggactcactgagataatacttttgacatttgaatagaggtggtaggagacaaggttggaatggcaggccaggggagtcagctgggacactgtgattttactgactagggcctgggttgggaaccgacatgggagagaggttagtgggctgcacagcactttctggagagcagggcctgggcacttagggatcagactggcacaattgtgcgttttcataaagcagcacgtttggtggagtgcttctgtggaatatccaacacatccacctggagaaacacactttggtctgagactgagggagcagagctgcggaggggcaggcaggccaggcaagacctggctagctctgaattggccacagccagctctggcacccgggacctcctcttcaccatcgggctggttccctgcagtgtgtatacatgtgcagaacctttccccaagattcagactcctgagtagcttctgtgattgtcacggggactgccttctctttttggtttctttgtgaaaggcaccttgtgcaccatcagcagagtggctgctgaggtggtcacacttctcctctgggacgtgaggatcagcgcactgtttgcttaaacgggctgttttgtctttgatattttggtgagttttttttttcccctttgacaaagtgtgatcatccgctcaggaacgaggtgcccagtctgtgcacggtgactggaagagggaaggtggcccttgaccgaatatgatcacttcaggacactttgctgtattcattcatttggttatgaagctcacatttggaaactttacaagctgttctttgagatccagtctgttggctcccaaggaaggatggctccatgtctgcctttcctatctggggaaggtggcctctgcaactgctggacagcttgcatgggaccagggatgcagagagagatgagggacccagctcaggcatgcggcaaccctggtgatcaccagcaaggcaaatgctgtagccaagtcacccttacctgcactgggaagttttttctccatacgtctttggattttttacttgttataataaacagcatatagaacttttttaattaaagggaaaaattgaattacagaaccttaaaaaagaagtatgatctcaaacaaaatatctctaagtgatacaagaataaatggttttaaaagcacaaatctgtcaattctgcaagcacttcagcatttaaagattccctcgtcacaaacgctataggacctggcacttatttgttatcatgagtggatactttttttccttgttttgctgcctttctgggtattagagaaaacaccttgcttctctgttattagaaacaagtgcctaacatgcagttaattcattctgtctccactgtttctaggtgcttaccaaataacagatttcacagggttgcatttctcactatttaaaaaactgccttataagaagtatcaggagcttagaaatttttgtatccattagccgtatacttatatttctggtaatctattctttttttttttttgagacggagtctcgttctgtgtcacccaggctggagtgcagtggcgcgatctcggctcactgcaagctctgccttccgggttcacgccattcttctgcttcagcctcctgagtagccgggactagaggcgcccaccaccacgcctggctaattttttgcatttttagtagagacggtgcttcaccgtgttagccgggatggtctcgatctcctgacctcgtgatctgcctacctcggcctcccaaagtgctgggattacaggcatgagccaccgcgcccggccctcataatctattctttttttgttgttgttgttgagatggagtctcgctgtgtctcccaggctggagtgcaatggtgccaacttggttcactgcaacctccgcctcctgggttcaagcgattgtcctggctcagccttctgagtagctggagttgcaggcacccaccaccgtgcctggctaatttttgtatttttagtagagacggggtttcgccatgttggccaggctggtctcaagcccctgacctcaggtgatccacccacctcagcctcccaaagtgctgggattacaggtgctaggatcacaggtgtaagccaccgcacctggccttctagtaacctattctaaggaagaaatctgaacacatcaggcaaaaagatatttgtcactacatttttttaaatagcaaaaaatagttacaatttaatttccagcaatagaggatttgttaactcaattagatgattgaacataatgaagcaaataaaggtgcattaagtgtagtaccttttagttgcgggaggggagtagtgtaaactgatatgattgaccaaaccatggagtgacttcttgtcctctttcactgtcttccagtgttttgctgtgcgttctctgggatgggtagagatggcagaagaggacctcgcccccggtaaaagtagtgttgcggtcaacaactgcatcaggcaactttcctactgcaaaaatgacatccgagacacagtcgggatttggggagaggtaagtggcatgtagaatgatgcacggcaggctgtttacgttctcctgcatttcaggaagccccacagctcagtgacacatggtactgaggggctccgaggtgttcatcaggtgccttttcccattaatgcaggaagtgtaggcatggtacccccgtgtgactgatcccttagcactgccagatgccagtgaggactggggcctggagagagagcgtttctcagtagctaaggacacagattcacgggtgagctttaggggcccagaactcccctaaacatgcctgcaaaatgggatgtgccagtgtataagagcagttttgcagactggaagaaggacctgtattctcaaaggggaaggtgacttccacacgtccacacaaaaatgttgatgcctctgctttaaaagttgacaaattattcttttataacactcttctttacttagcgtctgaagaatcaacattatacatgaattgtggaattgatatttatatacttctcccttttaacagagtgattccattttgaaatgttagttgagataatttcagaaaggaaaaaataagtacagataccaaatgtgtatgaaactcacatcaaaccggaaaagctgtattcctggtgtgctctgagacctgtggaaaaagcattttgggagcatcttggaatagtgtttgctacatgaatagatagatgttgttctctctgcttctagtgaacagagcagtggtagaaaagtttgctttttggttgggctgattgggactccactcacattttctcctagcagcacatcccaatgggaagtaggtttccaagcctttccatggtggagtttgtctccttaaagtggagctgaatcactgcattgccaagctgacttttagattctaggcataagggagagctggaagaattttcttccatccaagaaaagccatttaccctcttctgttgtttgactttaccgtcctctctcaccgcattatctcccatccaaatacccaagcctggctgagcatagtggcttatgcctgtaatcccagcactttgggaggccgaggcaggtggatcacctgagctcaggagtttgagaccagcctggccaacatggtgaaaccctgtctctactaaaaatacaaaaattagctgggtatgatggcacgcacctgtagtcccagctactcgagaggctgaggtaggagaatcacttgaacctgggaggcggagaggttgcagtgagctatcgtgccattgcactccagcctgggtgacaaagtgagactctatctcaaaaaaaaaaaaaaaaaagaacaaaacccaggcctatgtttcccaccaaattctccacctgtcttctctctccttcagtcaaaactgctgttctttcttggctaggatttagaaggtaggtggttgtgacttacactaatatgtgaatgactgacctttggaggagccataggtctaaggcagcatgctcagccttctgagtagctggtgaatctgtttcaccacaacagtgcacaagttctgttttctgccagtgctttcatctgtaaatggcttagctgctctttggggaagatttgagaccaggctggatctcagctgtagacaggccacagcttcaacgctgtctgacagaggcactgagatacctatttctgcctccctgagcatcagagctgtatttcactctgagaatgtttggtaggaaactaaaacatcattccccaaaactataccagaaagcaatttgtctgttttactttgagatttgaagacctaccgagaagcctcactgttctgctgagccagaacttccatcatcagtgctccagcatctagatgacctttaggagagagagtctttcagctgtgcaacagatgtttaatgatgtcctaaaattatgccggggagattgcagggggaatcaagttgaatagtctagtgcttctgcccacaaagagccaacacaggtggggagatgggacaccagagtgtaagactctgaaagatagtgcaggagttgagaaacctgggtgttcccctgtgctgggatcccagcagcacccacaggttctatgtcagaccctgagcaagttacttaacctttcagcctcagtttccccagctgctaactgggatagtaacaatccaagccctcagagggcaatttagagagttcatgagccagtgcaccttaagcacgtagcctaatgttgtcatttaaatgtttgccattgttagtgctgagaaatgtcacaaagctgtgcctgctgtctgccaggcagaccacacagctaggaagtggtgtaaaagccgagaggaagcagatatcgttgtgggtttggaaaggccatcgaggggatgcttggtaggatctggccagaagaatggggagagacaggttccaagagtttgatgggcatggaattagtaaaagacgtattctccagggaaaccacaattagccttttgtcgtaaagattcagaagtgtaaataattaaatttaagagcagcctggaaagcaggatggggacacatttcagaggactcggagagggagagagaaattgggtgtatgaggggaaactgaaagatatcaatattcttgtccagaaaggaagtttcttaggcagacaaattacagaccccagggtggcttcttctgatggttgacacggcattcctagatggccacacacacgattaggctttccagcctgcatgaagaagacagcgtgttttctcgttgtgtcccaggggaaagacatgtacctgatcctggagaatgacatgctcagcctggtggaccccatggaccgcagcgtgctgcactcgcagcccatcgtcagcatccgcgtgtggggcgtgggccgcgacaatggccggtgagtccctgggtggggcagtctgggtcacctcacccgtgtccctggtctagctgaacaccaaagcatgggctcgcagcatttcacggaatacgaaactcatgtagcttctatatagaaatgtgaaaaatgaaagcttgtctctagttccctgcctcttaaagacttcaaactgcttcccttcctggtttctgtatctcaaatcttttgtcaactctgatcctgatcctgccttctagttctgcatgtgtcttctcctgaccctcctcatgcaaccaagtttccaacccaggccatctgaacccctttttcccctcctctctgcagtctttttaaaatgaattccatttcattcagtgaagtctcagccatttcagaggccctcctgctgctgttctcttcatcaagggcttacttgagggggacgttgtacagcctttcatcacaagcctcaggtcattaaatcatgattatcaggaatttctgggttttgggattggctaaacttttttaacacttgaaaggtctggtcatatcaaaattccatttgatgtgtatttttctgaaattctactgaaaatgtgttatttataagaaatgcatcttagatgtgttatgaattttatgttctccaggatgattggaaacgagttccgattttcaagtgtgtattttaactaataaaatagcagttatcacagactttatgttcagagaccattgttaagtaattggtctacattaaatgcagttaattcttaaattatagtcagtctttggcaattcctaaggtactagagcatctcctagcatttagggacgagctataggatgatagcttgttattgctttgttgaaaatggacaagagcattgcaaaagaggataaaaatccccgacaacagagaggcggctctcctgagcttatggttccatttctgaacattctgcttttttattgagtcatgtggtcctctctaatggggttgttgtctaccttggcttatcacagcctttgtcaaccaacgctgggcattagcgcatttgattcagttccaagacctaaaccagaaaggaaggattatggccaagtattcatcagtgaaagagtaagcatttatgctagaaccagacatgagaaatggtctgcaaaggagagagctgaagtgtctttcttctcactgccaattggataagccttcctgggagcacagttgcatctttgagctttcgtaccagagtgatgaatgatgacagctgggccagatgctttgggggaatgggtggatggattatgtgcgcacacctgtcattcccttgcttgccagagctgtagccctggaaagatgcatgaattggttaattttacgaggaagctctctggtgatatttggtcgtcattaaaaacatttaactttggtggaaggtcctgggtgtaagatgcttgagcttttcctggtttctgtcctccaagtttgtttttaaggcaggagccaaagtgcagagcttgtgacattacatacgtgtgcgacgcaggagcgaaagtgtggagcttgtgacactacatacgtgtgcgaggcaggggccaaagtgtggagcttgtgacactacatatgtgtgcgaggcaggagccaaagtgtggagcttgtgacattacatacatgtgcgaggcaggagccaaagtgtggagcttgttacattacatacgtgtgcgaggcaggagccaaagtgtggagcttgttacattacatacgtgtgcgaggcaggagccaaagtgtggagcttgtgacactacatacgtgtgcgagacaggggccaaagtgtggagcttgtgacattacatacttgtgcgaggcaggagccaaagtgtggagcttgttacattacatacgtgtgcgaggcaggagccaaagtgtggagcttgttacattccatgcgtgtacgagtggatgagcttgggttttcctaaggtcagattgtcagtggattgtattgatgaggttttcagcttaccctaactctttaaagtgaggccacatgctacatgtctggaaggaaacaaatgattcaaactccagttgacaaaattattcaagttctctgagcctcagttctctcatctgtgaagtgaggatcataataaggaccacaacacatacgtatatgtgcatgtgcatgtgtatacagtaatcggttcagtgatagggacatgacagatgcttaatgaatgttagcccttgatttttaaacacacgctagcagatgcagctaatgacatggcttccttttaaagacagtggaggtcggagaggagtcagaccgcagggagacttgaagtacgcttgatcacgtgatctagaggatgagcggctgttccagaccctaatgagttcagttgtcctacaaagcaggaagagcttcctactccctgatgaaatcagtgtgaattaggttacattgccttggttatgtttttgaaacgtgggctgtattactcatgtttttaaatcacttcttattctcactcagtgtcagcagatgagtgtaatttcgaaatacgctcagggttccacatagctagcaggacctcagcgagatcatgggagggttccacatagctagcaggacctcagcaagatcatggggttgtggctgccttcagctggattggcatggaaacggtaaattttaaaagtgtgtttgccagtgaaaggttctgtttctccccattggtcccctgagtttccattccccagaagaaggggtctttgtactcctgctttttttactttcctttgcttttgattcctttttttttccttaacagcaatttacaagagcaaattcaatttgtaatgttgcaaaggaaagggcttttcactttgcatgaataaaacatttttgcttgcgaaaaagaagcccatttcacattctcttttgtaactttccttgctgagaaagtggaatctcttcagggatttcttgatgtggttaaaatgaataagagaagtgtgtattataccagacatgaagggcgcaaaatctttctgcaaatccagagtgcttccctgagccacgtaatttcagaaattatcaaagtattttggatgtgacattttcttaaggctttcaagtggttttgatttacttggaagaaattccttcgggaatgagtttactttgcatgaggaggtgattggctatgacacccccactgagccccccagggttgagttggagagacctcttactatgaacagcacaaggagttgagtcacatctgataccagtcttctgtggggttttggttgtcgcacaactatgctgaaggctttgtcttgttgagagccatgtctgtctttattacggtgtttcttggggcccatttgctttattgcctggcaaagtgagggctgcctcctctttcttggccatagttgagttttgttccctttgatcagtgaggtaaatgtcacggcccctggagatggaggctggggcaaggggtttcatgagctttgtctttccaatctagttcagccccaggagcacccaggttggcctgctttgctcctgcctgctgtgcaaaggaggacgtacgcaggtgtgtgcactgggccttagaactggcatttctgcccttggcgactgaggccaatgaccgaatgctccctttcatcttgtctctgtgggcctgccaggctactgtctcaaaggtgagtttggagggatgtccctacccagtttcagggacctgtgctaacttccggcctcagcgttcttcttattcactcagaccctggcgagcaccttcctccttattcttttacagaagtaccaaagccaagcaaacataatttcttttgttttttttttctctttttgagatggagtttcactgttgttccccaggctggagtgcaatggtgcaatctcaattcactgcaacctttgccccccggtttcaagcggttcttctgcctcagcctcccaagtagctgggactacaggcgcccgccaccacgcccggccaattttttgtatttttagtagagacagggtttcaccatgttggccaggctggtcttgaactcctgacctcaggtgctctacatgcctcggcctcccaaagtgccgggattacaggcgtgggccactgcgcccagccaaaacataatttctgaacacagggaacttggaacagggactcccctcttgcctcgtggttgatggaggcttatcttctgggtaggggcacagagatccttgtgtacttcgccaatgagccctatagtctgctcatctcagccatttcccacaagaaaggaaaatggatattgtcagagggtttcagaccccgtaaatgggatgtttccaagaggcttccctatcagtgattaatccacggttttcccttgagaaaaaaaaaaagattctatagtcacttgggaaactgagttaaaccaagtacactgggccctctcagaggttttcctacgctgagatgcactaggactctgcaagaaagcgtttcccaggcttggctggaccgtttcctcggtggaaacacaatcacatggaacacacttcaggaaatattgctgtcattagtaaactcattcatttaaattcgtggcaacactaaactgctatttttgattattaagaaaaattggaattacttttaatgaatattataagtggagaccccattgggcctgctctaatgaagataaaatttcttcataatgaatggcaactatgagaaacacactcacccatccaaaccccaagaatggacttagaggcacgaagaacagtgaaagtgagactttttaataacagtcttgcgagatcgggtatctggtgggcaggcacacctgggacagtcacaacaggtaatttatctcctagcacgccagtccctcccccaattcctcactggccgagtactatggggctacaatcttcctggacattacctaagtttcattatcccccttataaggttatacctcattcccttccccgcttaattttcatttcccaataagaaaactttcttccctttaatgggctgacccctcctctacattctgttagcttattgtgactttctaggtgcatgagccatgtggtttgttacatttgcagcctggctgccaggacttagatttatcatgccttgaaaatggaccatttaaaatgttttctcacacaaccatcaacagtcatgatgtgtgcagtgctttttaaacagtgctctcttattcaggttcagtgtttaccctgtgatgttgcttatgcttacagattgtgtagccaaacttctcttccttgaaggtgtttaatacctttcttttctggttttgatgaacaacttttaataaaatctttctgtgtcatagattattcataaatttccaaatgaggttatctttgacttgattgttctatctgattatgatctcaggaacttttgtctaaagaatatagtgtccactgtaccgaattttttttcatattctcttctaaggtattcccagctgtatttatccaccaagaccctggcccaagttgttttatttctttttatttttagagacagggtcttgctctgttgcccaggctggagtacagtggcgtgatcatcactcactgcagcctccaaattcctgggctcaagcgatcctcctgcctcagcatcctgagttagctgggactacaggtgttttttttatttttatttttgtagatacggggtctcactttgttgcccatgctggtcttgaactccaggcttcaagcagtcctcccacttcggcctcccaaagtgctgggatagcaggtgcgagcccctgtgcctggttaggatgttttaaaaaaggcctttgtcacatgtactttatgttcttgttttcatgccagtgctgttctgctgctttgttttgacttcttttgaaaacactgcttaattttgtggaggagttcagggatcctgaggaatattgggattaattatttagaatatgcaaaactttgactcataggtttttagatttaaaaggtgctttagtattagtgtctttcagtctctttattttagaggttaggaaactgaagacagaagagtgtgattaccttaggtgacccatgtagtttgtggcagagcaaaaaacacaccccaggtatttttgccagcccaaatgggaagctactctgttcatcttgacaagagatggtgaatggtctaaatgtcccggggttggcaggggaggagaggctgggtcagatacgtcctaaatactatgttaggcagcagcaggacacagaaggctatggcatggtccctgtccttacagtctggcttcttcattgaagagataagaccacatgagtgaatggaaagcaaaggtggacacaccatgttcctgagcctcgtttttgtgggtccatgagctgagaatagtttccacattttcaaagcattaagaaaaagaacgggggacccagatatgggaactcagcacagcccagctcttcatagaaggaacatttgagtaataacatactcagaatggaacgaggcgatctttgtagctgctgtatatagaaagtcgttgtggaaagggcccattttttttttttttttttggcagtctctatctcccttcctagccatgtcttctactagcagcattcgggggtccctgaaagcacggcttagccttgctactgttccgtagagttaagcttgagtaagtttttcttttttttcagattgagtttcactcttgttgcccaggctggagtgcagtagcatgatctcggctcactgcaacctccacctcctgggttcaagcaattctcctgcctcagcctcccaagtagctgggattacaggcatgcgccaccatgcccagctaatttttgtatttttagtagaggcggggtttcgccgtgttggtcaggctggtcttgaactgctgacatcaggtgatctgccctcctcggcctcccaaagtgctgggattactggtgtgagccaccgtctcgctctgttacccaggctagagtgcagtgatgtgatcatagctcactgcagccttgaacaccttgggctcaagtgatcttctcacctcagccttctgtgtattataaaagggtatagggcaggctgctgccacaagtactctgcagtccactggcttcagtgccagaggttagttctcatgccacagctgcagtgggcactgccacctggaagaacagctctgtgccactcaggggttcaggctccttccagattgttgctctgccatccctcagttgccgtcctggcctcaccagaccaagtgacttgtctccaagttaaacacacctggaacttgcgtacctcaggtacactcacattccgttcacaccccactggccacactcagctgcaaaggactcggaactagagtctctagttgcacagacatttgccaagttaaaactcaatcaccaaagaagtttaacagctaacgttccgacgcagtgtgaaaaccagtcacctcaagtttctcacccccacggcctgttgcttcccgtactagtgtcattaagcagctgtcccctcagctccaaacccacacttccccgctcagctttgtgatgctggggctgggactccgcagactacgctcctgcttctctcgtctgctacctgttagactctggtgactgtgcagcactcgaaggagaactgccaggtggaggaggaaggaggaacttgctccctcctttgcttcctgtttctctgagcaccatcctagaaacacagctttatcccagttgcatcagttctgaatccagtttgcagtttttccaacttcacagaaatgcagaactggcttcatcacacggcttcttcagagattccagcacagctagcaggcaagccctctttttaagtctaggtcctggccctggggtccctccttcaagcctagggacaccatcagcagccaacaatgtctcttcctctgcagtccgaggttttgctccaggaggctcctccgtgaagcttctatgttttaattattgcaacctctctcctctgttccctcaaccctgcaggtcagagcccccctcttaacagttgcagcctccatgggagctttctcaggatccccttttgccattgtagttattagttaaaatcctatgtgctattctccgttcaaatgactggtgtggtttctgtctcctgcctggtcctgcctgtcccctccctggttgacctttaagattgaattagcgctgactgaaggagacagccactcacacagcgcagtctgtccaccatatggagggcagtcaggaaagcttttctgagcaagccagtgtggctcttctttgtgtttacaccacactgcaggtgacactgcagccgttgtgccaaggagacttcctttctaaattattagaaattgtctgtgataaagggcagtgttttaggtgacagtgatttagaaataatgggtctcggccgggcgcagtggctcatacctgtaatcccagcactttgggaggccgaggcaggcggatcacttgaggccaggagtttgagaccagactggccaacatggtgaaaccccatctctactaaaaatacaaaaattagccaggtgtgatagtgcacacctggaatctcagctacttgggaggctgaggcaggagaatcgcctgaacctgggaggcagaggttgcagtgagccaagattgcactgctgcattccagcctcggtgacagagcgagagtctgtatcaaaaaaaaaaaaaaaaagaaaaagaaaagaaaagataaaaggaaagaaagcgaaaaggaataatgggtctcttttgtttttgagctaatctgaaagttatctctgtttcttcttggtcattgttttttttccctaggagtgattaggtggggtctcagtctggaagaagtagagtttcctgatgacatctagtaggggattctctgagccagtcagtaatgaaagactgatggaattccaagatctgctgatgaaagtttaatctatggtatgtgctgtcttgcctcagggagaaaagtcttcaggaaggaacaataattctctccctacactatagtattgtcttgacctctggagttaatttctctttaatgcagctccatgataagcagaggcatcacgatttacttgaccgttttgctgacttacactgtggttctattttatctctttaaaagtggcttctctgccttccattaatcatgatgggatgcttgcaatactttcagcacagaataacctttaaggaaagacatcgtaagtgattgtccaagaacagtttcccttagaggaaagtgggagggcattttcagacagatcgttcatggcggtcctgtccctgttcatgaatctatgaaggcgacagtttctcctgagaaatacctcgtccattttggtaactctggctcaaagcatggttcaggatttcttgtgagcatgtttcagtagcagccagtgacgtgtgggggcttgaggctgttgtgtcaagagagagcagaaaagtctgatgatgatcttcgaacagcttccatctcgcacttcccctgagtcctgagccagacaaaggatgggcctttctggatgcagagcgagggagatctatcatgtttgattctctgtgtccatcctcaaagtgccgtgatcttctttgaatacttggagcatcccaggaaaagaagagtcatttgagtaaagaaatagcctaacaacccatgtaaacatggatgaatgtctttgagaacagaggaagtcataaccatgataacccagaacttatgcagatgttcagtgcatggtttggtgcttgaagaattgctaaaagcctcttgttgcaaaggaaggtgcagtcaccacttttcatacacgagttgtcacctggaacctttttactcaaatgtcatcatcctgagatttttggtttcctggggagtccagtgactatgaatttagtgcagcacagttcgtcactgggaaagaagaatttgagaacatcaggtggaactcaaggagtctcattgtgtcgagtttttgagagctagagtaggtcaagagaaggaacactggagtaggaatctcaccatttgcaatgtaattgtgcctcttcctttgcactgatgttaggggcgctctgtgtgccactgtctccatccgcactggagatcatcactgacgtagctgaaatatggaggtcctttcatgcaagggtcataagtgccatcgctcccagtgacactctttttattaacatagtaatatttccttgaaatattgtcctgggtctgctgggtgcagtggctcatgcctgtaatcccagcactttgagaggctgaggcgggcagatcacctgaggttaggagttcgagaccagcctgtccaacatggcaaaaccctgtctctactaaaaatacaaaaatcagctgggtgtgttagcacatgcctgtaatcccacctactcgggaggcttaggcaggagaatcacttgaacccaggaggcagaggttgcagtgagccgagattgtgccattgcactccagcctgggctacagagtgagactccatctcaaaaaaaaaaaaagaaagaaaaaaaatattgtcctgggtcaaccgtaacatattattaaaaataaggagaaatttaacatgagagcttagtattattctgtctttttaatatctagaaattatctctagttcatagtgagtctcaactaacgagttggtgactcttcatagagttccctagagctatttgatgctgcccttcaaaggctaaaattgttgttcagagccccccaaaatggctttgtatttttctaaccctcttatgaagtcagaattggtgtttaagtatcagagctgtgaactcaagctttggaatggcttgtgttcagaggagttatattttaacagagaaaaatgagaatgtaggagaattatcgtgtcatgaattttcagctagccttgagcctttgggtggactgaaaaagtcttgttcacttgggagccaagagttcctgcttctgtgagtccatgtgaggctgcaccagtttccttccaggtcccacgttctagtctcctcctgcacactgctctctcttaagataagaagacagtagagttatgttccctgcagtccctcggagcagcacccacactttgggctcaggcactgggtctcatgtttctttgttataacttcaactgggaattctgttcttctaggctattccccaaaaagtggcctagggatgtgcttgtttgaaaagggaagacaggaaaggaaatcaaagacaagaattaggaaattgaacccagagtcctcaagcaagaacccaatttccaagagtaaaaagctcttgggaacagaatcatgcaggcgcggtcatggcagccagaggacggaaatgccagatcagacgtggggccaaagaaaaagaagggagccagagagttgacttaaaatggaaagaataaacctctccaaaccctggaagaatcatcaaggctataaataaaggaacacagagtgggtgacagacgggctctgacaccattcactcatctagaagagtgtgatgggggaggggagactaagaaaaataaaacccagaaaatgttctcattcagtcagaaattttataccagaaatactccaaagaggaagaaacatttgaaagtcctgaggcgggagaggatgagttagggggcacagttacagtctctgagggagatccggacagggggcatggcagggacacagtggatgaagatggatgctgacatggcaaacaggcaggtaacgtgatggggaggacaaagccaagcagacacaggtgcctttctctctgcgggcagtgcattagataagcttctgattgcttctcttttattttgttttttttgttttgttttggtttggtttggtatttttggaatggagtctcactctgtcgtccagggtggagtgcagtggcaagatgtcaactcacctcagcctcccgggttcaagtgattctcatgcctcagcctcctgagtagctggaattacagacatgtgccaccacacccgtctaatttttgtatttttagtagagatggggttttgccatgttggccaagctggtgttgaactcctggcctcaagtgatccgccttcctcagcctcccaaagtgctgggattacaggcgtgagccaccgagtccggcctgattgcttctctaatgctcagccacccaccctgtcttgccaagtctgcccctttaggaaaatgctccagctgcattttcaagggctgctttttctctgcaccaagcaccctgcccactggagagccatcttcaggcagggctcacgagccccatgccctgtaccctgagctgctctgcccggggtgtggcaggtcatgatagagttaagagtcactttgccactggacaatagttcatgacacgtggctcctacctccctgatccctaaatccttcttgcctcctccctaaaggagagctcctgagtgaatttgttggaagcaacactagaaaactgcaagtctcaatcttcaactcacagaatcaaatgttcctgtgaggtcctaaaaccaggtctgtcccagcaggtgaactaaacagggcacagcaggatgagtttgcaggaattttatatatagcaccgattaaggcattaatgccatttttcaaagagttgacccttctttgattaccaaatctgtgaaatagagatttagttcagattgaaagtatctgatcccctctgaccctggccctcagcaccccacccctacatgacctgcctttatacagacctggaatgaggatgggaacaaggatgagagggcacacgtcatcccctaagtccataaacagcatctgagctccaaagaattgagttgtcttttgagagaagtctctttcctaaccacgtgccacgagggtgtaaatagtgggtatggcccaaccttggctaacctaggctaggccacctttgctctcagatgggtaacagctttctgctgggatgccaaggcaaatctgttatactccacgttggccaagacagactcctgaccccattttcaaagctgttctttctatttattctcccgtgttctgcattcatacattcactcatttcggcatgtgttcatccactggacttatgctgagccactgtggttaatggctctgccatgtagtacacaggtcagcagtgtgggagcccccgaccctgctcctgtgggtcctccccacccatagtggtggtcagccctaaagagtctacctccttaatacctaggtcagagttaaaaacaggctgtcatattgacagtgggtaatgattcaaatatccatcagcaggtaaatagataaacagaccatggtatattgtataacagatatccacacagcagtgaaaaggaaccagctgttgatacagtcggccctctatatctgcagattttttacatcgacacattcaaccaactgcagatgggaaatatttggaaaaaaatacaacaatgaaaaataatacaagtttttaaaaataatataacaattatctacatagttttgcattgtattaggtattataagtaatctagagattaaagtatacaggaagatgtgcataggttatatgcaaatactgtcccattttatataagaggcttgagcatcgttgggggtcctggaactaattccctgcagacaccaagcgacaacggtatatacagcaacgtgctgaatctcacaataattgtgctgagtgaaagaagccagaccagaaaaaaaggtagtgtgtgattgcatttatgtaaaattctataaatgcaaggtaaactaatttgtagtgacagaaggcagttcagtgattacctgggaaaggacagaaggcagggattataacgaggcaggaagaatctttgagagttacagatatactcattatgttgatggtggtaatagtttcacaggtacatattgtcaaaacttatcaaattggatattttaaatatatgcagtttattgtgtatcaattatactcaataaggttgcttaaaataaaagttttaaaatatgcagtgagtgcatgccaaagatttatttaactcatgagctggctaccaacaccagttcaaaggaacctaagaaaggctgagaatcttctaaacctgataaccaagccaccaggaagcacttgtgctttcaagaatttgaaaaggtttcaaaaaacctcaagccaggaagaatcacacacatacacaaacacacatgtactgctgcctagacacagcctaataaaacagttgaaaccaaaggcataacacagatcataacagcagctagaggaaaagagaaaatactagaatagatgactaaggtggatacaaaactggttaatgttctactggcaatgaaatcctcacctttggggttatttttttttttcttagcagaaagttgcaaacattacttgtaacatattaatgttctacaaattaacaactactctcccagagtctgagccctaatcactagcaaagtcagataaaaatacatttccctagagctgggctgttcatttcggtgatggccttgagcacttgaaatgtagctggtctgaattgaaatgtgctgtaaagtgtaaaatacatgccagaattcacaaacattgtattaaaaagatgtaaaatgtctcataacaatttcatattgattacacattgaaatgatagtattttggacatattagcttaaataaaatattgaaattaatttcacttccattttccagttgtttaatgtggctactagaaaattgtaaattacttaatgtggcttgcattgtatttctgttgaacgggactcccctagtgaagtaagtaatccttaggagggtccattaagtgttgctctactgtgacattgaaagacacactgtcctccttttgtcttatttccaagtgttggttaatttttcttaactacttcttatacctgtttgtccacccctgatctttaactcccatctctgtctgtgtccttgacaatcagcaacccaagtgatttttctgatgggtaaaaagacatgacatgttccctgctgctcaggatggagccaaaccccacgatgtgacatgtcaggtctcacccctgcctgcccccatcccaggcagcacagctgagccaggcacttacccagctgcaccggactgtgccttcacacacttaactaccaaaaatgtcacacaacagctctgacttgcactgtgtgccctgctttttgattttttttctttactactcttttaacttttaaaacgctgtttgtgaccactgattggtcatagtttgaataatactgatctcagtcaaattttctaagaagtttttgagctgagcactctaccagcttagtaactggtgtttaaagaaaaagagattccacactcacataattttgggaaacactgtatgcaatgttctattctcagagaaagcccctaaaacacaccctcagctgttgaagggtctgagctgtcccgcagtcaacactagatgagcagaagacatattattggcttcattaacggcgaaccttcagagggccagcagttctgggacccaccaggtcagaaaacactgttctagggattctgaatgataacattgtatcaggggacaggataacaaagctagagtttcagactttcatttacttatctccaccccccgccctgcccccgcctcctgtgccttctctgaaaagtgttgtgttcttacgaacagcacttccattgcattcagtcaatacagttgtaagtgatgatcccaggaaggaaatctctacttctttggtaatatcatccctgaagacgtcctttatattgttaaattgcccttggataaaaaactgaaatgcagatttcttttagatttcagtatctagaaaatattgtctctcaaaggatatgcatgtaagaatttagttaacagggaaaatagtatagtttatcatgtttccctttttgctaggaagtttcaagttaaattaaacctgcaattgcagtaattaaatcagatagaatcatataacattgctgtttttgtggatcagaaatggttgaatgtggttccaactaatatttcgcctcgttaatttatagaattactttctcttccttatatttggctttaaattttacttttctaaatttagaacataatagactgtgtgtgccttttattgtaagccacttaattcttttgggaaggaaataggatataaattttgataaataaacagagttcaattgtaatgccccattaaccaatgagtgtataaaatacagattttttctctgacttctctattattcaataattgggaaatgctatgcattctaaaacaggagtattttgcgggttttttccccctgtaaaatccctaagcaactaaaagaacacaaagttaaaaatctatccctacagccaattaatatttattgacctatccaaatgacacccgtggccttccccattaatcagagaataatagtgcacagaaccacctcagccctaaagatacttgcttgccaaaccagtttcctccaccaccagcgatctcattgcgaagagtagcagcaattcctaaaagcattttagctagtggacggtgtgaaatttcttaatatatttcccccacaaactcagtggtctagcataattgtctcagctccttcttgcctaaaggaaatgttctgattcatctctgtacagcgttgagcttaagagttgctttgtcttcttcattgacgtaagagaagctgtagaagttatttattaagaaagataaaacctgatactattaattaaattcactaagtcaaggattgaaaattaagagggaaaattttttttaaataaaagataaggtttaaatatgtctacactgtacaaattagagtgcttcttaaaaaagagaggagatatagatcttaagttgtcaaatcttgggtcacttctaatcataacattgtcagtcattctcttaggccccagaactggtagagcagattataccacagaagtatgctaaccagggcaggaggatagaaatggctgtcatcatccatatacggtaccatctttttttttttttttttgagatggagtctcactctgtcgcccaggctggagtacagtggcatgatctcagctcactgcaacctccgcctcctgtgttcaagcagttctcctgcctcagcctcccaagtagccgggattacaggcacgcaacaccacgcccagctaatttttttgtatttgtagtagagatgggcattcaccatgttggccaggctggtctcgaactcctgacctgaggtgatccacccgcctcagcctcccaaagtgctgggattacaagtgtgaaccactgcacccggcgccatcttttttttttttaacctttatcattataatttaaccagatttcttcctgtgtatcttacagtgatctgtaaagttggctttcttcatgtccaaggccacatcatcctcattcctaacttgagatgtcaagccgtagaattccttttctccctccttcttcctctattgatcccatctagctttctggggatttattggatacccatgtgttaagtccctagcatgtgtctgccaccatgcttggcaccaaggatgtagccatgaatgagaacgccatggttcttgccctcatgggatgtgctaagaggaacagacaggtaatgacatgggctcatgagtcccatgaagcactttctaacatgaccgtcaagccctatgccagtgttatgtgacatccctatccttaggacttagtgcaggtcccacctgttctgttagcctttctgtcaccgttcgtgtccttcagcacaggctaggttagactgtaataacaaccaaaaatctcagtggcttataacaattctttctgctaaaagtccatggtgggttggctgaagacacggcttcctttgtcattgtcctcattctctgtctaaagctgatgataaagtcacaatctagactacaatattggcaacaatggtggcagaaggaaaagatgcgctgactgaacatttctgctggaaatgatgcttagcgcttttgctcacatttcattggcaaagcaagatgcgtaactgcgcctcacttcaagggttggggaaatatacgccacccctacaaatgggagtgaatcttcacagcacaccatgccctgtgctgtctttcagctctgtagtcatgcatatattcattgtactagatctcttcaacctcgggttgtcactaatgtcacagatgtgtgtctccctggttagactgtgaattccttgacagccatcaccatatcttagatttccttgtgtgtgcttcaacatgatgttatccttatattagatgcttaaaagtacttttgattatctgaaggggagaatgaggggagaataatcagaactctgtgcatgttttgacacaatgctttatggtttactgagggtctatctccattagtcctttcaggactacagggtgtagcattatgtcccttttacagatgaggaaactgagacctagaacttttacacgacttaatcagttttatacaaaaatgtggctgaaccgtgtctgaaaccatgaattctaaattaatgggtcagtgttcctactccttttagctgttaatatggacactccaattaccttgtgcagaggcccacatgagggaaggaagaggaaacttcagaaaaggagttgaggccgggtgcggtggctcatgcctgtaatcccagcactttgggaggccaaggcgggcggatcacttgaggccaggagttcgagaccagcctggccaacgtggcaaaaccccgtctctactaagaatacaaaaactaactggggatgatggctcttgcctgtagtcccagctactcaggagtctgaggcgggaggatcgccacttgaacccaggaggtggaggttgcagtgagccaagactgcaacattgccctctagcctgggcaacagagtgagactctgtctcaaaaaaaataaacgggtgcggggtagtagggtcttcacagatgtgattaagttaaggattttgacctgaggatattatcctggattacctgagtgggacctaaatccagtcataagtgtccttctgagagacacttacacatatatatatatgtatggctgggcgcggtggtggctcacccctgtaatcccggcactttgggaggccaaggcgggtagatccccagaggtggggagttcatctctgctaaatatacaaaattagctgggtgtggtgtcatgcacctgttatcccagctactcgggaggctgaggcaggagaatcgcttgaacctgggaggcggagtttgcagtgagccgggatcgtgccactgcactccagcatgggtgagagtgagacttggtctccaaaaaaaaaaaaaaaaagagtgtgtatacacacacacacacatatatgtatataatacctataaggtaacatttgcaggttccagggattaggacctgatttctttgggatatttttcagccttctacagttagggcagtggaagccccttctgctacccagctttgctcctccatcttcctcacccagctgtctctcctctaggtggtacagattatatgacttcttaaatgaaagggcttttggagtgaggcacaccggttggcttcctgatctgcctctgttagctggctgaccctgagccagttacacactgtgccccagggccctcttgtgtagagatggaagctttggaaccccgatgcagcttggttgtaagatattaaatgggagagggcttggcacgggtccctgtcccctggtgagcactcagaagagaatgttgtccctccctctgcgctgcccctcactctgccctccctcatctgcactggcagtggtgggcacagtgggctggaggcagaggaggctgcttgttgagattcctggagcatttcctcccatttatttttcttagtgaagtcaaaaacagacaaatgtttattaaataatgaatcattctttcctagaaggattatttcatttcatgggtgagcggtttattgccagagaatgatgtcttcccccaaaatgatgtataacgtgatttggtacctaagtttttagacacttgaatgttttttctctcttccatttaaacttgaaggttgtgaaatgtagtccatattcattcatactctgttcatttcaggagatacccacaagcagaatggggtgactggggcctgctttgacctcatattttcctatttctacaggaatatatagaatatttactaaatactaggtatttagtaataaataccacaagccttcctaggtaataagcctgttaagaaaagtaagcaattatataattggcaaagaaattaatacaaagatctaaaccaagaaatatcaaagtcttttattcttagaatttttttcatttcacgtatattccttgtctgccttcagaatctaaaattctggcccactttgtttatagagcggtccctttagacatttgccttatttttaggcctcttttattttttttctttggagacagggtctcaccccttcacccaggctggagtacagtggcaggatcatagctcactgcagcctggatctcctgggcttaagtgatcctcccacctcagcctccagagtagctgggattacaggcacatgccacttcgcccagttaattaaaaaaaaaaaatcatattgatggggtcttgctatattgcccagactagtctcaaactcctggcctcaactgatcctcctacctcactcagcctcccaaagtgctgggattacagttgtgggccactgtgcccagcccattttaatcctagggctaggattatttgccattaccacacactgttgattattatagctatatatgcagctttaaaattggatacactgattcattctactttattcttctgtttacaggcaggtgcctgtaatcccagctactcaggagtctgaggcaggagaatcacttgaacccgggaggtggagattgcagtgagccaagatctcaccactgcactccagcctgggcgacagagcaagactctgtctcaaagaagaaaaaaaaaatagaaaggtggtgtggggacaaatcgaggtaacacatgtataagaaataaatattattgatcttttagtagttcgtaagcatggtgattggcttttcatgtgcatgtgtgaaatgtgccttccacaaaccttgttacaaagttggcacactaccattgatgtgaaagaaaaaagttattaaaataagaggtccttgatggcaaaaataataaaatggctctttggtggttaaaaggaccaatttggtccaatctcaactctttaaataaaaaggaattttgcttgaggtaagtaatttagttcctttgtggaaagttctttgacttctaagatgattcagagtttggaattactgatttagtcttctgactgtatcaggagtctttaaatatacattttcaattcaattaataagtcatgagttcagttaatttatcatcagtgcaatcagaaaccatcaaagtagactgagttgccagcctttacttctggctaatcctgacacatttcacatgtcatggattcctgaaattctgaagctgagattgctaatggttcagattggttactggatcattgtgttcctaaagaaaaattatacagctcgcttcaatgatgcagtttcccctcttttcctcaaaaaattttctatatgagagaagaaagcagaatctatggtccagtaaagcagtgatgctcaaatccaagtgcatgtcagaatccactgtgggtctttttcaaacaaagctggctttgccccagcctcagtggttctgattaattcagtaggtctggggtggagcctgagaatttgcatttctactaagttcccaagtgacactaattctgtctgtggaccatactttaaaaaccagctgggtgtggtggctcaccctgtaatgccaacacttggggaggctgacatgggaggattgcttgaggccagaatttcaagaccagcctgggcagcatagcaagaccccatctctaaaaaaaaaaaatagccaggcacggtatacctgtagacctaactactcaggaggctgaaaatttagagcccctttcaagaccctaggaggagggctagcaattagatcacatggtttatataaaatgattttgcaaaaggaagataaattttgtattcttaaaaaaaaaaaaaaaagccccagaaattgtctaagctttaggtcccacaaaacctagatcagctccctgataattgatcaatataattaactaatatatatgaaaggaatacagactgtaagcaagagaagttttttgtaggctaagcagtctctaagtcccaggaatgagagtacatgggaacgtcatctcagagaacaggagccccatatgtgaactttgtgtggaactttaattgaatgagctcaatggagaatttaggcggatgaaaattcaagttgatcttcactcacctactaaatgatcagcttgctatgtgtgatgtatcaatttatttgtgacaagatcagacaatttggagaatgagacaggttcaaattttggcttcacctcttataattgagttcactcattccctctgagcctattttgtttacaaaaagggggttgataataataatagctaatttaatagggctaatggggtgctatagtgaaatgatagatatgaaaaatgctctgaagatagaaaatgctgcacagatgttagtagctatacaaagctaacaaatagtatactcatcgtttatattaatagaatgactaaaaggtcattctgctggagaaggagtcagtcgactttttctgcaaaagaccagacagtaaataggctttgtaggtcatgctgtgtctgccatggtaggcaaaagcacctacagacacgatataaatgaatgtgcatggctgtgttccaataaagcttttatttgtaaaagcaggtacaaaaatggtgatacactaaaattgatctaaaaggacactgtcggccgtgcatggtggctcatgcctgtaatctcaacattttgggaggccgaggcaggcagatcagttgaggtcaggagttcgagaccagcctgaccaacatagtgaaaccccatctctgcacgggaaactgcacagttcagtgcttttgtattctactaaaaatacaaaaaattagccaggcatggtggcgcacacctgtaatcctagctactcaggaggctgaggcaggagaattgcttgaacctgggaggtggaggtttcagtgagtagagatcgtaccactgcactccagcctgggtgacagagcgagactctgtctcaaaaataaaataaaataataaaaggacactataaaataataaaagtcccttcaaattaggaacttccagttgaatccgaagataaaacaaataacagcaaccatatatgatgtttttatttaaactcaacactgaaggatcaaaattatatcggcctcagtttctgtggccttctaatgtagctgatatctctttagggcatgagggcacataggtggaataggaaaagcaaagtgaggaggaagagggaggcaagattaagaacagttgagggtgaaaatagcagcttgtttctttttatgcttcttgccactggaagtaacgatcatcgggtaagctcctgcttaaaccctcctctgggattcagcctcaacagtaagctcctgagcatggagtttcgtgaccaccaagaaagtaaagtgcttctattttgtaatctcctagtgaatttttaaagatgactgatggtgtccaggcctgtgaacatggaaaactgaggtaaacccatcaagagacagttgcccatccatcttaaaaggcaagttaatcatgaaccatgaataaagccgctgtaatcattcacatacaggtttttgtgtgaacagaagtgttcactcatcttgggtaaatacgtaagagtgggatcactgggttgtagggtgacagcacgcttaagtttatgagaaactgccagcccgctttctgaggaggtgcaccgttttgcattcgcaacagcaaagtaagaaagttcagttgctccgcatcctcaccagcagttggcattgccaggattttttggtttgtttgtttgagggtggtggtggttattttagcattctaaaatgtgtgaagtggtgattcattgtggttttaatcggcattttccaaacaaatgatgttcagcatgtttcatgtgcttgtgaaaaacatttatcttctttggtgacgtatctgttcagatgttattgcccatttaaaaaattgtgttgtttgttttcttattatcgactttattcatagttgccaaaactggaaagagtaaaatacctatcaactggtagatggatacacaaactcttgtacatccatgcaaaggaattctcagcaataaaaaggaatgcactgttgatacactcaacaattatgctaagtgaaggaagcaaggttcagaaagctaggtattacaggaccccctttttatgacattttggaaaaggcaaaactgcagggacagaaatcagatcattggtggactggcagtgagggaaaattcttacttatttttaaagaacttctcttgtcttcactccttagcccttactgtcttactctcctaaccctaccttcccagccatgggtttagtatctgtttcagcttgagtttctgatgcagaaacacaaatgtgattttctcaaattacaatcatggaacttgccagacagccagctttttccttggccctccgtgactgtgtgtccctgtgcatgcagtacccctgtccttgcaattctgctttccagggagagcaagccagggcgttgagtggggagatggttgaacattttaagaattgaaaggaccaggcgtggtggctcacacctgtaattccagcactttgggagaccaaagtggatggatcacttgaggttaggagttcgagaccagcctgaccaacatggtaaaacccgtctctattaaaaatacaaaaattagctagacatggtggcacatgcctgtaatcccagctactcgggaggctgagatgggagaattgcttgaacccaggaggcagaggttgcagtgaaccaagattgcactactaccctccagcctgggtgacagagtgagaccctgtctctaaaaaaaaaaaaaaaaaaaaaagaatcaaacgttgtgctgactcccttaggattctgaaccatggaggataacaatttatgctcaccctcgctacaccctgcagcagttaggaagaagagatctggtgggtggtgggtggtgggaagataagtcaaatctctttatagtacagtgaaggccagggaatggcccgcagtctttggagtagtgggaggttttttctgctgaatattgcataaagaaaatgagctatgctgcctgcctagggcttcggaatctcttccacttaacaaagattcttgttatacacatttattataaatagcctttgcattttacagggcagaacaggaagactccaggccattgggcaggagaatttcttttgttttttttccaaaatttttgttagagttgagttaaagagatactgtggcaatcccttttagataaagggcacatccttacgtgagtgcaagctaagcgtctgctgtgactgatgtcttgtggggcagtggggtctttcttttacaaatatacgttatagagtcctccaggagcaataatcaggtacacagtggtttttttgttttgttttgttttgttttgttttgtttttattgagacggagtctcactctgtcgccaggctggaatgcagtggcacaatctcagctcactccaacctctaccttcccggttcaagcaattctcctgcctcagcctcccaagtagctgagattactcggcgccaccacacccagctaatatttgtatttgtcatagtgatggggtttcactatgttggctaggatggtctctatctcttgacctcctgatccacctgccttggcttcctaaagtgctgggattacaggcgtgagccactgcacccagcctacatggtgctttaaaagaagttgggaatgttactgttagtccacaactccctggcttgctttttttttttttttttttttttttgagacagtctccctctgtcacccaggctggagtgcagtggtgtgatctcagctcactacaacctctgcctttcgggttcaagtgaattctcatgcctcagcctcctgagtagctgggattactggcgtgcaccatcacaaccggctaatttttgcatttttcgtagaaacagggtttcaccatgttggccaggctggcctcgaactcctgacctcaaatgatctgtccacatcagcctcccaaagtgctgggattacaggtgtgagccaccgcacctggcctccctggctttcattgtccaagctcattgaaaatcttttatgctgctcatttgtccgtgtgatcatggtttagatgattcacgtatggattcttgctattcaaagtggagcctctgaataagaacttgggcatcacctgggatgtagtttttagaacgacagggccctacccagacccactgaatcagaacctgcagacccactgaatcagaacaagtcctcagacaatgcatttgcacattgaagtttgaaaggcattgatctaccttaaggtcctgccaaaacatcccgcctgctctgttgataaccttgttgtgatatgaccctcagaaatgtacccatggtgaatgcttctgacatccacatagctgtgagtatagatgcatgccactttgtcccgaatgtacttcattattaagtgcttagtgctgagctgggcacaaaagatacaaaaacaagtaaagcatggttgctgccttcaaggagctcagaatgcagtgcgggacacagaaagagctgcagcatcccatcctccagtgtctttatctgtcatctgactttctcctctgacacaaagtaccagtccccttctctggaaacagttttgaatcctcaatgtacagccccctgaacacctgcctccaaatcatttgggtcagaagggacggtgcttatgtaaaaaaagcgaggagtctgtttgagacctactgagttacaccctctgagattgtggcgcttttttttttttttttttgagatggagtctcactctcgcccaggctggagtgcagtggcacaatctcggctcactgcaacttctgccgcacaggttcaagtgattctcctgcctcagcctcccaagtagctgggattgtaggtgcctgccaccacgcctggctaatttttgtagttttagtagacacagggtttcaccatcttgaccaggctggtcttgaactgctgacctcgtaatccacccggcttggcctcccgaagttctgggattacaggcgtgagccgcggtgcccggctaggacccgcccggcaccatcattttaactgttatgatgcacgttatagtttgagaccactaacctgggtgctgctttgaaatcctctgattatgcaagtgtcatacaaatggatgttaaaatagtctcaaatatttaaggaatccttcagggattcccttatcctcaattcaggagattttgaagtggcttccacattcagagctgcttttatctttggctgaggcaatataaggatctttgtggatggtatttaaggatagttcaaattcatatctatgtattttagtagcatgttctctaggagcaaattataatgctttgttctataatgagttaatagcgtgaacattgtcctaacagtcctgtgactttcttgtttaatgtttatactcatgtaatcaaacaaattgaaattggattatggctgttgcacgttatatcagttattatccagtttaaatgcaggtctgaaggaagtaaaattgatttttctatgctacttggggacatcataggttattggtatcctggttgaattttcagttaggtttctatgaaagaaagatgagtggttaggtttgttgaattttttttctttcacagtattttgtaaataaactgggatatttcattctaattaggaagtcagatgccttttaaaagttgggtgatcagtttccatatttttatttaaagcatgtctggctttttaaagtgtatcataatcctgagtaacatttttatttttagaaagaaaaaagaaaacaatagaacaccttcataatactcagttactacagtaacagctaccatatttatcagagaattagctgtaatatgtaccagaatttcacacataattgaacctgtctttctgtgaaccagacctgtttttaaaaactgccttcattccataaacaccgtttgtgtaccttttctgtacaagccccatgcccagtagtagggactcagagtttatctaacatagatatccttcacaaaagcagatgttttatttttattcattcattcatttattcatttattttagagatagcatctcgctctataatccaggctggagtgcagtggcaagatcatagctctctgcagcctcaaactcctgggctcaagcaatccttctgcctcagcctcccaggcaggtaggacaacaggtgcaagccaccacacctggctaatgtttaaaaaaaaaaattttttttttttgagacagagtctcattctgttacccaggctggagtgcagcggtgtgatctcagctcactgcaacctctgcctcccaagttcaagtgattctcctgcctcagcctcctgagcaactgggattacaggcacgtgccaccacgcccggctaattttgtatttttagtagagacagggttccaccatgtttgccaggctggtctcgaactcctggcctcaagtgatccgcccacctcggcctcccaaaatgctgtgattacaggcgtgagccaccacacctggcctaatgtttaaaattttttgtagatatgggggtctcgctatattgcccagctggtcagaaatacattttattactacttaatgcttcgaaagcaaagtgatgggccagagaacacaaaggcaagggtgacgagccctcgggaagtagggaaaggcctcatgggagagatggcatttgtttgatctggaccttaactcataagtaggcatttgcaaaatggaaatttgttatttaaatcataaaagcattatattctgattacctggtcatataaaaaaatcggttaaaaaatagtaacattaaatttaatcaatagtggatgtattaagcacttactgtatgtcaggaaatgtgcttactgccgaaaatacaacgggaaactgccaagttagagaatagtcaatgagaccaccctcaggtttgataatttgctagaaggactcatagagctcactgagggctgtgattatgctcatggttgtggtttgtcacagggaaaggattctgattaaaatcagcccaaggaagacacacataggacagagtccagggaagttctgagccttcagttgtcctctccccacggtgtcctgggcagcataacttccctggtgttgccgtgtgacaatagcacagagtattgtcaaccagggaagttcatccaagccttggtgtccaggatttttattgaggctccaccccaaaggcatagacaactggtccagggctaatctcagtctcgagtccctccagaggtggagctgatactgcatgggccaagcgcccaccccagatcaccctattagaccctctagtgtatcccaaggccactaggcaaacagaaacaccccagtcaggcacaacattccaaggtgttagagtttacctcccagaagctgaaggcagaggctctcttcagccaaggttgaattcttcactgtacagaaacaaaaccagactctgtaagtttataaagctcactgtaaagtgaaggagatgaataataaatggatgattttccaaatatttaacaccaagctgcagcaggagtacgaaggaaaagcctgggatgctgtcagggaggacactgcctgtcaggaacatcttccaaaggaatcaacttttgggctgagattcctagaagatgagagggattcatcaggtgagcagtgcagggaagagcattctaggagggtcacagtcagtgcaaaggctctgaggtgggaagtagctgggcgtgttccaggaactggaagaagaaaaggggactggagcagagacaaagaggagggaatgtggttgcagcattggagatagaagcagggacctgatcccaggcggcctgtgagaccctgaaagcgattatagactttatctgcattgcagtgggaagccactgtgtggttttaaggttcgagcatggatactcatatttgtgattttcgtttttgaagggactcgcatttgtgatttttgtttttgttttgaagggacaggtgtggctcctgtgagaacagcttgttagagatgagtggaggcaaggagactgttaaaacactactgcaggccgggtgcggtggctcatgcctctaatcccagcactttgggaggctgaggtgggcagattacttgaggccaggaattcaagaccagcctggccaacatggcaaaaccccatctctgaagcatgaggatcacttgaacccaagaggaggaggttgcagtgagccaagatagcggccactgcactagtgagacactgtctcaaaaaaaaaaaaaaaatgacagcagccctcctgatgagatgttggctggaactagggtggcagcatggagttgagagaagggggcaagttggagagagcaggaggaggcagagttggcaggacttgtcacacatgacttcctgccagcagaccctcagctgtcacacttgacgtaccctgtggacatctggcagacccatctatttgttgcttctgccctgctatagacagagaatcagacaaccaaactcactggaatgatgtgtaaggaaggagaggcagcctttgaaggggtgacaggtacaatcctgttaacttgtttcatatctctgagcttgctgctgtctgttctggctgctgaaccccaagtcttaaaccctcttctagcctcacttgcagtttgtgttgtgttccagacagttgtggttgccaaagcagtttactgtcaataactcttccaaataattgaagtgttactgatcgtagattcagaaacagcatgagttaaatcttgccctccctagaaagacaactgttaactagaaaagcataatataaaattttctgcacagaacctggtacttaggaggagcttagtaaatgttgaacaaatgagaaaacacctgatcctcatttaaacatgaacattaaagttgtctgtacacctgtggtgtgttttaccaaacccaaacaagacctatagttaaatactcccttgattttccatgtgtatttcctattttctgttcctttctttgtaaaaggagcgtatgagactttgaatatagccaaaaacatggctaatatgctttgcctattttgctcttttttttttttttttttttttttgagacggactctcactctgtcactcaggctggagtgcagtggcgcgatcttggctcactgcaacctccacctcccaggttcaagcaattctcctgcctcagcctccctatttcactttgttaattggctaatcaaataacttacgcttgcccagaaacaattagaaagaggaagtactttcagtgctcacagaatacagtcagtgagagaccttggattttcctttccaactcatatatttatatgactagtggctagccaggactcttacttaaagtgctgaaagtgctgtcacttagccaattggacattttctgcttccatgtatatggggggaggggcgctcagctagagatgacaatgttggggtgcctgtgggatcttggcttcaagtcagctataaacaaaaggtgtcttaaaagaggtagggattacaaaagggtgtaggggtgtactgctaagtgctttgtgtaaattggcagatgatctgtaaacactttccagctcgattcagaattttctgcctcttgaaatctgattattcagatttataaaactacaatttggtttctgtctttctgcccaaaggctttctggctgtgggctgcaatacctcccttccccaaccacccctccccgccccccatttcccccactcgccccacaatcaggatcgtagaaacccagcctggtgcggtggctcacccctgtaatcccagcactttgggaggccgaggcgggcggctcacttgaggccaggagtttgagaccagcctggccaacatggtgaaaccccatctctactaaataggaaaaattagccaggcatggtggcgggcgcctgtaatcccagctgctagggaggctgaggcaggagaatcgcttgaacctgggaagcggaggttgcagtgagccgagatcgtgtcactgcactccagcctgggcgacagagcgagactctgtctcaagaagaaaagaaaagaaaccagaaacccagcaggcctagagcatcaactttttctaaagaggttcagtgggtttgaatgaagtttctaagtcttgagagtccaaaaaggaaacgttcgttacaggaagggagtatgttggggtgggggatcctccttgccggccctgagccagtcccctagcagctggagcatctggcgggagcacctagcgggagcacttcacgggagtgcggccgggtggggcggggccacgcgcctccccagcagccaatgggcggccgcggcgggcggggcagggagggcgcagggaggcgcgggcgccgctctcttcaacttgagcccggggcagtgcgcgcggctgcttgagcgacggcaccgctggctggtgccggcaccctggggcttgtcgtagcacctggggcggcatccccgcccgacttcggaaggaccgggaggcaaaggtgaggaagttggcgaaggaacggctctcctttgtttgcaggtgcgttcagggggaacgggggtcgagcccaagctcgctcgcggggacagcgaggcgggcgcgggagacctgcgggacaaaggctgcgccctcccttccccgagtcagcgcttagcgagttgcctggtcctggacggctggaagggctgaagagggggctttctgccccgccggtgggaagaaggagtgaggcttgtatgaaatgggggggaggcgtccttggacccccaattcgccagtgcagcaggactgttcggggtgggctattcattgatggggtctgcacggggcatttctgccgtggacagcgttctatgattgaggcagtgactgccttcgcctcacgtgccccctggtgaggccacatttctgtcttcctgtctacattaggactgaaagatatttcagggttttggtaatccagtatttggattaaaagcaatatcctttcgtgtagaaaaactgtgcatttccaaatgattttagttacacgatttaggatattggtgtgacttccatgcgagaaaatatctcaaattccccaaatgtagaaacgcagccagctcttggcattgagaaagaagtagtgtttttgaaaagaaaggcgtgaagatttaaatattgcttacaacactctattagcttgtgggggaatctgtgccttttctattatctgtttccctataccaatattgtaaccaggcacgtctatggattcctaattaatgtgtagctgtgaatcttcattactgccttgggtgggagaaggcggaaggagggggcaatcccattagtctttttctttctttttataactgcagctgcagcctggctttgacttgtatcatgaatgggggttctgcctgctttcctcatgctgttctcttttaggttttcttaggccattgagcagttggcccttcctccagccgagctcttacacaagagtagtttgtaagattctctctaaagttcagatccttgctgctgccttttagttagttgagttcagaaaggaattattaagtgtcctgaggcctttcctaagaagttagaagcagaatgtgtttgtaaatgtggtctgtaattttgtaaaagttataagtaaaagggagtgtgaatgaaatgcttaagaggggaaagactttccataaagcatcagccagtattatcaaagaaggtgtcatggtttgtagctcagtaagaaccctactttccgttttgcttccttttttttgtttttttttttgagacagagtccctctctgtcacccagcctgtagtgcagtggcacaatctcggctcactgcaacctctgcctcccaggttcaagtgattctcctgcctcagcctcctgagtagctgggactataagtgcacaccaccacacccggctaatttctgtttttttgagtagagacgggatttcaccatgttggccaggctggtctcgaactgctgaccttgggtgatccacctgcctcggttctcccaaagtgctgggattacaggcatgagccaccatgcctggcctcattttatcattctcactttgcagatgtgagaaacacacttttctaacagccgccacgttgtttagttctagcttttctgcaatggggataatttatttaataagtatttattggacacttgccatgtgctgggcattggtgctggtgattaagtggcataataaatacaacaggtgtcttcttcctttcttggagctcacactatgctggcgtggggcccattgcaggttctctgcactggagcatccctgggaagcagtgtggatgacaccaaggtgagacaagaagatactgctgctgatggccgccttggaggtcagctgagcatgtggcagtaggcgcaaacaacgaggggcctcaggtcatctgcactccaagggtggaagtattaatcacaccagtgggccattgggcactaaagtcggtcatcttgaacttgcttactttgatctcaaaggagcctgcagctgcaaggaggggcagagctgagttctaaagagtttgaacattggcattgttgatttcaatggggtaattccagtttgttacaaaactatcagtcatgcagcctccttgtctcacctatacagctttcctcttggacagcccccctaggaaatgaatttctttttctttcttctttttttttttttttttttggagatggactttcgctcttatcgcccaggctggagtgcagtggcgtaatcttggcttactgcaacctgtgtctcccagattcaagcgattctcctgcctcagcctcccgagtagctgggattacaggcgcccgccaccacacatggctaatttttttgtatttttagtagagacagggtttcgccatgttggccaggctggtcttaaactcctggcattagcttatctgtccatctcggcctcccaaagtgctgggattacaggcgtgagccaccgcgccaggcctaggaaatgaatttcattctgtaccactggctgagcaaagctttacatctgtccaggctcccgagtgttaagagatgacttaactgtgtccctatttactctccatatacgtttcatgggtttttgggagtaaactgatggcatataacctcttatctaggttttcacaaatctctaggatcacagaaaaacatactaagtagtagtgtaacttgtctttttaaagagcttgtgttgaacacagaatatgacatatttgaggagttcttagacttttggattcctcgggccctaacatagtacctagtataggatgccctccataaataacccagttgatgaatgggcagatgaatgaatgtagatgaaaatacttcattgtctacttttagggtttaattttgaccatccatgtgcttaatatttatagtctaatggttaatatgctgttcggcagataaggagcatccatgtgtcaggcaccttgtgaggcagcatgaaggactgagacagatgaggtccctgtttgaagaggcaggagataagccggaaaaacaattcaggaagcaagatgatacaggttatgccgagtgtcttgaagaccatcaacagcgtgatgcaacagagtagctcagaggggaaaggggccatcaggaggcagcctgtcctaggaggcaacatttgagctgggcttgaaggctgagaagaagccagccatgtagggagtgaatagaaagcactgaggaacagctgggtgtggtggctcatatctgtaatcccagcactttgggaggtcgaggcaggtggatcacctgaggttaggagttcaaaaccagcctgaccaacatggtgaaaccctgtctctactaaaaatacaaaaaaaaaaaattagccagacatggtggtgcgtgcctgtaatcccagctgctcgtgaggctgaggcaggagaatcacttgaacccaggaggcggaggttgcagtgagccgagatcatgccattgcactccagcctggacaacgagcgaaactccatcgcaaaaaaaaaaagaaggaaagcactgaggaagtggagcactcaacgtgcctgaggatgaagaggaggccagtggtttgtgctggaagaggtgggtggggacaggatcctttagggcttgtgggcagtgcttaaaggtttgccatgaggtgcccgtgaagagggttaaccaggggaatgccatgatctagtttatttcatacagaaagatctcagggaatagatattgggaacaggagtggaaaacgagggaccagttggctagccctagtccaggagagatcagtgacatggcagagggcatgaagagaagcaggtgggtgggggaaatgtggaggttgaactcgccaagttgactgtagaagatgcaggaaggggtgtgatctaggaccatacctgatttctttgatgcgttgtttatgtctgtagaaaatacatgctaatagaagtaataactgttcgaggacaaagttattaagccatggaacaactccctttacatttatgttgtatcaagaccttgatttaagccagacacggtggctcatgctgtaatcccagcactttgggaggccgagtgtccccaaaggatcacttgaggctaggagtttaagaccagcctgggcaacgtggcaaaaccttgtctctgctgaaaatacaaaaattacctgggcatggtggcacatgcctgtaattccagctactagggaggctgaggcacgagaatctcttgaacctgggagatggaggttgcagtgagctgagatcgcgccactgccctccagcctgggtgacagagaaacacactgtctcagaaaaaaaaaaaagactttgactttcttttctttggttctccagtgtagatgagcagacgtatccatccagtgcaatcttgtgtatttggccatttttccaagatgttttcacccttcagtaccctttctgtcattctcaactggttatgagacctttgagcatttttctttgttctggcatgaaaataaagaatcagactaagaagagaagatgggtttaagccttaatttatatggaattattctacctttgttcccagtttataagaatccattcataattacttttttttttttttttttttgaagacagagttttgctctgtcacccaggctggagtgcagtgtcacgatctcggccccctgcagccttcgcctcccgggttcaagcgattctcctgcctcagcctcccaaatagatgggattacaggcatgcaccaccatgccccactaattttttgtatttttagtagagacggggtttcactatgttcgccaggctggttttgagctcccgacctcaagtgatccaccggccttagtgctgggattacaggcatgagccactgcgcccggccccgtaattacatttgaagttacttcacatgcagcatcctctgtagttccaacaattgatactctctcataaatataaaatttgttccatatgtatttcaattcaaagagggtaactttcttagtaactttgcaggaaattcactgagcattttgagagctagagaagccatttccttatagctgtaaagtagaactaaatactgagtttctgataggattctctgcccccttcttccagctgcagaattgtgaacttgaaagcttaacaacatgtttgtcagagaacttgagttttgagataactttggtttggttttgaaaaaaaaaaaaaaaaaaaatatatatatatatatatatatgcatagaaaatattccttctgcagtcagtattttcagcagatgggaaagggcaggagtgacttgagcttccagccatttcaatctgggtaccttataacatggaagcttgtctggggatgaataaattatagcagttggaataattatgatagaggacaagcagcagccgagagtacaattgacaatggggccaagttggcctgattctgtcgtatcagagcatgcatctgtttgccaggttacctgaaaatgctgttttcgaggattctggtgtgttttgtttttcatcgccctcccttttaaaacactgtaagagccatcatctgctagtgaccttttagaaataaaatggctggggcagacgtccacatggctgccgcttcacatgttgggcatccgtgtaagatttaaattgagcaaaaggttgtttggttctaaagcacttgcaggttgtaaatgctcttactcttgcatcttggtggaacagtttctagccagccctgggagtttgtcacctgtaacgagaattattctaccatctcagccagttgcagagtccctcaattggtttacactctgctgttaacatcttgaaaatgttcattgttttttttgacagccttgcattttcattttgcactgggctccacgaagtgtttagccagtgctgtccacatcgtatgttgcacccttgaaacagattgtcctctagagcaggggttggcagatttttcctgtaaaaggccagttttaaaaaaaaattttttttttgagacggggtctcactcagttacccaggctggagtgcaagtggtgtgatcacggctcactgcagccttgacctcctgggctcaagcagttctcctgcctcagcctcctgaatagctgagactcacactttacacaccaccacacctggctatttaaaaaaattttttttagagctgaggtctcactgtgttgtccatgctgacctcgaactcccgggcactggccacatattaaatatttgaggcttttggagccatgtggcctctgttgcaactactcagctctgcagctgtggcacaaaagttgctgtagcctctgcctaagtgaatgagtgtggccgtggtccaatactcttcattcacaaaacagtctgagatttggggggatcataatttgctgatccctgatctgaaggacctgcacagaacctttaatgacaattcaaatagggatttcgtcacttggaagtaagaaggttcagtcatctttggccagctttgtgttgtgttgaaaattagcccccaaagagaattcctgcagaaggtcagggtctttggggtatttctacacttgagcctctttcttttttaagatgacatacttgttatagttgtcaaatatggacaataacaggaagccaaactcaaataataataatagggtgttacaaagccgggcacagtggtccccacctgtagtcccagctgttctggagcctgaggtgggcaaatcacttgagtcaaggagtttgtgtccagccaggacagcatctaagactccgtgtcttaacaaaaacaaagcaggatgttacagcagtggcgttgtggttttcgttttttaaagattcttcatcatattcaacaaaaaaggaaaaatgatgctgaaacaaagagacaaactgcctataaaaagtaacctgagtagcagggcacggtggctcacgcctgtaatcccagcactttgggaggccgaggcgggcgaatcacctgaggtcaggagtttgagaccagactgagcaacatggtgaaaccccgtctctactaaaaatacaaaaatagctgggtgtggtggcgccgagtaatctcagctactcgagaggctgaggcaggagaattgcttgatcctgggaggcagaggttgcagtgagctgagatggtgccactgcactccagcctgggtgacagagcgagactctgtctcaaaaaaaaaaaaaaaaaaaagtaactttagtaaacaggaagagtacatattctttcaaactgtatcaagaagttaactcctgccattatacactagtacctctgagggggtgggaggaatgctttgtgggctccccaaagggcagcttttcagtccataactgcctcagcaggtatgggaatgtgttgtcttgggtcttttccctaaatgataagcagaggtttatttctcttaagagtacaaatataaagaaaattatctggggataaatcttgatagaaatcaatatacgagggaaatttatatattgatttcttcaggagcagaggagctatttctcatttagacaaatgttccaaggaaggaatctagttaggagctctggcaacattgttgttgtttctgctggagatgatcagagtatagattcgcttggcttttaaatagagtcataagagattaataatcttctcagaacttgcctcctgcctgttcagatgaaatatatgttttattaacattgtttcagctgacatgaaaacaggatatgaaccaaagtcattttaaaagcgctgtctgtgatgagcaatagcaggagaaaaaggaatccagccaactccctactgtttgtggcatcattcccttagcttcttaccaacctgatcaggaagaagggagttcactctttcccctacttaggtatttattcacatattcaagaatattgattgattgcctactatgtgccagacagtggtaagtgaacaggcagaaaggttcttgctcgcatgagctttactttcttggtggagagagggaaatagggtagcttcagatggctgtgaatgttgacaatgactgggggatcctcagggttcttttggaggcagtgatgatcaggatgatgaggggaggacctgggggaaaagcagaccaagcagccgatcagcaagcccaggcaggggcgggcttgtatgtttcggagcaaaacggtcccagtgtggctggaggcagggagtttgcggcggtggggcgggtgggggttgggaattgtaagcagaggagtcatggaataagtggctactgagcagatgatgaaaggaaggtaatttaaaccaaacacagcacttaattaccatcacgagctccagcagtggtggaaccaaaagtccaatggggacagagagagaaaggcagagcagaggctacctccagtgagggatggggtcctgagcagagccaattaactgggagggagccaggctcaggtgctaggtgccccagagctacacggcaggaaagagcccagccagcaggcctgtgttctgtttgcagatctaccacctgctagctgtgggctttggagcaagtcaacttaaactctctgacccttcaattcctcatttgtaaaatgagtcgtgatgcttccccctgcaaggttattgtgtggcttggcgacagtgcgcagcaagaatagagcctggctagacagaagcaatcatagccaggagccgctactgttacttggttagtggtaatcagccttcctagggttggtgtctgcttttctttagatattattgagtttacattataccagaaatacttgtatctagatggaagttaacaaaattcaggactgggcatagtggctcatgcctgtaatccaaatacttttttgagaagctgaggtgggtggattgcttgagcccaaaagtttgagaccaacctttgcaacatagtgagacctcatttctacaacaaataaaaaattagccgggtatgatggcaaacacctatagcccccgctacttgggaggttgaggccggaggattgcttgagccaagtagtttgaggatgcagtaagctatgatcgtgctactggactcctgcctgggcaacagagcgagatcccatctcttaaaaaaaaaaaaaagcaagcaaaaacaacaaacaattcaaatgaaggccatatgtattggctttccatgttatctaccctagtactcctttgaactggcacaaagaaagccccttgaaaattcagaaagtgattcaccatatccacaagaggtcctccatgtggctgggtgctcaccgtggttttaagtaggaggcttgtctgcaccttgccaggagtttgtaccctcatggcattctggcatggaaaccactgtgctgtcattttccctgctcagaatcagttctaaatccttatgcgttcctgtgctttgtcagataggagccttctggtgtcaaggtgtttcgtgttgttttatttttttgagacggtcttgctctgtcacccaggcaggagtgcagaggcacgatctcagctcactgcaacctccacctcccgggttgcagtgattctcacgtctcagcctcctgagtagctgggactacaggtgtgcgccaccatgcctggctaatttttgtatttttagtagagacagggtttcgtcatgttggcaggctggtcttgaactcctggcctcaagtaatccacctgcctcaacctcccaaagtgctgggattacaagtgtgagccaccatgcctgacctggtattttttatttttgttttaccatcttggctttcagaaaggaagctaacccatggtttcacagttcaggtagaatttatataacgttatcctttcattataccctaaactttaaagttgaaactggaacatggtgtaaattatctctcacttaataactaactataatttgtgtgtgtattcttctctcagatattcagagatgcaagatttttgcatttggttttttgttttttttttaatctgtgatatagcacagatgaaagctgaagctcgttaattcttgcttaaagtcttcaaagatggacttttaaaaatactcgtttcctggttgcttttaaatatcctttttccctcctcctcattagtaagcaggctggtaactattgtgtcttccctccaatggcatgagaaagtcctttgtttagaataatgtgccttgaatttcaataacctcaaccactttaactcctggctttacacttctaagtgctggaagtctaactttcccatcatggcgctgctgggcaggacagtgaggtgggaggggagcttgctttggaaaggaaggcacacttggtcagagacggttgttcatgtcaccggttgatcctgggaaggatagaacctttccctgagatgaattctctaaatatcagccagaaatcagatggtaaatttgcataaattcagtattcatttcagttcagaggcctttcacctgcggcatgtagattctaaagggacctgggattgagtttcaagaatcactgaactgttccagctctgcccccttccaaaattgtgtataaaattgtgagtctgtgcacttttttttttttttttttttttggagtgttttcatccgagggccttgatccaaaacaggtcaggaacctttcctttctcctcgtggagctccccttccctctctcacatagtgattggcctggcctgcactgtaaggccatactcaagccgccatcctgtaggagctttatatggattaaataatggaattttatggcactctcaggacctgaaggcctctatgattcccatttcacagatgaagaaactgaaaaacaaagaggctaagggccctgaccaagggcagacagctgataaatgacacacacacacacacacacacacacacacaccccactcacacccacccacccacccacccacacccacctacccacccctgaagctggagggaaaaaataaactgtcagactcaggagctggtgcaagaattttcatgatgtaaagttttgcagtgtttacttcattgtcctgtggataatggtgtgatgtgtgctcaaaaggctagagagatggccagtgatgaaagacaaacatcaaaaagaagcatgcaacagagacttctgcaaaaatggagtgagaagtctactggcaagtccttgcctcgcgtgctcagtttgtgaaaagtggacagttgtgcgcagcatgagaagtaggtggctgtgccagggaacaggagatggcgtcctcttccaaaaagctggaatagacattgtcattctggtgtgctggtttttttttttttttttttttttttttgaggaatttccttttcatttggattccagttacacatgccaggtacttctgttatttcaggcttatattaatgaaaacattgccaattactccggcatttattttcccaaggaacagccacggagagcatgctgatcaggcagccttgggatgtgcggctcatgtggaattaatcttggggtttaattcttcccactggcatcttgtacagcgagaagggagtagacttacgcctggcactaaatttagccttctccactctcagactggtttgtcttgtgcagaagcccagctttggactgatgttttcttcccagcaaatttacaaggtgctgaattggtggagctgctggcactgtctgtgactcttctgggtttctgaatgacatttcaaatatcactctgcggtgtcttatttatggctggttttcactttgatacttaaatcaagcagtgtttattaactccaaatgaattaactgtgttaaaagtttgcagtagcattttttccaagtctgctttcagggaaaaacacagtagctacatcttgatggtatgtttttaagtgaatcactagcagtggatctgatttaaaatatccaagactacaataataattatacacaaaagaaacaggttgtattctcagattgttagatttttaaagtttttgtcacacactacagataggctttttattaaaaataagaaattgaaaacatttggtgtaattaaaagcaagtcaaagcactaacatatccttttctgataaaaatctgagcactaagaagttcctagcacatccattctgagattaggaacccaagaattagggaggttgtgtgacttgcataatgttacccagctgtggattcagactgggaccagcatccaggtctctgggtcctttgctgatcttgtaaattgctacccaagcctggctttgataggtggaaccgagtagcacagagggacctgagccaaggggtgactctccagcatcctgtatcagctggggtccagcaaacctgagcagagggcccctgccactcccccaggtgactgtccttccgtgggagacagtccatctcaaatgctgcccagcacaacccagccgaagagatgaagctattggatgacacagtgataatagctgttaacgttgcaggttattgcagctttgttacatgcccagcactcccatacacgtgtcgtcccatttaacttcatgcttataatgcccctgagcattatgagcatgagcaggtgtccttatcccctcttcaatgatgaggaaacaggttttgtggggcataccatgtaacacagtgtgcctggcacacagaggggccctggaaatctatgttgggtaaataaagagaaggtaagcagtgtacttgaaggaatgtggctacccatctggatttgagcacagctgtgtctgcctcttcagcccaaagatcctcttaggaatttttagccacctctttccctacaaaagttcaccaaaagagaggaatgttccctgttcctctaaaaccctaggttcttggccaaaccctttggccctaccttgaatacctgtgcctagggactgtgtttgccatttaggagacaaaccattagggggctctgcaggactgtgtagaagggtggagtacccatcatgggtgcatctaagactagaattcgagtcctgcagcctactgtcaaactctcttccccatgtagtagctgtgtgaccttggccaagtgtcttagcctctctgaacttgtttcctcatctgtcagaacagtaatactgaccttgtccagttactgttaggggccaaacagagctcaataaagggtaattggtggctggtgttactgtaatcattaatattagtcctgttaactgccctggggcatgctgatcacaatggctttccttcagtactgaggtagatatttgcatattttatcacaaaagtcaaatgtgcttattgtataattttcaaagagataaagtaaaatcctccataatcctctttccatattacagttgacagttcgggtattatattccaagttttttactgtgtatatattaaaatacacatgcaaacattttgttgtttttataagaccatgcttgttttataaaaacagcttggctttgtttttgctccacttactagtgtgccatggtcattgttccgcctcagggtgagcagctcttcctttccacttaatgactttgtggttcactgtctggtgcacttggcgtttcatgccatgattttagctccatccctgcagggccctgctggccgctccatgaccctggccatagagtgcccgagagaacgggtttctgtaaacattgggtttcttcctttcctcctcgttatctatccagtgctccatgctcttcggtctagttgctctgtgtacggtgcatgcaaatcggctgtgacaatgccagaaaggaatggtgtgagcaccatgggtcaggggattaagtgacttcattagggtcccaggcagctcaggacagctctgggtagctcagggagggaactccaagagtgtggccccaaccagacttgcactgtgttcctctctccgttccattcctctctttcctgggacgtctctgatctctcccccattgagctgtcatctcctgtctctcccacttcccacccgcccttgacctgtgctgcctccctccctccctgttgccctgtaaggatgcatctcaggaaaagtgcctggattccagtgatgtggctctgttaatagagtgtcaggaatgtcggtaaaacaggtaaggctatgtccatgccgttgtttctgtatgttttttattgggagcaggtggaactggaaaatgaagacacgtcctctgccagtgtttactgcaaacagtttcctgtatttgactgtgatattttaagcttgattacctcccccagttgatatgttgcctctgtaaattcagctggcatctcttggcttcatcataatgtggctcaaaatacacacttctgggtgatacagttgacctaaaataagcacggaaagcctattaattgctgcagagttgggaaattagatgagctgtcagtgctcagactcgctgttaacggggctgtgttattggcgggatgccgtgtgaatgctaacgtgttgtttctgctctgttccctcacgccttcccggattcagagagaggtaaccggccgattttcacttctccccccttcgtggtgtcttaacgtgtctggcaaagctcacttgctttcttcatgtcgcattgccatcctcacaaccatccttgtctttgaaaggcagaacttttgttttgttttgttttgtttcgcctcttatcaccagcatttaaaacagagtctggaattgcatctgcgttcctcattctctactgtgtttgaccctggttgtggaaggtgatgggctgagtgattaagtctaacaccaatgtggtcactcactaacgactgagaaaaatctcatcagtgtggcagggagtgaatgtgatggaaataggttatgtgccatgttgtagaaggaggcttttcatgcttctggaaaaattaatatcatggccgggcgtggtggctcacgcctgtaatcctaacactttgggaggccgaggtaggtggatcactcgaggtcaggagttcaagaccagcctggccaacatggcaaaatctcatttctactaagaatacaaaaaattagctaggcgtggtggtgggcacctgtaatcacagctacttgggaggcctaggcaggagaaccacttgaacctgggaggcagtggttgcggtgagccaagatggcaccactgcattccagccagggtgacagagggatactctgtctctaaataaataaataaataaataaataatattagtgcttatattacatattctctagaatttgattggtaagggttggcactaggctactagcctagccagaagcactgattcagtttcagtgtcaattattagccaaaatatatggtcctccctctccaccacaagaaggatagaaccacagaaaagacatacctatgaaacaagagattttgacctcagttgtgtttttccaatgctctgcatgtccgcctgcccgtttgattgattggggactttaagctccatgattccatagctctaccacttaataaaaactccacttttgatggaataagggaatttggagataattctccttgaatgaatgatggtggttcctgctgggcaaagcggagagacacgaaggcagatctcctctttgtgtcggagttggtgtcatgtaacctccctgcctggttgggagctggaagtgatgagtcctcagctggtatttcctgccacactggtgttgtgactgccctctgctggtggctgttttcccctgtgatgtgctgctgtcatagtccagtggttaagagggagagacagcatagagtgggcggtgacacctgcagggctggtcttccagagagtgtgattaggagaatttgcaggtttcactgactttttaaatcactttgaggagaccctggcgggggcaggtggtggaaagttctggaggatgagggctgtgcatgtggatgtgagctccttcatgtaaaataacagccagtcccatcagagtcaatggggaggacattttcaggtgttcgctagttcctatcctccttgtttatgtgagtgtcctcgctgggaggcagttgctctgaatattaacaccaggaccctgttctagagagggctacagattctagtttgcccaagccacctcgataattgcaggtggtagaatttcagatctgctatttacacactgtgtctcatgagcgtgcctggtgaagaattccctgctaagcctgtgtgtttacccaggtgacgagtacctgggatactcctttcggaggctaaaaaacttagcatctttttaagcttgcaaagaaggagaaagtaagttaagcttaccaagcgagagcctgaactttgtgaaattagtgatgcctgcatgtgatacatgtgacattgggttaaaaagaacagaaaaccagagtcttacatgtgtgtgttttgcggggggtcattctggattggccatctggaaagatgaagtttcttacgtactttcgcttcctgattcctcccactctcaaaacaagattttttcaaagtgcagtcagaaaataaaagcatccagtcttgaaaacaggactcattcttcctccagaccttgtacagactgtcaacaacccacatttttgtatagcccaggaaccctataattacaccgtgttctcatgtgggcttaccttttgaattctattttggatctcatgctaggccctgcacaggtgaaacaaagaggagagaaagccctttgtcctaaagtgccagaagtgcgatgtttggatccaatccgtttgctgctgtcttatccttatttgcagatgggacctgccctttgcaatagcatcaatagaaagataagctgggagggaagggtcactgggtacattttagcaagtcttagtataattcatatgagtgcaaatatttattaaaaaacacccctcgtggggccaggcgcaatggctcatgcctgtaatcccagcactttgggagtccgaggtgggcggatcacctgaggtcaggaattcgagaccaccctggccaacatggcgaagccccgtctctactaaaaatataaaaattagccaggcatggtgtcacacgcttgtaatcccagctactcgggaggctgaggcaggagaatttcttgaacctgggaggcagaggttgcagtgagccgagatggcaccactgcactccagcctgggcaacagagcgagactccacctcaaaaaaaaaaaagaaaaaagaaaaatccctcatggataaggagacagtatttcaaagtaggctttttgtttgacttctttttcctcatttataatatggtacctaccatttattgaatgcctatcatgtgccagccttcacaaattccctcaataaaacatgccatgtatttgacctgagcaactgtgattgatgtgaaagatgttatcaaattgtggatacttggtaaggaatcccaacaacagagaattggtgagagattgagtgtaatgtgactcttaacagaaaaggacaggtgagttcctgccagttacatgggctctggtgcagctgacaaggtcaacttgttctgtgccactccagaaagcaaaactagatcctacaagcagaagttacagggaggcaaggttgcgttcatcatttagaaaaaatatattttgagccaggtgtggtggcacatgcctgtagtcccagctacttgggaggctgagacgggaggatcgcttgagtctaggaggtcgaggctacaatgagctttgattgcaccactgcactccagcctggccgacagagtgagaccctgtctcaaaataataaagtgaaaaatagtatataaaaatgttttaagaagacatatatatattattcactggagctttccaccaacagaacaggctgatttattaaagaaacgagatgtcctatcatggaaatactctaggtaccacctgctggtgctgctgtgaaagggactttgaaaagttagcctgagtcacagctaagaggtctgtagatgccttttggaagagaggtaaacacataagcaaattccacttacactacgagagttgcacaggagagatttagggagagaataagtagttctggctattttttaaaatagagcctgcttttgccaggcatggtggctcacgcctgtaatcccagcactttgggaggctgaggtgggcggatcacttgagtccaggagttctagaccagcctgcccaatgtggtgaaactccatctccactaaaaatacaaaaattggcaaggcgcgtggctcacgcctgtaatcccagcactttgagaggccgaggcaggcggatcacgaggtcaggagatcgagaccatactggctaacttggtgaaaccccatctctactaaaaatactaaaaattagccaagtgtggtggcacgtgcctgtagtcccaactactcaggaggctgaggcaggagaattgcttgaacccgggaggcggaggttgcagtgagtcgagatcacaccactgcactccagccagggcgacagagcgagactccgtctcaaaaaaaaaaaaaaaaaaaaaaaattagccatgtgtggtggtgcacacctgtaatcccagctactcaagaagccaaggcatgagaatcacttgaacccaggaggtggaggttgcagtgagccgagatcatgccactgcactccagcctgggtgacagagcgagaatctgtctcaaaataataataataataataataataataataataataataatgcccacttgaataaagaatcatttattcattccataaagatggattaagcccctattgagtgattagaatgctatataactgagaatatataaaagcaatctttggtcctttatatttttttaattaagaaatttgaggctgtcagataagatgtattaacactgtcatttttctccagcaaaactctatcttggtcctctgggagagtaattactgaggaagacagccaaaaagacaggaatgaaaagagttggaaacaccagggctcagtaagcaggtggcaacaggtacttgattcctggtactagcttctgtcaccatttaaagaagagacacaagaaactatagctataacccttccacttcctggcttataaaagaaaacgcaatgattctcatgactgcaggcgttaaatggagtgagactccatgtatgggcagcagatggctcctggcctagccttgtaaatggctagggtatggcatgagctggagcagagagcagaaacgggtcttgctgccaagtgtcagacagatcgtgtctgatgatcacaggtggtagaatttcagataaccacaggttcctgggaatctagaagctgttggaaaaactgggagtgatgttctttctggcccttggagatcttttgggccagctgtgtggttttacagacgagatgctgaagcctggaccctgcgtggctgtgtgaggcgcccggttaatgagtatggctcccagcctgtctgagatgggaccctcctggtgctctggaagccggaagtgctaacggaaggatagccctcaagggctcccaacctgaaggctcctcaaaggtgcctgcagtggaccagccagcccccgtgtcccatgcagcaacagagctggctacgggccctgcctgcttggctgcctgacgcctgatggccatgtggcacccgacacactctttcctccccagcccacatgctcggcctgagctgatcgcaccagtttaggtttgcacagtctgtcaggaacactctgagtgtggaggtgtgtttactacaaagcaatttcttctccccctcagaatacaagaaaatcaaggacctaccctgttgctcttacgtatgaccacagtggcctttagcatcatgacactgggattggggaaaaacccagctgtgtaaaaaactaatgggtgacattttgatcactgtggaagccagctgatgggatatagagtttgtttactatcttctcaatttttatgtgtgtttggaaagttccagaaggagaagagtaaaaaacagaaaggagagagatggatgaactctgttcttttaactcctgtactcctcaggctgggccccaaactccttctcccaggtaagggtccaggaggccaaggtcactgcagacctccctgtggctgagaccacctggcctgtctcccactgttctggaaagctctctacccctttccctcaaccccctttctttgatatctttgggaccagcctctcctgggcttctcctgccctcttccccagcaatttttttcccaccttctcattggacctcctgcctcaaacaaggcctctaaatgtctttcttccccagtcgccaggccttggtttgacatgttttttgtttgtttgtttgtttgtttgtttttgagatggagtcttgctgtgtttgcctaggcaggagtgcagtggtggaatctcagcctactgcaacctccatctcctgagttcaagtgattctcacacctcagcctcccaagtagctgggattacaggtgcacactaccgcacccgcctaatttttgtatttttagtagagatggtgttttgccatgttggctaggctggtcttgaactcctgacctgaagagatccacccgccttggcctcccaaaatgctgggattacaggcatgagccaccgcgcccggccagctttgtcttttcatgctccacactctcacctgctcccccgacttcacccacctcccagatccatgtctcctgcccagaccgcaggcctcagtgcagggtcccagcacccacctgcttggtgggcctcgtcacctggtgctcctcaagcacaagcaccccacacgtcttgtccaccctggagctcatcaacttcttgcaccaaaccagccctccttccctcccccactccagtgatggggtgcttagctgtcctagcagggaccccagagttattcttaatcgcctccctcatccacgtctctcacacatctgccactcctgccagctatccttccaacacctcttccatctgtctcctctgccctgttctcgcagatgctgatttagcctgcactttgctcatccccctgcgctggaccaccgcagtggcccccagcagtccccttcccttggccggctttctcccaccaaacaaatcacatggggtcacctgtaatattgcaagactgggatggctcggagtaagggccagtcctggcaagacacaaggcactgtgcaaactgagtacagactcccgcacagcacccctgcagcggcacctgagcctcaccacagtgcctggggcatatgcatagggcagctgggagttctcgcaaacaactggggggccttctgacctccctgcctttgctcatacctgtttcaatgttctttgagctgtctgctgccttcttactgtgatgaggtccttcttacacttaaagaagcagctcaaacctcattgcccgtctgtaacattagacgggcttgcaaggctggaaccttatctgtttgaatttgcctcactggttcctgatacataatatcagctagaaggtgcttgtagaagtgaattgaatttttttttttttttttttagacggaatcttgctctctcacccaggctggagtgcagtggcgcgatctcggctcactgcaacctccacctcccgggttcaagcgattctcctgcctcagcctcctgagtagctgggactacaggcgcccgccaccacgcccggctaagtttttgtatttttagtagagacggggtttcacgtgttagccaggatggtctcgatctcctgacctcatgatctgccaccttggcctcccaaagtgctgggattacaggcatgagccaccgcgcccggactttaatgaattgaatattttaaaaaatatcagtctttaataccacaccataaaatccaaacggcagttgcattcatttcctattgttgctgtaacaaatggccacaaaccgagtggcctaacgccacgccacttgattcttttctgtttctggtggtcagaaatgtcaaatcccagtgttggctgggctgtgtttcttccaggggctctcggggagaatccgttttcttgccttttccagcttcttgaggctgcctgcattccttggcccctgcctcctgttctttcccttaggaagaaagtgcctcccgccttcccttgtgaatttgcggggcccacctagatagtccagagtaacatccccatctcaggatcctttgttgatcacatccgccaagcccctgttggcatgtaagggaacatagccacaggttcctgggatgtggggagggatcatgactctcccgcagcagcccttttcagaagtcaggtgccaaaaaggcaggcttttcacacaggcaagtgatgcttggatttcgtcttaaatcaatgaaattcgatcgcttgtatgtttcattgtccatagatgaagtcgctccactggtctgtgctctaggcctgaaagaaaggcctcactgcctcttacagatctccatatttagggacttgggatatgttacatgagagtgaaatgggaaatgcacaaatctcttgacctctacagtgaggagaagacacctgttttatcctgggaagtgatgaaacctctggagggttagttaccggactcacccaccgtcatggactgacagattgctgcctccctaatctattagcctctaccttggaggaaacaacaaaagataaggctgtaaaaaaaaaaaagtgagaattcctcccaaaaaagcctgaggctgctgagtttctccctggggaagctgtgggttccagatggttgcccttaaggcatcagtcaccttgctctgcgccagaggaaaatgaagattaataatcataattttttaaagttaagcctaaaaggctgcctatgaaagaactgaggcacagagggcacaaagccgaagttcgataggaataatccattgcttattgaccaggacctgttcatccgccgtgtcggtaaccttgggatgttgcacgctggggcctgccagccaccatggagaggctgatggatcttggaggcttctatcagagaatgtcagagccggggagggacttggaaatcatgtttttcaaccccttcacttaaagatgaggtgaaattccatgcccagggttgtatagctaagtggaagcagggctgagactcgaatgtgggtggccagaatctcaatgcctggcccttctggctgctgctgtctcttagaggacagacacaggtgacacctgtaacagtaactacaaaaaggtatgatataacgacctcttctttgtagcacagaatgtaaataccgtgggcattttgatacaagcagggtcctggggccagaggaccaggcggaccgttgagctgggctaggctgagtagatgggcgtgcgctggacagtgtggggagggccactggccaccacgtgagggaagacaccactacgagcggacaccaagacccacctcttctggagcagcggggagtgccgtgcagtgggaggaacatgctggaaagttggtgggacaaattttggaactcttaaaatccacccagaggtttttggactttgtgtggttgaccacagggagctttggggagatttggcctcaggaagatggtggctgcacatggaagttggaaggattggagttgtgtgccgggagacgtggtgtatttctgaaggaccctctagggaggagaaccagaagcaaggcatcccttgagtgtgatctccaaaagggatgtcttctgtccatttcttatgtgttgccttgatggtggttgaggctggatgggaaggccacagtgtggagaagactgtgctcacccctcaaagtctcggcccagtgacttgccccaacccacccccgagcccagtcgtggaacccattcagtactgagcaaggaccgactttcccaacaggaaggagggatgtgtgccacaggcccacacttgtactcagcccgcaaacatgtattagtaccggtgatacgccaggcctgaactagacgctgggatgagttaggcacagtcgtcttcatggagctgcagagtgttgaggggaagacacactcagacacttgctgtgcccccgtgtatgtactgtgtgtgcgaggaaccttccaggctctcacccatcttcagctgagtcctggcaaggggatggagatggcctgagcacaggcagggaggcgaagagcagcttagaatggctgcgtggtgagggggctggaaatggagggatggatgccagaaatttccaggaggtgaaacaggacgaatgtggggattgggtgtggcacgtgaggcagggggagtccggttctagcatggaggacactgagctagaacgtgaggaagcaggagtaggttgggaggagaaatgttggggtcatgtgtggattgccggtgattaaagcgtcatggggcagccaggtgaggtgctgctgagctggagcctgggcttagggagccccactgcagggctgcctggggcatggcgaggtgaggttgcgaggcagggttttccggccagaccttcacgatggccagttgcctgctatagtaaatccctgtcccttcccaaggccgccaaggctttcttggggaaagtatccatcatagtctatgaaaaggctgccaggtcttaccttaagagaaataatttaaaaattcctctgtagttatatctccagacagtatcctggcttagcatcagatgcaaataaatcactgtgatccattcctagatgggtaaagcttggtgtatatgtgtgtgtgtgtgtgtgtgtgtgtgtgtgtgtgtgtgtatataaataaatatataaatatgtgtgtgtgtaaaaacactttcatctttgaactgctgtcttccaatgttaacattgagaaatacagtcgtatcgcatggttcttttgaagccaagtaatgtcacagtcagtatcctttttatcagtagaaaaaatgcgaacacccaacatcggctgcatgctcaccaaggtgtctcagcaagcaataaatgatgtgccgccgctgccgtcgctctgagatctggagtctgagacgtgtttaaaacagtcaaaggcctttgataggactgcagtccatggtgtctctttgtgttctgacattccctgtgattgcccttcaactttctcagtcagctgtgggctggtccattgtttgtgcacatgtttatacatcagagcctattgtttgcttccgctgcgccactgtctgtgtcattatatcatcttgcgattcatgcgctcctcaagcctttctgttttctaatcataacactggttattacactagatagaagggttctgtgaaattcagttttcactaagggttgttagagattccaagagttcaacagactggcttttgaagttatgttttttttttgttttttttcagagggagtttcacccttgtcccccaggctggagtgcagtggcacagtctcggctcactgtaacctctgcctcctgggctgttcaggcgattctcctgcctcagcctccagagttgctgggattacagacgccggccaccacgcccagctaattttttgtatttttagtagagacagagtttcactgtgttggccaggctggtctccaactcctgacctcaggtgatccgcccacctcggcctcccagtgctgggattacaggcatgagccaccacgcccatccttttttaaaaaaatttttagaggctaagtcttgttctgttgaccagtctggagtgcagtggtacgattatagctcactgcaacctcaaactcctgggctcaagcagttctcccacctcaccctccagaatagctggaactgcagatacatgccactgcacctggcattttttgtttgttttttgtttttttttggttttggttttttttgatagtggtttcactgtgttgcctggttcgagagctggtctcaaacttctggcctcaaacaatcatcttaccttggtctctcaaaacgttgggattacagacatgagccactgcgcctagcccacatcgtaggtattttactcagaaatgaatttctaattgtcataaaactatatgttaggaagctattgtaatttaatttttcttttaatcattgcatacattgtttaccattgacacgctggctgctagctcagttaacttcataactaaagtatgtgttggtaatcagcttctcttactaatggactgatacattttgcttgcacagggattttgcttatgtagcaagagataaagatacaagaattttgaaatgtcatgtatttcgatgtgacacaccagcaaaagccattgccacaagtctccacgagatctgctccaaggtaaggtgggtcagggcagtatgggccgcctctctctttttttcttgctgcataaaaggatgtggaagggcgggggagtgggcacatcaacctgcagttgagctcagggagaagtaggcagattgttcagccagagtcattaaagtattcttgctgcgggccaggcatcgctcttgagtagcactccatctacacaaaatgaatagaaccatagtccctcccgccgcctggaaacatatatatatatatatgtgtgtgtgtgttcagccaagtcattaaagtatttttgctgcagggcaggcatcgctctaagtagcactccatctacacaaaatgaatagaaccatagtccctcccgcagcctagaaatgtatatatctcaggtaggcaaaacaatggcagagatacgtacaccccagaaaactgggaaaaggagtcaaagcggattttccaggggcagggccatctgacctgagagtgaatgtgggtagagaaaaaggctacaggaaaggaggtggcaagaaaccatccagggtttctgcaaatgcagggagctggggattgccgttaacacacaccaacttcctgaggacacacagtggctcgtagaagcaccctgtccagctgggaggcaagactgtggtctcatgctagtgagacttccttaaccagagtcacagcctcaaaatgagaacaaacagtctggcgtcaccagcctagcctccgcctcccaccagcataacagcccccttgcagacatccccccaccctctgccctacacacccatggactcccacagatggagtctcttgcttttcaggaggaggttctattaccaagcagctctggctgttacagatttcttctttatgttgacccgaaatcttcctcttggaacttccaggtactgactggagatctgccatctgtagcagcagagaaaggtcccccaattctctttggtggccagctcctcagacacttgaagccttgctgtgtttcaccatgtgttatgtgttttagaggcgctggacaagcatctatcattgagtcttcttgcccctgacttcctccctctccagatccaccacccccgtctctgcagccacttttgggtcacatggctattccagtccctaaccattgtcttctgggcactctctggttggatcccccagatgaacacagtattccaaaagtgagcagagagcagaccagggccaggggctgctctgtcctttgaccgccaaggacacactattgtggtgctcgatgttcttggcaaccacatcaccccctgatttctcttcacatggtggcagctgaacccccaacacactggcacaagcttcttttagccagccctttccatgccccagacttggttaatttcttgaatttagatgcagaattttgccatcccctctgttgaatgtcacctttctgattcaggctgacatcataacccagcctcactcccacaattcttcctgagccgtcaagacccaacccaggccaggagttggcccagcctgttaaccgagcaggaggtccaagccatggtgcctgagggagggacaggggcagggagctgtccccagcctcagaatgaaagagtgcccccgtctgctgctctgaatcccacgatggggacgtgcaggatgggcactggtcttgagatcaccacgtttattcccgcccatgttcacattcttgcattgatgagacgggggtgttgctgccatttgcagcattgcggcctgctccctggatttcatttctcattcattcatgcaacacatagaatggaatgccatttatgtgccaggcactatcaaaggcactggggagagggcaatgaccaaaacagaaaaaaaaaagtccttgcccttatggagcttatattctggcataaagccctcagaacatggcctggcacagaataagtatgcaggaaacgcttgattttattcttgtcggcagccctcttgctcgctgccctgggcacagatctggagataggcagagtagaggtctgcgatggaaatgactttcactccacttggaatggaaaacttagtctgggaatgaagatccgagttacttttggggtcactaaagggtgggcttctttcagtccctaaacccacagcactgtatgtaactggtggagaacaggagtataaagtgctttactcttaagtaaagcagacatcagtgtcccttacagaagagaagcaatttagagcagtttgaggataacagcaaaaatggcaggtgtattagtcggctttcacgctgctaataaagacatacccaagactgggtaatttataaagaaaaagaagtttaatgaactcacagttccatgtggctggtgaggcctcacaatcatggtggaaggtgaaaggcacgtcttacatggcagcaggcaagagagaatcagagccaagcaaaaggggaaaccccttgtcaaaccatcagctcttgtgggacttactcaccaccacgagaacagtatgggggaaaactgcccctatgattcagttatctccaccaggtccctcccataacacatcggaattaagggagctacaattcacgacgagatttgggtgaggacacagccaaagcatgtcagcaggggacatttctgagcacttaatgctgtctaggccttccctatgcgtgacacactcactcatgtgatcctcagaactaccatctgagacaaatactgttaaccacctccgtgtgcagtggagacacaggagatcaggtcacttgcccaaggtcaaggtcacacagctagtaagtggcagaggtgcagtttgaacccatgttgtctgtcttcaaagggtggcatttggaagcactggaagaagccactgctgtggctgccgctggccactgtgggccggcagggtccatgcaagaccagggagacttgtttgagttgtttctagtagaggtgggagcctggtgaatggaagaagtccattccaagcaatcaggagactgctactctgaggaatagtttttcacctatcatccccagagaaaatgagtggaattcctcaacaaaatatgtagccccagagatgcaggggtgggacttcaggcaatagactaaagctgatctaacttggaagtgaagtcaacctagacactttacaggctggaatagctgaagacatgggggcttgaacccacgctccaaagctgcactttttcccccttagattatggctgaacggaagaatgccaaagcgctggcctgcagctccttacaggaaagggccaatgtgaacctcgatgtccctttgcaaggtaagtcagtggcacctcatgtcttcattatggccctgtccctcctggtccaggactgaaggctctcagatggttctctggtatttcaagtctccttaaagagcacactcaactcagtaagcacaagttgagcctgcacgctgggtctcacagaggcacagagttgattttgcatcactagggttaggcataaagccaggatgagttttgttgttattggacaagattaaagaatattgtctttagtttttgccttcgttttcattttgttttgtattttatgttctttaagaatactgtcttcatattataattcatgtacaacctgggataaggaccctggctggtttaaaaacacgtgggttgggctggtctgaaggtagtgagttacctcagttgatggttcagccagttacagatcgacctccttgtgctcctcattctccccttcccactactatacttgactaatcttaaaaaaagaaaacatgggccaggcgcggtggttcacatctataatcccagcactttgggaggctgaggcgggtggattgcctgagcttaggagttcaagaccagcctgtgcaacatggtgaaaccctgtctctactaaaatacaaaaaattagccaggtatggcagcatgcacctgtagaattgctagaacccaggagatggaggttgcagcgagccaagatcgcaccactgcactccagcctgggcaacagagcgagactcttgtctctaaaaaaaaaaaaacgtgggttgattactgggggaactcagttatcttcctatgtctctgattgtgccctttgaggttacattttctctgggcatcaaccacacctaattaaataggacaccaaaagctgctactttacttaatatacatcaaagagacagtagcagctttaacacatagatgccacttcctgctttcacatgcattcctatcttgaaagttgaacaggattttaacagagccccaatatctggagtaatgctgctcttgtagaatagttgttacatttacatccagaaacatagggcgttatggcacagggcgtgtcctgagcattcagatgatgcagagccacggctgttgtgtacatgtgtgttggaaccactgagaaagatgtgttgcttttgttccctgtagtagattttccaacaccaaagactgagctggtccagaagttccacgtgcagtacttgggcatgttacctgtagacaaaccagtcggtatgtgaaatgtttattgtctttccactttgcaagtgtgcgggagctcacaggaggcgttcgccctccgaggagggtgaggtctgctgtttactctcacgccttgtcttgaatcaaactgtcacactgtcacctgccagagaacataaacggtcctgatcaaaagatgagtagagggacaggccccgctgctttgacctgtcatccccagcatgcaggactttagcaatacagacgtggatttcttgtttacccagtagtccagagctgtgtgactcagggccgtggaagagctccgctgctctgaaacgaggcctccatctctgaggccagggcacctgcttcgtgtcttgtcagctggcgggccaggagaaaggactgtggaggcttcatgctgtcaaggagtgacacagtagtggcacacacagcattcagctcacatgccaggggcagagtgtagttgctgggctataccaagccaaaaagagactgggagatgaagccttcaccagggctaaaaaaggctgtggagaaatcgcaagctacatatactgccaagggggctgtaagatggtgcagctgctttggaaaacagtctggcattcttcagaaggtgaaacatagttactttagacccagcaactcagttcctaggcgtagacccaagagaagtgaaaacgtttgtgcatgcaaaaacgtgtatgcaaatgttcacagcagaattattgatgagagtcaaaaagcgaaacaacctgaatgtcctgacaaatcaactgacaattagataaataagatgtgatacttccatacagtggaattttatttggcaataaaaaggaatgaaggactgaagtgcgctgtagcgtggatgaagcctgaaaacatgctatgagggaagtcagtcccaaaagactgcatactgtgtgattacgttcatatgaaacgcccaaaataggcagagctctagcgtcagaaagtaggtaagggttgccttggtctaggggtctggggagtgggggaaaaatgcagaatgacccctaccaggcacggggtttctctttggggtgatgaaactgttctaaaattgattatggtaggtctagcatggtggctcacacctgtaatctcagcactttgggaagccaaggcaggtggattgcttgagcccagaagttcaagaccagcccaggcaacatggcaaaacctcatctctacaaaaaaaattcaaaaaattagctgggcatggtggcatgtacctgtagtcccagctactccagaggccgaggtgggaggatcatctgagcctgggaggctgaggctacagtgagccgtgattgtaccactgcactccagcctgggtgacagagcaacaccctgtctcaaaaaaaaattgatgatggtgatgggtgcgctctgtgaatgtactaaaatccactggattgcacactttacgtgagtgaattgcatgtgaatgatacctcaataaagctgtcactcccacccctatcccccagaaaaactgtggaaacagctggcaaaagggccctactcaatggggggatccactgtaaaggtgccatcaagagacagtgagggtggagagaggctgaagggccatggtctgcataggtagacagcgtctaaggcaccaggtccccggagcttctcctgactctcctctcctactgaaaaggctgttatttcttttttttctttttctttttttgttttttgagacagagtctcactgatacttgcccaggctggagtgcagtggtgcgatctcagctcactgcagcctccgcctcctgggttcaagcaagcatgtccagctaatttttgtatttttagtagagacagggtttcaccgtgttggccaggctggtctcgaactcctgacctcaaatgatcctggctcagcctcccaaagtgctgagattacaggcgtgagccactacgcccggccagaagctggtatttcattcctgttgagcaaacatgagaatgaagtgtcctgtctattaaaaaaagatcagtctgggcgtagctgttattggtgatttgggcccacatttgagtgtggtaagtggctttaggacactttaaattatccttttctgtccccaggaatggatattttgaacagtgccatagaaaatcttatgacctcatccaacaaggaggactggctgtcagtgaacatgaacgtggctgatgccactgtgactgtcatcagtgaaaaggtgagaaggaatcttcgatgacattggtgtgtcttatacagtgagtataagatacagtggttttctgtggaacttaggaacatagtcaaggccggagttgtgcatccttgtgattaagatggcctacatttgaaagatttggccctttgtctgggtctaaatctgtgcatacctctgttttcctgtggcctgagaaacttctcttctggtgcttctgattctgtcttcctcatgtgccccagagagaaattgtttgctagaggtgagtgtgtgacgctagtagtcgctcactctcagggcgccagtattgcctgggctgtgtgatctggggatgaaaagcagaagatgcttccatttgggagagtcctgtgactatcagtagcagaaggagctattggttgtcttgagaagaggccacattagcctcagcccaaattatctcagtttcgtggttgaagaaattgaagcacagagaggctaagtcatttgcccagcatcacacagttggaagcaatggaatcaggacttaaatccaggcaacctggcccagacttgtgcccacttttctattctgcctctgtgaagcacctgccagggaaagaccaccagtcatcagcctgccccacagctgcccggttcaccctggagagaggagcagggtgctcactgcctgcctccagctggccacactgagctctcctcacctcttcaagtaggtcccgcccttccccacaccagcatcatcgcaagcactgcaccctccatgctccaccctctgcctacccgacccttacccagatcaccaccacagcctccttcctcctgagaaaacttcccgacctctcacactagtgtactttgctcattaaacactcccaaggcactagagtgaatatttaattagtcaagatgttaatgatccaaaagtcaacattttggatgtgtttattaattcaaaacttgcatatggttcttgcaaaggatgtggtgttcatccctatgagaaagaattctgaacatttctttacgctgcctcatgtggatcccagatggacaccagtttgcaagagagaaaagaaaaaaacaatttgacaactttttgttgatttggcagctttttgttttatatggttttagatggaaatgtgattcagtgtgctgtttagtttgggtaagaatcactggacgaagaaagataccgtgaatcccttttttctggtgctctgggggtttacttggccaaatgggttttgggccaccaggtgtcctgtatttgggctagatgtaagaagtatggacggcactgtccctccccacagtgaactcacagccacgtagcataatggagaatgggacccacatcacaccccatgacagcagtgtagttcagagcaagaatgacctccagaacagggtagccatgcagtgatggcctcttcagacatttgggcaaggttccgcctttcgagaaaaacacaggtcctttctgaattcggcctggctatactttctgaatgccagttcctatgtgctgccactcttaagcttgatcctgggatctcctgattggatgccgcataatgtctcttgcagaatgaagaggaagtcttagtggaatgtcgtgtgcgattcctgtccttcatgggtgttgggaaggacgtccacacatttgccttcatcatggacacggggaaccagcgctttgagtgccacgttttctggtgcgagcctaatgctggtaacgtgtctgaggcggtgcaggccgcctgcatggtgagttatcccggtacaggctgttgagccctcccgcctctgctcatctctaatatgccatacattatagcagaatcactcacggaaatgaaaaaagtcgaatccctaaagtaatgctttactttataacgccgtcattcctagggccagaatcagttatgataaacagattacatctccaaaggccagaactcctgaaagaagtggggccagatagaggctccgatgagtttcataaccaccaccttgacgacggtcaatccttgatcccaaatcaatttcatgtgtgaaatgttggtcgtgtatgagttggtactgtttgggttcaattcagtactttaaaaatcaatacattgaatgacttttgtttccagtgattggtttctgtacaccgttcttatatattttatttatatctgttaactcagtccttccgacaactctgttaggtagttgttagttctgttttatttatgagaaaatagagactttagggaagttagagaatgggcctcagggcttgtcggtaagtgacagagccgagcctggattcagccccaagctgccaggtgacaaagtcagagctctttataccacatggatacttggaaacaaacaagaatccctcattattccttcagcatgtgtctttgtgcccctcttatgccagacactgcaaaagttctaataaaaatgagggaactgggccgggggtggtggcttacgcctgtaatcccaacactctgggaggctgaggcaggcggatcacttgaggtcagaagttcaagaccagcctgaccaaatggagaagccctgtctctactaaaaatacaaaattagccagcgtggtggcgcatccctgtaatcccagctactcgggaggctgaggcaggagaatcacttgaacctgagaggcagaggttgcagtgaaccgagatcgcgtcattgcactccagcctgggcaacaagagggaaacccatctcaaaaaaaaatgagggagctatatgagtgtgggcaccaaagcctgtgggcaggtgtgttccagcagcagcaggttgggtgctgggcccgagtggaaggaggtgcggtccagatcatggcgggcttatgatgatggcgtgtgggggcctgattttcttcagcaaggattgctaaactggggattgaattgattgtatttagattatttatttatttatttattgagatgaagttttgcttttgttgcccaggctggagtgcaatggcgcgatctcagctcactgcaaccttcgcctcctgggtttaagtgattctcttgcctcagcctcccaaatagctgggattacaggcacctgccaccacgcctggctaattttttatatttttagtagagatggggcttcatcatgttggccaggctggtctcaaactcctgacctcaggtaatccacccgcctcagcctcccaagtgctgggattaccggcatgagccaccgcacccagcctgtatttagattttagacgagtatccagcaaaaaaagaagacaaccaagtagaggataggttggaggaacaaggctgaggtggcgatcagccaggagcccagttaccttctgcagatgggagagaggaggagcgtccacgctaggagagcagcgttgggaacaaacaggagcagaggctttgagaagcaccgagctgcctggctgggggagaactgctgcatgtgaagcccctgggcttcatttaattcagcctcgcacttacgggctggaatctggggcattcagcatgactgagatacagtccttgcattgtagagctcaggtatagtgggggagacacagaaacctaaactctgttacagtgtagaaagtgctgtaaataaaagtatgaggatcttcactttcagccgggcgtggtggcacatgcctgtagtcccagcttctgaggaggctaaggtgggaggatggctcaaacccaggaggtcgaggtgcagtgagctacgatggcaccactgtagtccagcctgggtgacagagcgagaccctgtctcaaaaaaataaataagaaaaataagtatgagactgtgctggattgagaagtaactgggaagaaaaagaagtggaggccctaaaagcagataacttacaaagtttgccagtgagggggagcttgaagggcagcattggagggtttgttcatgtgtttatttcaggacaggagaggcctgccccttttttattctttatttttattttattttattttttttaagagatgggatcttgctatattccccaggttggtcttgaactcctccctggaacggcaggggagcaccaccatgcccagctaggttttcttttgtggaaaatggaggtagataaagagtggaggaggctgggcacagtagctcacgcctgtaatcccaatactttgggaggctgaggcgggcggatcacttgaggtcaggaggttgagaccagcctggccaacatggtgaaacccatctctaccaaaaaatacaaaaattagccgagcgtggtggcatgtacctgtagtcccagctactcagggaggctgaggtgggaggatggcttgaacttgggggtggaggttgcagtgagctgagattgcaccactgcacttcagcctgtgtgaaagagtgagaccctgtctcaaaaaaaaaaaaaagaaaaaaaaaaaagagagccaaggggagggacttagcctacgaattagttagagagaccttttactttgacatagtccagaagatgctaagaaccaagaatgggtggagcttggggaaggaaagggagttctctgaccgccgcccccccaccccatacagcacattgtgaggttatgaatgaagggaaagtttgcacctgtagtcccagctactcaggaggctgagatgagaggaccccttgagcccaggagttcaagtccagcctgggcaacatagaaaggccctatgtctaataaaaatgttaaaaggatgaggtgggagagcagattgcaaaggtggggcgtagaaaagaggcatttgacctttatcatttgaaatagagcaggaaggagggagaaggggaggcctggcgttgaacacttgttatctggtgtcacacttacaccatcctctgtgagagtggctaactccctgcaagaactgtagggccaggattctaactcagacaccctgaatatgcaggagcagggctggggttcaggggagcagggacagtagaggagtcaggtgaacccactgaccaggtacagggagttgatgagataaaggagatctgtgaagaaaatagaaaatgggagatttcagccaagcgaaaatggatgacaactattttggtattttatgaaattgaaacagatcatagcagatggttttagtcataaaatgaatggctttccgacttaattatacgtttaagtgataacgacaatgagttttatctctttggctacagttggttttctgattctcaattcattttccctcttggaaacaacttttactcatttgcttcctattttaattgtatcactgcaacgagtggacacagctcagccaatctagtataaggcatactagtaaaatcaaaccattcttctctcctgcccgctctgaatccagtgtttctagctcaggggctttcttcttagttcaaatccgcatgattctcctctgaatggtccgtatgtgaatttataccatgtgaatatctattgacactaacgttcttttgaatctgcttaatttttaggcatattttacagctgtgtggtataggcccaacagaagacattttggcaaaatttagaatagaacagagagggaccctttatgaattccaacacttaggtgtggttttgattcacactggatgtacgtgactactatttgaaattccaagtccagagtcccatgttgccatgtataaatccgtgctttcgatgtgtgtggtttgggttgtgatgtgggcctagtaaaataccttacacagaggagacgtgtaatcaatcatcatatttcatatgattgatttgaaaggggttgttttgtggcctaaggggtatgatagaacactgtaccatatccttcccccagggtcttgctttttacagggacatcagcctattccattactaaagagcctgttaatatttaagttgattttttttaaaaaagccatggagtgacagtccttccttggtatacgtggggcggggtggaggtgttctaggacctctgagtataccaaaatcctacatattcaggtcctgcagaacccacgcataggagaagtctgccctctgagtaattgggttttgcataccaggaatactattttcaatctgtgtttggttgaaaaaaaatcctcatataagtggacctgcacagttcaaactctgttgttcaaagatcagctgtatttttttttcattatttattttgagacagggttcactccgtcgcccaggctggagtgcagtggccatgctcacagctcactgcagccttgacctcccagtctgaagcaatcctcccgcctcagcctcccaagtagctggaaccacaggcatgtgccaccacacctggctaatttttgtattttttgtagagacacggtttcaccatgttgcccaggccggtttcaaactcctgggctcaagtgatccgcctccctcagcctcccaaagtgctaggattacaggagtgaaacaccatgactggccaggtcaactgtattttaaaacgtttggattagaaaaaaaaaaatttgataaattttaactttttatctaatcttaaagaattagttatcttcccattatgcaaaaccaggtggactacattgttatatttctgaagaacaggaattatccctggtgccagtgctaatggatttttaaaaattaatccataaagatttagacttgtatgtaccatgtatcttgaaatcttaatacctcatctttttaattaaaacaggaaatagggaaggaaacaaacatttctgaatgccttctgtgttgctaggcctatttcaggcattccacaagcattacaagtattacttacttaatcataacaccctctgtaaatagtcctttcttcagccattttacagttgaagaaactgaggctcagagagatttaataattcgtctggggttcacaagtgatagaccttaaactatgccctttctactgtgctgtcagtgtaccatgagcacctgcctagatttgcatgtctctgatgaaaaatgtaattaacacactctctcccaatcctttctggtttcattagctcattgactgtgaggtgtattcgttgcggactatcaatatagaggacacgtggagggtggaaatggatggaaggaaagggtggcaaaagccaaaacccctttgttgagcctaatcttttaggagaatttaaagcactcacattcagagaaaaataactcttggatttatgtttaggaactaggtcgttaacctttgggagtcaatgtattatgggtcatgacttaaagtcatattaaagatgaaataatatgttgttaattaccttaaaacacgttttgttttatttcagttacgatatcagaagtgcttggtagccaggccgccttctcagaaagttcgaccacctccaccgccagcagattcagtaaccagaagagtcacaaccaatgtaaaacgaggggtcttatccctcattgacactttgaaacagaaacgccctgtcaccgaaatgccatagctgcacatgcaaaaggactcggctatttacctgaagattgactagctacactaaagaaaatgaactccgccatccgaccttccatccagttgctgatgctttgtcttcagagaatttacccttaaccaagcagtgttagacaagcatgttctctcgtcttgccaccatcatgtgatatgaaaagaagcatgaataattttttttgctgtaagttacatcatgcgcagtggaaggtctttttcttattgtaaatattgtgaacattacttaacttcacacacacacagagaagagtgtggccccacccctcctagtgaactaacgctgcgtccttggaatgaatgatgcgtgagttagtttcactgtcttcttggctggacctgtcacaagcaacctttaagtcctacagcactttgccctgttttcaacattggagtaggcactgcatagcagataccattgaattgctgtaaaaataggatggcgagtttgtgttttaatttttcataaaattgaacctgttggttgacaaaattggctgttggcatcagtatagaaaccaactggcagctttccctgacaagctctttgacacatggacaccatttcatgtctacagctgtttgtgggatgttggaaaaaaatgaaacttcaaaattgatgaaaaactaaattcgaggaattaaaatcgaacaaaacatagcctttcttttccgatggttttcaaactgattatttttaaaagagattaataaaatcataatgcattttgggtgggacatatttcaaacttctgccttatattgtacggtgcagctagagaattatagttcactatggccattctctacataaacattaagatgaaatactcctcatcagcctttcatccttagtttgagaattagctgatatgcaatttgaagttgaggaaatatcattgatatttctatcatgcacgattattttagatttctaccaccgtgtgatttttgctagtccatgtgctagaggtaaacgttctgctggaattctgcatccagctctatccccctctgatgctttttgcccagaaagctgtctgtccatcatgtattgtccatggcaacaaattacattaggttgaacctttccttgattttatgtatttaatattagaatttgttggactcaactagatatattttttaatttatattttttccattttactttgaagatttgaaatgttcatacctgagcaaagtctacacaggagtaatggactgtttaacaagtttcccaaaacagcattttcctgctccttcgtatgtaggtgagaaacttagctggaaagacatacaaatttagactctcgttgacattgtcgttttaaaaggaagttgctaaggcgatcaatctcaatattagtcttgtttacttcttcttaatgtcaaaattaacatttacaacatccaattataaaagtaatgctttatgtttatacactgctatgtacttgtcaaaatggtttccacattcttatcacatctgagccttaccaggtagagaaggtactaaatacactttagaagtaaaaatatgaagtaccgagaggctaaacccactggcctaagatctcaccaaagttcatgaaaaccaggactaggacccacggctcccaaagcccgttcttgctgtgttgtgctgcctccatatccgtcaggaagagcctttccagaatgattctgggcatatactaagaagagcaggtatggaaagatctattgtcagggaatcttagaattccctacacgagtgggagaaagatgtccaaattccttacgcagtggtattcatgatggtgccctatctaagtccaggactgttt

SEQ ID NO: 37825 - DNA, 59253 bp, Homo sapiens
ccggagcgaggcgtcgggatgcagcgccccgggcccttcagcaccctctacgggcgggtcttggccccgctgcccgggagggccgggggcgcggcctccggcggaggagggaacagctgggacctcccgggttcccacgtgcggctgccggggcgtgcacagtctgggacccgtggcggtgctggcaacacaagcaccagctgcggggactccaacagcatctgcccggccccctccacgatgtccaaggccgaggaggccaagaagctggcgggccgcgcggctgtggagaaccacgtgagggtgagcacttcgaaacgtggggcgcggggcgcatgtccttggcgtgatgggctactgttgcgcgttgtgggtgctgccggggcgcgcctagctcctggcagggcgggagctgagtgagagggtagagggtgtgcactttacccgagtttagacccctcttccctgctccttaaagaccttttagatgtggaatcggttgggggcgaatcttctaatacttgagctttctaaagactccttgtccagctggaacagtttgcaaagtggagcctggtgctgtctgatgtttggaatgggggctagaggcacttgccttgtggcctccttatcaataaatggaaaatggtgggctttggggctgcggagaggttttcatttctctttactgacccggaagccggcggagagttggtttgctagtgctttgaaatttcagtcgaaggaggttctgggcttggtgcgcgccggcccctgagtgtactcttggagggaagggaagacccggggcttcaaacttccttctttccatagggctgggtggactaagtctggaggatgctggtttattttttaaggcgggtctgcagagatgtttagctgttattcagtcaggtcgtggtccctacttgtttgttaagtggcaggtgtggtgctgttagtggagtttttttaatccaagtggttttgctgtcaccaatcaagtatcttaattataataaggaagccaagtggagtatgtctgccctgtggtgtagtttccttggtcttattggctttttatctctcgtttctacttattagaaagtggtattagagtctcttttcttctccgataatagttctttacatttgttaatgctttacaaaattattttgcttagatgatgttggatgagcttcaccacagcctgtttgagtgggagtggacaatgtggtaacctgtggctcagccagttctgtagaagggatgttccagtgtgaccttctactctttccactgctaccctgttctggtgtagcttgttgtaagtctgattggcaataggattttctatggggattaacagagataatgtaaaatgtgttaatttgaccctacctttgggattcagtgcctccgttgtaaaattgagacaataagctgaaatttcaaaatatctgcatacagtgaatagctaatagataaatgtaatccacatgagaatacaattagaaaagccccatatctaagttgtcctgttaatgaatttacattaatatttggtggcgcatctccctgacctttgtgttatagtcatgtatttgattaaataaaaatctgcaagccctgaccttaggctagagccccaaaacactggattctgaccacatcatttcatgaagttaggtaattttggggagatctacagtgaccttttgggggcacctgttaaaatcatatatgcccttcagggtttggcttaaaggccatttcctcctttcagtttttccttagcatcctaaggagaggaagatttctcttccgtgattctgtagcacttcatgcctcttatgtgctttatgttgtatctcatgttttggtcatctgtgtgttcgtttcttccagccccttaaagggtaagctcctggagggtagttaaccttcatttagcattggtcacagtgggtcctgcccagtacatgtttgttcaattgtgtgcagtgtggacacaaatacgaaagtgttggggttattggaggttctttgtgtagaatctctggggagtagggcttcctgttctctagtccattggagttccaatatggtgaccacttccgtgtctgagtggatggaaaacatggagagttctcaggtgaatcctttgtatagccaccttgggcccagctctgtctgtttctgtgggtgtagccacccaggatgggtcgacatgcagaactaggctcttctgaatgtctgtagcctcatccctttgttctctttggagcctgggctttgtttttttactagcttggttgaggaagctgatgggcagtggttctagttggttagcagaagtagtatttccaaagttactccattcgacaagctgagtgaagttctgatgttgcacatacatgtggtttaatattgcccattagaatggggccactcctctagcagggcctgcttggcagtcttctgctgttgggccacctcataggcagcctttggtcacctctggttggctttggcaagggcactgatttcctgggccagtcatttgattccaaggcagcagggatcacatgggtgaagagctttaggtctggcagggccttgcaattcctggtctctttcaaaaggcaaagaacgagccttatacagagcttgtctgattcatccgaattcacctctgtgccacctgcctgctggggactgtgagtgacatgaatgtatggctaagcttggtaaccaggaatttggtgattgaattactgtaaagctagagttcctagcttcaggtcatatgtgaaggtcaggttaagtctatctagtgtgatattttaaacacacacacacaatgtttttatccatggctcttggttcataacactcatagcccttgctacagtcttttgttatatttggggtgctttagggcccaaagcaggcctcagaaaacagaatctccctctcttaccttctccttccctccttccacttgctcctttctctccccaatgcttttctgtcttggagctggctgtaaagaaattctgtgacctatgttgtctgtttgtacgtcataagatccccatttcagaagggttcctgttccataccctggaggaaggaatgctgcaggtgaagaagaatctgaacagacagccgttgcagggtttccccagtcagtctgctagtattggatcatgccctttttgttcagtcacatttctaggcccttgcaattcctggtcttttccaagagccaatcatacctattcaataaagtctcaaaaaaaaaaaaaaaagaaaaagaaaaagaaaagctcgagaggacagggtttggaagcttctggagagcagaacatgtgaaggtccctggaggatggtgtgcctagagagagcatggaagctctgtgctccttcttacatgcctttacctatgcatctcttcatccatatccttcatcatagcctttataagctggtaaacatgttttccctgagttctgtgagccactctagcaagttaatcaaacccaaagagagtgttgtggaaactccaacttgaagctgtcaagtcagaagttctggaggcctggacttgcatttggtaggaaggaggaggcaatcttgggagctgagccctcaaccagtggaaccttatggtatctccaggtagagagtgttgaaattgaattggaggatacccagctggtgtctgctgcagagtagattgcttgcttgggatacggggagaaatccccatacatttgatcacagaagtcttctgtgttgatgattgttgtggtgtgagagcagaggaaaaagtttgagtttttccacactcagacataggccttgataagacattttctcattccttgaagatttttatatgtgagatatttagccattttgaatgtttctgtactgtgatgtatcatttacttgtcttgaagtccttgcctttggggattgtccaggtagctaaacaactttactacacacattgccttcttgagagcattggtataggtggaatcctgacctagtgcgagccctgttctgacagcccaagcccctgatgtattcagtgcctttggaactgtgagctagtaaaagcagtttccaccaggtcaataacacaaaagttgttggataaagtcttctgtaggtaggagaggctatagtagcatttttagtatatatgtatatggttgtggggacattagtatttgatttttttttttttggtaactctacttgttggtcattctttctaatcttttctagttatagatgtagtcaggctttgagaaggaccatatctaatgtgaggcctaggggctgactttaagtattcctatggcctttgtcctgtggggaatgaaggattttagttgtggccctgcttgtcctgagggcccttcaggacttgtcttcttcctaaaaagaaggttttactatgggctttcctttgtcaaataaattaattgttaatcagttgttggaaatcttaagaaatttgaaatagattgatgtttcagcgaattgaacttcctgaagttgcttattcgattgaaatggctcatcctgtaatcccagcactttgggaggcagaggtgagatgatcacttgaggccaggagttcgagactagcctggttggcagagtgagactgtgtcttttaaaagaattaaaaaaattagctgggcatggtggcatgttcccatagtactagctatgtgggaagctgaggcagtaggattgtatgagcccaggagtttgaagatgagtttgtgtgtgtgtgggggggcattgatagtttatatatattataaacatatatacaagatatattgtatatcttgtatatatatttaaaacaggtaaaatcacacatatataaaacaaatatatgtcaaagattttatttaactcactaaattaatgagggaactggaaaggttattagaacctgttcataggtgtcttagtccattttgtgctgctataatagaatacctgagaatgagtaatttataatgaacagaaatgttttggcttatacttctggaggctacgaagtccaatatcaaggcgttggcatctggtgagagagacagatgttgaagtgctatgggtgggcaccaatcctacccatgagggtggagccctctgacctaatcacctcttaaaggtcccacttcttaatattgttataatggcaattaaatttcaacgtgagttttggtggagatgttcaaagcataacaggagaagtcaactgtaagctcatatgtagtaaaaaaatcttaaaatgaatttagaagatctgttaataattgtgtctcacagaacactattaatttgcatttcaatgaacaaaacttacttgctttgttaacagttttctgcaagttaaagtgtatctctatacagtcgtcatatatcttaaagacaaaggcacataccttcttagagtcagacaatacaagcaggttccagcatcccattggaaggatatccagtagtctcttttgctcatttcaaagtcttaagtttttccttacaatattgaactcatctataaagtggaaatagtggctctgtaggtcataagtgattgttgtgagatttggctttatattaacatttataagtcttcttggtaggtgcttaataaatggtagctgccgctttggtgttcacttggctttgccttgcaaaggcaggagatagatgtcaggaagttgcttaggcactgagctgcatattagttcctgactgttagtaccctggcctcgttttgctctttgtggtctagtagactcagctgagcttttactctttggtctgcttgcaggtaccttctttgtttcttcttgtttggtctgcttgtaggtaccttctttgtttcttcttgtttggtctgcttgtaggtaggctccgtattgtgatgtctgcctgtactttgtactcaggaagtgctctgcatttattatgatcctttctattgcagatgaagactatttttcatgttcttaactaagcctttgccctctttccattttctctgaggcaggctcatgcaaaatgagcaccccttggtgtcacctaggcagatgctgacatactttattattttgaggttacttcaggccctccctttatctgctgactttgggagagctctagatggtgggcctgatgtgtcttgtggtgctaccaacttgaaggtgcctatggaagacactgaagccagaagccttagctttcctcccttacccaggctccaggctctattgttttttcttaggtgtttttctaattgcctccctgggattggccaggaatctttttcttttctttcttcttcttctttctttctttcttttttttttttttttaaacacactgttgctggcttgaaatgtcaggaatctttaagtgtttatatgcaggccatttctgtgagggtgacgcaagttgctattcagttgcaagtaattgcaccaattatttggtagaatgtagggaggaagcggtggtgttgacagtgtcagaaatgaagagaggagggccttgttgaacatttgtccaccatggattggctaaagtacagcattgaggttcattgtttatgttcctataaaataggcacagtacctgtcttgtacctgtgttggtggattgctgttcataataattttatagctttaggaagtaggctgacaaaggagtaaaatatgatattaataagttttgttttttcttccccgttttttggcagaataaccaagtgctgggaattggaagtggttctacaattgtccatgctgtgcagcgaataggtatgctctctcactgtctactggatgttttgtgtgtgatgatggggtagggaggtagaggagagggaggaagtggcacacaggtttggcattgcccttttggcttcagcagtacagagctggagagagggactacctgaggtcagttgagtgtttctgctcttttgtggagagagggaatcttgggcctcttcatccaactttgaaggacgcccttgcctttgtttactctgctcagctggaggggaggagctgacttagcttgaggtcccaatataattttaatcatgttgatggcattctaccattgagttctttgcgtgagctcagacttcctcaggcagataattgaggccatagtgggtttgccctgtccatgaccctggagtggatgtgggactcctgccattgatggctggttcctgcaggtgctcatttcacactgattagggtgtctctatgcttaggaaagactcaggaattatcagcccctatggctgctcaacaggttttacttccctgctctttgtttgtaagaacaaagcccagaggagaggcctgcctgaatgctgaattcttctaggtgccaaggggcagagcccaggaggtaaagtccaggaacactttgttatcaaggagtggttttagtgctggtgtgatggcttctggaagccttctcactggccaaataggagcttttgtgttatatacctttcaatcttaaccaagtatctggagaatactttcagggcacaggagttactatggattttataatagtggcacccaaacctcccaagatgcactcagtgattaaaaagacttgaaattttaatacgaattttttcctgaagtcttttttttttttttaaatcaaactttcctgaaaggtacaaatccaaattgaaaaaataaatctcctttagctactctctggggcctacaaataagtatgttttttactaaaatgcaaaagtaaagttctggctttttcctagaagaggcaatataggggagttaagactgtgtggctacatggcctgggatcatgtcccagctgtgtcccttattagcagtataactaccgagttacattacctctctgaacctcagttgccttatctgcaaaatgcggaaaataatttaacttaccttttgggttgttaggattaagagttcatatatacaaagttcttagaatattgtcaggcacataacaatggcaaacactgacactgctttctgtggtcagtacttacctctccaggctttcttgtgtccctatcttctgatgtgtgaggtacagtcaccaactttcccaccaaggagggggacacaggatgaaaggcagctgtctttgggaaatagaccttcccttgtctgttggtttcgagcaaacacatatgacaagaagaataaagtaaggagagtgaaaaactgccaatatggcttttgtttccacagctgaaagggtgaagcaagagaatctgaacctcgtctgtattcccacttccttccaggtatgtcctgctttccatctgcatcgtgacagcttctgctgtatcttctggttccccggggttgtggacctatggccttgtcttgtacctcaaggttgttctaggtcagagagtccaggaataggagagtttattgaccaaggattccttcttggaattgtagttttaggtgcatttgtttaatcacttggtgaatatttcagtgcatgttgagtttaggcactacggagaatgcagagatggcccggtagtctctctcctcaaggaatattactcctatttataggtgaaaaaaatcaggctaggccaggtgtggtggctcatgcctgtaatctcaagtactttgggaggccaaggtaggcagatcacttgagcacaggagttcaagaccagcctgggcattatggtgaaagcctgcctctacaaaaaatacaaaaattagctgggtgtggtggcttgtacctgtagttccaactatgtaggaggctgaggcgggaggatctcccttgagcccaggaggtccaagctgcagtgagctgtgattgtgccagtgcactccagcctgggcaacagagtgagaccctgtctcaagaaaaaaaaaatcaggctaaaaggaattaagcaatgtgttggtaatgcaagtacatcataaaatagtaggagctgatggaggaaagcagtggagccagttaaatatagggagagataagggaagagaggttttgggaagtggaagggaagacagttgctcagatggagccaattgtcatccctcatctggccattgcagggaggagtatgtgtataatctctcgctggattagtcaagatgatactatgcactggggtaggagatgagatttatgagtgactgatgctcctgggactttatggacttaggcttggatagctgggtttcttaggaaaccctcccaatcctggagacacaggatgctggcagcctgcaaccagctctggtgaagggagagaggttaaggttccttctaaaccagactggcctcagcttaacagtagggtgtaaggcagagattccaggtagacaggttagggagttggatagtgcatactgttggagcttccttgatgttaaatctcttggagaccttaaacaaggtggatggccacccaggggactgaaggcaatatcttaagtgttttatatagctttttttttttttttttaaatcctgctttcttgaggcaatgcttttaaagcctcagtggcttgtgatggattttcttagtcttttgaaaagctaagtatctaatttttccaactggcttgatcatcaagtatttttatttcttagttaataaattacattggtgtttatttttaaagttatatatgcacgtggattgaagaaacaaataattcaagtctttttatttaaaagaaaaaaaagcacactaccctcactttcccctagatgaccactacctagaaagcacactcttattacctcccacccctgacctccactatttcttgctctttacatggacatacttttagctcttttaggtgattggatattctaacagccactatagatttaagtcaaagttaattttattctgagccaagtttgaggactatagatcagggacacagactcagagcaaactgggagcgtgtccctttctgttgtaattcagtaggtcagaattagaggaaagagtatgttggataaaacagacaatagaggaccacccttacatacattctgtggctgtagttcaaattgatgagctaacataattttggctggagttttattcttttggtaacatttttgcagtattgataatatttgtaatgtaggaatattagaaagataatcaacaatatgatgagcaacttagaggtccactgaagtaaagaaacacttatcatagaaaagaatcttgaacatagattttgatagtctgtgactaattagataaatttcctccctttgtatttgtactttatgatatctttgcatttataactgtaattagctgatgatttataatgtctaattgcttgtccattttctgctgggagtacaatttgaggagggttgagttccaattttccaatttttattatcaaaagtattacttcatcgtaaaagtaactttcctgttaacccagtattgtaccaaatggcagtataatttaaatcaaatgttgtctggttgcaagtaagatctaaaacagctacagtctcatttttcctccctttctaatgtaagcaaccttttcctattgtgttagtccattttcatgctgctgataaagacatacctgagactgggcaatttacaaaagaatgaggtttaattggacttacagttccacgtgctggggaagcctcacaatcatggcagaaagcaaggaggaacaagtctcgttttacgtggatggcagcagacaaagagagaatgaggaagacacaaaagcaaccttgataaaaccatcagatctcgtgagacttgctcactactatgagaacagcgtggaggaaaccacgctcatgattcaattatctcccaccaggtcactcccacaacacatgggaattatgggagtacaattcaagatgagctttgggtggggacagaatgctggcagcctgcagccagctctggagcctgccaaatctcatgtccttgcatttcaaaaccaattatgccttcccaatagtccccaaagtcttagctcatttcagcattaactcaaaagtccacagtccaaagtctcatctgagacaaggcaagtcacttcagcttgtaagcctataaaatcaaaagcaagctagttatttcccagatacactgggggtacaggtattgggtgaatacactcattccagatgggaaaaattggccagaacacaggggctacaggtcccacgcaagtctgaaatccaggatgggcagtcaaatcttaaagcgccaaaatgatctcctttgtctccatgtctcacatccaggtcatgctgatgctagaggtgggtgcccatggtcttgggcagttcccttcctgtggctttgcagggcacagccttcctcctggctgctttcatgggctggcattgagtgtctgcagcttttccaggtgcatggtgcaagctgtcagtggatctaccattctggggtctggaggacagtggcccttttctcacagctccactaggcagtgccccagtagagactctgtgcaggggctccaaccccacattttccatccgcactgccctagcagaagttctccatgagagccccactcctgcagcaaacttctgcctgggcatccaggtgtttccatacatcttctgaaatctagacagaggttcccaaacctcaattcttgacttctgtgctcctgcaggctcaacaccacatggaagctgccaaggcttggggcttgcaccatctgaagctacagcccgagctctacattggcccctttcagccaggggtggagtggctaggacgcagggcatcaagtccctaggctgcacacagcttggggaccctgggcctggcccacaaaaccacttttttctcctaggcctccaggtgtgtgatgggaggggcttccatgaagacctctgacatgccctggtgacattttccccactgtcttggggattaacatttggctcttccttacttattcagatgtctgcagccggcttgaatttctcctcagaaaataggattttcttttctatcggattcaggctgcaaatttttcaaacttttatactctgtttcccttttaaaactgaatgcttttaacagcacccaagtcacctctcgaatgctttgctgcttagaaatttcttctgccagatatcttaaatcatctctctcaaggtcaaagttccacaaatctctggggcaggggcaaaatgctgccagtctctttgctaaaacaacgagtcacctttgctccatttcccaacaagtttttcatctccatctggaccttattttccatatcgctatcagcattttgggcaaggccattcaacaagtctccaaacttaaccacatttttctgtcttctgagccctccaaactgttccaacctctgcctgttacccagttctaaagtcacttccatattttcggatatcttctcagcagcgcctcactctgctggtaccaacatactgtgttagtctgttttcacgcagctgataaagacatacctgagactgggcaatttacaaaagaaagaggtttaattggacttgcagttccacgtggctggggaagcctcacaatcatggcggaaggcagggaggagcaagtcccatcttacatggatggcagcaagcagagaatgaagaagatgcaaaagcagaaacccctgataaaaccatcagatctcatgagacttattcactaccacaagaagagtatggaggaaactgccctcatgattcaattgtctcccaccaggtttctcccacaacacatgggaattatgggagtgcaattcaagatgagatttgggtggggacacagagccaaaccatatcacttctgtaccatatattatattgagcagggtatagaaattaagggtcatctctctcaccgctcccgttcaacatagtactggaagttctggccggggccatcaggcaagagaaagaaagggtattcacataggaagagagaaagtcaaactgtctctgtttgcagatgacatgattctgtatctagaaaaccccatcatctcagcccaaaagctccttaagctgataagcaactttagcaaagtctcaggatacaaaatcaatgtgcaaaaatcacaagcattcctatacaccaacaatagacaagcagagagccaaatcatgaatgaactctcattcacaattgctacaaagataataaaatacctaggaatacagctaacaaggaaagtgaaggatctcttcaaggaggactacaaaccactgcttaaggaaatgagaggacacaaatgggaaaacattccatgcccatggataggaagaatcaatatcatgaaaacggccaaattactgcccaaagtaatttataaattcaatgctattcccattaaactaccattgacattcttcacataattagaaaaaactaccctaaaattcatatggaaccaaaaaagagcctgtatggccaagacaatcctaagcaaaaagaacaaagctggaggcatcacgctactggacttcaaactatagtaaccaaaacaataactaaaacagcatggtactggtacagcagacacacagaccaatggaacagagtagagatctcagaaataagactgcacatctacaatcatctgatcttcgacaaacctgacaaaagcgatggggaaaggaatccctatttaataaatggtgccaggagaactggctaaccatatgcaaaaattgaaactggaccttttccttacaacttatatgaaaattaactcaagatggattaaggaacttaaatgtaaaaccctagaaaatgaaaaacactataaaaaccctagaagaaaataccattcaggacataggcacaggcaatgatttcatgacaaaaacatcaaaaacaattgcaacaaaaaccaatattgacaaatgggatctaattaaagagcttctgcgcagcaaaagaaactatcatcagagtgaacagacagtctacagaatgggagaaaatttttgcaatctatccatctgacaaagttctaatatctagaatctacaaggaacttaaacaaatttataagaaaaaaacaaacagtcctgttaaaaaatgggcaaaggacatgaacagacacttctcaaaagaagacatttatgtggctagcaaacatgaaaaaaagctcaacatcactaatcattagagaaatgcaaatcaaaagtgcaatgagataccatctcatgctggtcagaatggcgattattaaaaagtcaagaaacaacagatgctgaggaggctgtggagacaggaatgcttttacattgttggtaggaatgtaaattagttcagccattgtggaagatggtgcggcgatttctcaaagacctagagccagaaatatcatttgactcagcaatcccattgctgagtatatacccaaaagaatataaatcattctattctaaagatacatgcacatgtatgttcattgcagcactattcataatatcgaagacatggaatcaacccaaatgccaccaatgatagactggatgaagaaaatatggtacatatgcaccatagaatactatgcagccataaaaaggaacgatatcatgtccttggcagggacatggatagagctggaagccattatcctcagcaaactaacacaggaacggaaaaccaaacattgcatgttctcacttataagttggagctgaacagtgagaacacatggaggcagggaggggaacaacacatactggggcctgtctggggggtgtggggggagggagagcatcagggtaaatagctaatgcatgcagggcttaatatctaggtgatgggttgatagatgcagcaaaccaccatggcacacatttacctatgtaacaaacctgcacatgtatcctggaattttaaattaaaaaaaaaaaagaaattaagggtcatatttatatgatttcaggattccaaacattttggggacagcaccaacttcctgaatttgtttacgatgtagaactgaaattggactccaagtattatttaatatggcctttcaactccccattgggaaaaatgggtattacttaaaaaaatctctattcctactaacactatgttatatgtctagttattatctatgtggggtgctaatgctgtaagagtacagtgaattaagctacatattcttggtagtaattttccaggaagaagagggttcatatgtttgtgcataaatgtataccttgtgtttctgcatccaaaatggagggcacattttagaggccacttcagtttccatttggattagcatggtcagtaaaccttgttgagtttggacgcatgcaattttccatcactgggttttggcatggctccttgttagttgagtagttgatttaccttcttaacaatagtgtcattatctttttgtgtagcttcccaacccataccttccttctgaaagaatatttcttttaatctgtttagactggtaaatattgacttttcttgtgattttcttttttttttgtcgttgttaaatacacttttagcttgtcctaacatctcaagtcctgcctttattggacctaaggttctttttgctttagttggctagtgctgttttatccaccaaacatgttgttgccattgagcatttataatggaagtgcaatttgagtaccggttacaaacccaataatgttgggtgctccaagttaaggtgagaggagcagcagttacccctagatacagtttagtttgagtacactgtaaggcttctcacattctccctggtaacattcccaagtatcctctggtggtactcttgtccaccaagtagctctcattatttgatttccagtttcattagaattgtgtagaccagtcacaaaaacaaggtccctgactcctaggacaagagatgctatggcaaggcacataagctgcagctaaatgtcttccaggagtttgtatagtaagtgtatagtaagtgatcatctgtattcacagtaacatagtgatctatttgtaaagtgttaaaaattgccagaccaggcatggaattgggaagaacttcctggatatctttccctaagtgggggcctcttgatagtttattatgcctgaaaaactggtgccatgggctatcggaacattggactgattctaagaaattgatgtcagggttccagtatcttcttgatattgaaaaaatgtttgtcctactttcacatcagttagattagcagtttcccttaagaggaatggggatcaaacacatgagggagtgttagtaaaaattcagtcatcatgcaggaaaatacaaaaacaaaagatatatgcagaagaaattcattgtcagttcaggcctggtctggtaatttgggcaatgttgtctatcaggtcttgtctgctttccataatcagaggtgtcaggaatctcagaaatctttaactggaggtctccagtggacttataagttcatttagttgttggagctttctttaaatgagaaatgtgaatccaggagtcagctccttcaagttttgctgcacagcaattagttaacaatacctgatagagtcctttccagtgaggttcaagtgagtcttttagtgaggttcaagtgagttttttagttgatgttgtttccaaaaaaaaggtcccttggctagacattatggtatttaagatcttcgtctccaaggagtacaccgtaaaaagaatcttttattaatttattttggggaaagaagtttagttaagccttgacaataactgagtatagcacctttcaataaagttggttcatataaattgctgtcctgtttcataggttgacttgtaattgtctcgtaagtgggtaattgatgttatccaagagaagttgctcttgggttaagcaaaaccaatggaagagcctttggcccagtatgaaaagcttttgttaattttgccaaatggattttttttttttttttttttgagacggagtctcgctctgtcgcccaggctggagtgcagtggcacgatcttggctcactgcaagctccacctcctgggttcatgccgtactcctgcgtcagcctcctgagtagctgggactccaggtacccgccaccatgcctggctaattttttgtatatttagtagagacggggtttcaccctgttggccaggatggtctccatctcttgaccttgtgatccacccgcctgggcctcccaaagtgctggggttacaggcgtgagccaccgcgcccggccagccagctggatctttactattccgtttatttgttccaccgatccagaagactaaggatggtatacacaatgaaaatgttggaaaatgggccagattttacaaattgagtggactgtctttctagtaaaatgagttcttctatcgctatgtaatttggaaggagttccccaagagggaattatttgcttcgacgatattttcctcctgcgtgtgctatgactcttctgcaaggaaatgtttcaactcagtgagagaacattcaaatcataaccagtatctatttataatcctgggctggaggtaattggataaaatccacttgccagatatcagaaggtctggtgggcaaaggaaaatgcccttgatatccatgaagaggctgtcctggattatgtttaggacaaactgcacatttagcataagtcttatgagccaattgtgggtgactgtttccagtaatattgtttttcttaggcagtcattttctgaggtccctagtgagtgagctgatagaaatgttgtaatacaggaaattgaaataaattccaaaggcaaaacaagtctgttgttgagtccatactataatttgcaagtgggggaaaggtgtgtctcctttgttagccatatctgctttttcttctctgaacccttttcttgagccacttggagttgtttttcaatggaactcatttaaaaaaaatatagccacctgtatagtttcatctgctattagtgttagagcagcctttggctgctgcgtcaacaaaatactttttctctgaagggctgagtttggagtgtccaggaatcttaataatagccccccttttttttctggaaattccttagtaggggctctaagttctgcctcgtcctgggggactaaactactgaaggttctccctttgggtcaggattttctctaaaaggtgctatcaaaacttctgtgggtagaggagggagtaaggaacatctgatctgggcaaggcagttcttttgtttttttttgagacagggtcttgctctgtcacccaggctggagtacagtggcatgatcacagctcactgcagcctcggcctcctgggctcaagcgatcctcctgcctcagcctcctgagtagctgggactacaggtgcatgccaccatgcctagctttttaaaaattttttgtagagacgatgtctcactatgttgtgcaggctgttctcgaactcctgggctcaagtgatccacccacctcagcctcccaaagtgctgagattacagatgtgagccactgcgcccagccaaggcagttctgaaaggaaagaataagagggttctgaaggagcagttggaggggaggaggtgagacagtggaaacatgagacgattttttcagtggagaaagtttccaggatcttttggttcacctcctgtatggaagcaattttatcattacttcttttagaagcttttaaaaaccattgtagtaactatcccattctttgtgtttaatttttaagccactcctcccagttgtgcacgtaaataattcaattttggggtcttgaatgagccccattttggccaagttaagctaatttaatttttagtgatgttggttcaatgagtcaaaaaatttataagatgaggtgctataatttttagtcacaagcctagctggtgtcttggaagatggtaactctccttcaatagcttcaacttcagatgtcttgttttaaatgtctctcctcccttctcccttgtctgcaccagattaagaatgtgttcagggtcaaaaatgtgttgcttatgagcttcactcctcgagctcttacccctgaggtggtctgctcacccctgagctggtctgctctcttaggtgtttcaggagaaactcgcctgctgaagcagtgaggtgccctgaacgctaggcgaccagcctattatgagagttccctggaggagctattacaacttaagtgttttcctgttgatggtgaagctctttggaaccactacatgtcatgaggaatctcctctgacccttccgcaagattctttgtcacttaaaaatacctgaggtccgggctggtgggcgcaagcatcctttatatttggagcaatttttatctctgttgctcttatatagaatgtaaaggattggtgcagacaaaggagttttgaaaagaaaaacactcagctagtcaaagaaaccaccgcaaggtggtcaagctatagcttggttttatacgttttagggaaacataagacatctgtcagtacatgtaacatgtactttggatcagtctagaaaggtgggacaacttgaagctccagggcagagttgggacttccaggtcatagctgcattcaaagattttctgactggcaattggttgaaataattattatctacagacctggaatcaatagaagggaatgtttgggtgaagataaggggttatggagaccaaggttcttatttatgcagatgaagcttttaggtagcaggtgtcagaatagattgtaaatgtttcttatcagacttaaaaagtgccagagtcttaattaattctcccctgggtcaaggaaaagacctggaaagggaaggggattctttacagaatgtagatttttttccctacaagagacagctttactgggctatttcaaaatatgtcaaagaaatacattttagggtaaaatacagtttctttcaggacctgctgtcatgtgattctatactaggatcaggttggaatttggtgtcttattgctacaaatagtttgttttgttcatcttaagatctgttttagctgggagtggtggctcatgccagtaatcttaacactttgggaggctgaggtgtgaggattgcttgagctcagttcgagaccagcctgagcaacatagtgagaccctatttctaaaaaaagattaagaacaaaaatctgttttaatgttaatgcttgtcagttgtgcctgaattccaaagggaagatggtataatgaggcatatctgactcccctttcccatcatgacctgaacttgattttcaggttttctttggaatgcacctggctgagagtagaggtccatcagtcagttgggaggcatagaattttgtttttggtttacaatgaatatagggtaaaaagttaaccagtatgcaggtgtctcaggatctggagagaaatgattgattttctcctgcatttgtgcttcatctgataggcaagaaggttacaatcagcacatgttagtgaaatgtttggcaaattccagccttgcaagtgagagttcatctttaattcataggcctagtttcttttacctgtgtgttcaacctgcagctatcttgagctgcttttaaaattctttcagattttctttttctgacaactttaggtaattgtaattctgaatggataaatggaagatgaacatttgcttattctttaccttgctctcacagttcaccctccctctcctctcctaattgtcccagtacagttactttttagttaggttttacttgttttttacagaattgtaactgtgcaagaaccacacagtgtgttatgtatgattacttttccttgcctgcccaatattttgttttccccaaagtggtgaaatctgttttttccagcacagtgggtatcccacttcatcaatttcatctgctttgtgaaggctgtttgggtcatccgggatggtcaactgtaagccgctatacttggctgcactcttggggtctcccttcacagtcaggaaatttccttctcttttctcttgttttgggttgcccttgcttcttcttcttcttcttttctttttttagacggtgtcttgctgttgtcatccaggctggagtgcaatggcatgatctcacctcactgcaacctccgcctcccgtgttcaagtgattctcctgcctcagcctcccaagtagctgggagtacaggtgcccgccaccacgcccagctgatttttttgtatttttagtagagacgaggtttcactatgttggccatgacgttttggatgtctgaatatatatatatatatatatattttttttttttttttcaagctacgagtaggcctttttttttttttttttttttttttgagacagtgtcttctcactgtcacccacgctggagtgcagtggtgcaatctcagttcactgcagccttgaccccttggcctctagccatcctcccacctcagcctcctgaatagctggaatacaaatgtgtgcctccacacctggctaagaaaatatctttatgcgacttttcctcagtcatcatttgactctacagagcactatgttaaatactttctcaggaattttgtaggcatttctctgttgtcttctggtttttaatttgctgttgaggaggtagatacccttctgatttgtgatcctttgtatgaaatctatttttaattctctaaggactcacgtaccgttttattatcatgtttttctccagcattctgaaaacaccatgatgtgtctcttggtatggatctattttcgtccagtgtgctgggcacttgctgggacagctcatcatgcgtattcacactctgcaattttgggaatattttccctattgtttatttcatttttcttccctctgttttttctggttcatctttctgggacccttcttgtgactttggtgcttgtggacagtcttattttgtccctttgcttcatttttagctttgcctttttctgacccttttattgagctttctttgttctcatgtgttcagtttctaatagctcttttttgtttgttttctgaaaatttttcgtagtaggatcttgttcttgttttatggttaatttttttttttttcaatttcttcactgaggatgttaatgattttttgtttaagggacttcttcttgtacaggtttcctcagttgttttttccagttcatgggaggtacacttcacagtaaaattcactccttttaagtacaatttttagttttgacaagcacagtcatgtaacaaccaacacaatgaaaatattgttggattgtttggtctattaaattatgtctgttttctatctgctcattttttgtttttttgtttgtttgtttgtttgttttttagatggagtttcactctgtcgcccaggatggagtgcagtggcgcgatctgggctcactgcaacctccgcctcctgggttcaagtgattctcttgtctcagcctccaagtagctgggattacaggcacctgccaccacacccggctaatttttttgtatttctagtagagacagtgtttcaccatgttggccaggctggtctcgaactcctggcctcaagtgatctgcccgccttggcttcccaaaatgctgggattacagatgtgagccactgtgcctggcccctgtctgctcctttgaagagtgctgggctacctgatggtcagccagctctcaagatgaggattgtctgtcaggccattaccttggggaactcctgatgtcagatcatttgtctttcccctggctggtcagatgtcctagagaaggctgccccatttctttttgggaggggtatgcatggctacccatggcctgggagtcaagtaggtaaagaggactagaagatgtctgtcagtattctggatgtaaacttgcttttaattctcttgttttcaacacaatacctgtggtagatgagagaaagtgcagcatctcctgaacctgggcatgaacatgtgacttgtttgtcagccaccgagttctgggatagctgctgttcagcaatagctcactgatagggtacccttgtcctcaaatgtgcttggccactcaatcctaagaccagcgtttgaccttctctagagaatcagcatgctgttttgggagtacagagggaggattagaggtataacaagttttaaattagcctttcaaccagtcttctcttttttttactcctactgtaaccacacaataggttcgtcacttaatgcacacagcaagtcaatacgcagagacactggtttgtagcagagaaaggtttaaccatagggccaccaatcaaggagacaagaggaatcctcaaatccgtctccctgagtagttgggggctggggattttaagggttttggaatgggttgaagtgtggagatgattggaaagagtgcagggtgaagtcaagggacaggagaggaagaaacagtattctcatgctgattttgttcctcttcggggggaagggaggcttcaaactggttgatgtcaactcttcagctggaattcaggatctgaaaaaatcataagcaattcttaaaagccttatgattctaattaatgtcagagatcccatctataagaacaatgggggatgcaattaattcttaaaagcccatgactctaatgtcagaaattctatctataggaacagtgaggatacaagtgatcagtatctagagctacatgacttttggttacaaggaagtgggccaaagtgcagcctgattaatgcttaattataactatatttttgttcagaattcttgttaaccctgtgaggttggcttcacatcctggacttgaaaatatcactgcttcctgaaacttttgggacgttctgtggtattttagttacttcttagctttctttagtactggcctaggttttttgtttcttattcctgcatttaccgttgtccatcagtgttccagcttttaaaattcgttgctattttctcctctttcatgaggtttattcctttaagaaaaaatcctttattgtagtttcagagaggttttgagaaggagctgtgaaaggaaaataaatcttgggcccccaaatcactaagccaagggaaaagtcaagctgggaactatgtcaggcaaatctgcctcctattttctttccaaataagagctacaaaattaaaaagctacatacctccctcaaaatttgcccacaaggaacttccttgtggacaaaagacagaactcaaagtcatccctctgaggctcacctgagacaaatccatatctgattgcttcctctaccctattgtttatgtacaaatgcagatactgagctagactaaattgtgtattcagtggatagccgcttgaggactcaaaagaatgcagtcttttgtctattatctacttatgacccggaagaccccttccccgcctcaagttgtcctgccttatcagactgaacctaggtacatctgatacatattgattgatgtctcatgtctccctaaaacgtgtaaaagcaagctgtaccccaaccaccttgggacacatatcaggacctcctgagtctctgtcacaggcacatccttaaccttggcaaaataaactttctaaattgattgtgacctgtctcagatacaggtttacagagctgagctaaatgcaggtgttcaaactgccatctttacctggaagtttgatcctgtgtttttaaaatagcactcctcacccaactgagttttatggtgataattgataacagtgtatccagactggaaaatgctggcccattccggttaactgtgtggaggagtcattgagagttcacagggccttttaaaattcacttgttcaggttactttttttcccactcaaacgtaaacttatttttgtgttaagtttagccagatacagtctctggaaatggttgaaaggaagtcaaaatattttttgggggccaagagaaaaactccccctttgccctctgaagattcactgaaaattactgacaaaaggcatacaaatgtgtttgatcattgttttatgtggcacaaatgccttcagaatgcagatccaaagatcagaggaaactctccatttttatgcttaggttcagcaaagtatggacagccatgtagagatacgattggacaaaaaggatatgatttaatgctagtagatacagactgagttgagaaacccagcaagaccctcggtttagatccttcctggtctctctgcagcactccctccttggtatggggcagaatggtctttggaatgggggtcttatgacctacagtcagacaaaataggcgagataatttctttatgtccagttttggcatagaaagattagggagggaggaggttagagtaatattgttaaattttgtgaacccccaaaatgtgagataggtcccaggtaatttagaaagtttatattgccaaagttgaggacatgtgcctgtgacacacctcaggaggtcctgacgatatgtgcccaaggtggtcagagcacagtttggttttataccttttagggagacatgagacatcagtcaacatatgcaagatgaacattggtttggtctggaaaggcgggacaactcgaagcaaaggcgggaagacttgaagcagggagggagcttccaggtcataggtaaataagagacaaatggttgcattcttttgagtttctgattagcctctccaaaagaggcaatcagatatgcatttatcgcagtgagcagaggggtgactttgaatagaatgagaggcaggtttgccctaagcagttcccagcttgagtgattttggggccccaagatttattttccttttacatttcccccctttcttttaaaaaatcttttggagaaagtattttagaagaaaatgagtctctggcttcaggtttcttctgatctctcatggctaggattgtttattcctagacaggtagttcctgagttattaggaaagttcatttttagcaggtcgtgaagtctcatgtcctgtgaagagaaaatagggggaggaagggagaaaagcaacaacaaacaaaagaacaatcctggaaaattgatataggccacattactctaaagtccatacattagtagacaggtatgaaagtggcttatgtatgtaaataggttgctgttgtttgcttctgaagtttaagttgtctagcttcagtttgcagggctttgtgaaagcacagcttagtttttggtgactccaaattcggaacagtggggaaaaaagaaggaaaaaaacccctgaaaacattattttgcagggttgtagccaagaaaaattagaatttggttcaaattttagaaaataataaaattgaaaaacataggcaagactagaatctaacaacaggtgtgctatagtttttgaaacaatttttctctagtttcccatttttactaaagacaaatcatggtaggactgatttgctttatcatacttggccttattatttgtatacagtgcagcaagaataataattactttttttacacaggcttttaaattggctttgatggaactttgttccatagaaggaatctcagataagactccttttttaaagccgagcccagccattatggatttgtaccatcaaatactatgagttgggtgaattcctttcctcttgaggttccaagataaacttgggcctcctaggcctgtcagaaagtgacattctttacttaccacagctcaggaatcctgtacagggactgcatagacaaaggtgtaaggtcagtttttccaaggggctccataagtcagtttgatttctttatggaagacacaccattcaagttaaagccttggtaaaataaccagtttctttaattgtgccccattacgaatgaaaacagattcttattgcacttatgcaaataactgtattgtcataaggtaagaatagtcacaaatactccccaagttttatagaaatcaggtagagaaaaacaaatatgccccaaatttggttcataagagtatactttactaaattgttaaaagctataaatagcttaaaagaagtttttttgactctgaaaaataaaagaaaggatcagcaacgtcttaagcaaaacgttaaaaagattacttcagacttctattagtttagtccctgcagttaattactgttctgcttgatattcatgaatatttcagctctctgagtcctgaaagtttttcctttattctgatgttacaatctctaaagttgtgagaaacttgtattcaagagcacctgttaagagttttatagctgattataaagccaccttctaaagaggaccaaacaagacaacaattgtcatggatgacaaaaagttttagggcagctatagtcaagacacagttgacaaggagatttgttacctctgtagcacatagtaatttaacataacaattataattattactgataacatacattaagtcatatcagaattataggagtttcccataattttggaacacataccaataacatttatacaaatacagcccagagaaaagcaaacaccatttcatatttgacaatgcttcctgtataatttttataccaaataagccaaattatgtcattgttttagattttagggaacctggtatcttaaaggattaattaggtcagaaaaagacataatttataatttgattttggaaatattgtcaaatatcaaaggtttaaaacacttgatatcacaaaagaggatcacaggtcattgtaaaataagtcattcatttaaccaaagtgataacctaaggatttaaaaaagaaaaagtcaaaaaccttcattttttgagagaggagacttaatttgccaaacaataagccctaatcaaaacatgaagctaattaaatttgttttccaaaatgtataaacaatttataaaattttaatcttgaacataagatataacttccataagtcttttatagactttataacctttattaaggagtcggttaatgcctcaagataaccttgttaatctgacccaggtgcccatatgctggtcttgcatcagtgtgcttttgacattaatgtttgatttatagtgaaactgaacttattttatctctcaaaattggcccttacaatctcacacacccacctgttccacagtagtcccttggcgttgaggagttgaatagctttaatttctggcctgtgtctcaggaatgcagtttattttgattggcatcttctatggggcctgatgatgaggctttaattactgtcagtatttaagattttacaggacttggtatccttctcagacccaagagtcaaagccctgtaacttaatgttacaagaacttcaaaagcacatacaaaaagatacgtggatgtaataaccttaatttaaaaaaaaatttgtctcagttttttttcgtaagcaaatcaaaacttaatgccataggaattatttccataaaacgtaaaatctgttaggccagttaccaaaaggcaaaaggaaagaccttctgcagtgtacagaatattatgttggaagaaaacatttcctttagacctttaagaaattattgttagcatcaggccacaacaaatggaacttgaggggaaaaaaacttatatgagctgaaaatgagttggagaacattattactttgctccttttaaaaggggagaaaaaactgaaaatggtgagatgtaataaatgtcaaacttctaaaacaaaattaaaaaataatttaaattattttaaaatacattattaaatatagtttaaatatatattatttaaatatatagaaatatatttaatagttatgagataccatctcacactggttagaatggctatcattaaaaagtcaggaaacaacagatgctggagaggatgtggagaaataggaatgcttttacactgttggtgagagtgtaaattagttcaaccattgtggaagacagtgtggcaattcctcaaggatctagaaccagaaataccatttcacccagcaatcccattactgggtatatacccaaaggattataaatcactgtactataaagacacatgcacacgtatgtttattgcagcactattcacaatagcaaagacttggaaccagcccaaatgcccatcaataatagactggataaagaaaatgtggcacatatacaccttggaatactatgcaatcataaaaaaggatgagttcatgtcctttgcagggacatggatgaagctggaaaccatcattcttagcaaactaacacaagaacagaaaaccagacactgcatgttctcactcataagtgggagttgaacaatgagaacacatggatacagggaggggaacatcacacactggggcctgtcagggggtgaggggctaggggaggaatagcattaggagaaatacctaatgtagatgatgggtggatgggtacagcaaaccaccgtggcatgtatatacctatgtagcaaaactgcacgttctgcacatatattccagaacttaaagtataatttaaaaaaaagaaaataaatttaataattatactttaatacttataaatatattactaatataatcatatttaatataattagtataatataaaatacaacatattagtatattgttttattattataattaatatatgttaatataaaacataatagatatattttagatatatattatacacacacacacacacacacacacacacccccccccccacatgcacacatgttttttgcagcactattcacaatagcaaagacttggaaccagcccaaatgcccatcagtgatagactggataaagaaaatgtggtgcatatacaccatggaatgcagccataaaaaaggatgagttcatatatattatataattataattatgtattgaaacatatattaatagcaaatatatctttaaatacatatatttatttaaaaacataattaaaatctctaataatttattaagagtagatcccttaagaaatcaatcccttactgttctaataaattctttagtatataaatggttttttttaaatatcaaacccaatctccagaaagaccattataatttgtgtttaattatagacagcttgatctataaaagttttttttttttttttaatccttttattgtgccttagactcttcatgacgtgcttggactttctggtttgtcctgaacatacctctttcttaaacaaccagtcattttattctaggcccaaattaaccatacaagattttttctcatacaaaattatttctctttaagctttttcaccaaaaaaaccctttttttttatagctttctttacatctctcttattttgtggttccttttacaacttgttttatacataacctttaaaaaagctttgaaccaaacaaaaattgttcacctttttaaggacacttatttttgaaagaatattttcctacaatatatttttattggaaaatacccaaataataaaatatctataatttaactttagattctaaattatgacaagtttgtctacaagtatttatcccattacatttacttattttaattgtttagattatttatgaaaagtttgatagtcattatttaaagttatgaaactttccattgcaaaattcggagacagtgaagaagataggacctaacggactccatcttgcttctaacctttacggtgtccttgttcattcctggtctttgggaggaacttagtttgtagtttagctttgaaacaaagacgtaacagtcctttgtctcatttgccattatacatgccatggtcagatcctctcacagtacaaggtgatctctggtgcccccacagccaaagaggtcaggtcacccaatacaggaaaacagagctttagacctaagaagaatctgcccatgactcttgaaactctgcaaagaaaacagaacaccccaactgcggtgagtggcacctttgttctgaattctttaaaggggttcaactcattataaacctctagactgtttttggtactgcagatggcaaagggggaagaaggaggtatagggtggaagagaagtaaatgaaagaacatttgtttgtttttttaagacaggaagcaaacagaaaccaagtgcatagttttttgtttgtttgtttatttttccctcttttgcagctgcgaggaattttagcgaaattagaaagggtttgttacccataatttggaattcttgcttggatttgatcaagtcaggtagagttggtcaaatctgttgggagaaagactgcaaaaaacaacaacaataaaaaccctaacaatatgatcaccgagtgctctaatggtaaggagagattaagaccaactagttattaagctttagacaagagaaaaccccaattcaactacttacctagggatgggtctcaggctaaagactgctttctaccgctctagaagcaggaggaaaaaaacaacaaaaaatgttaaactcatattccctgctgggagtgagctcaaactccataaaggagttacctgccttccatcgtcatggaaacaggaaatcttgcattccttgttggaatcaagtaaaactccaaaaaacaaaaaggtggggggagttctacagcaaaataaactttagattttgaccagatttggggagatcagggattctctggagggtgtactcccagacctcagcaaattgtcctgttggtttgagccataaaattagctcatgctggtactaagcactgatagatttgtcaaaggtcaggggtacctctactcagaatccctctgtggttaccaaaatgtcaaccctgaaaatctgagacaggtttcaggtaatttagaaagtttattttgccaaagttgaggacacgtgcctgtgacacacctcaggaggtcctgacgacatgtgcccaaggtggtcagagcacagtttggttttgtacgttttagggagacatgaggtgttaatcaatatatgcaagatgaacattggtttggtctggaaaggtgggacaactcaagcaaaggcgggaagacttgaagctggaagggagcttccaggtcataagtatataagagacaaatggttgcattcttttgagcatctgattagcctttccaaaggaggcaatcagatatgcatttatcacagtgagcagaggggtgactttgaatagaatgggagacaggtttgccctaagcagttcccaccttgattgattttggggcctcaagttttattttcctttcacagttttatgtctggctttggggaaaagggaaaaggaaagtggttgttgtttctgtgacctgctttggggaggagggattctagtttctatggctatcctcaggagcatgagaggccagagtcaggagggcagaataattgaaagaaacttttgcctctgaatatgtttctttcttttttctttgttttgttttgttttttttgagacagagtctcactctgtcacccaggctggagtgcagtggtgtgatctcggctcacttcaacctccacctcccaggttcaagtgattctaatgcctcagcctccctagtagatgggattacaagcatatggcaacacacctggctaatttttttgtatttttactggagatggggtttcaccatgttggcaaggctggtctcgaactcccgacctcaggtgatctgcccacctcggccttccaaagtgctgggattacaggagtgaaccactgtgcctggcagctcctgaggatgtttctgaggcttttattttggggtatcctgagccctaacagtttcatgccctactttttaaacaagtaaacctgtagggatttaaatgattttggtggatttgctctttaaaattaaaggcctttaactttaaaggtagaaggtaaagaagaaggtaaagtacctgaaagccagaactggtttaaaccaaaaacagcatttattgctcactctgccttcggttctaccttgattaggtagtagaagggaaaatgtttatgcttctactatgtaagcaccataaaacctgaaaaccacattttgtgaaataataaaactacattttcaggttttattgtaaaatgaagggaaaacagaagtaccagtagcctgccaagtgccactgtccctaatcatgagacgtttagaggtaccagctgtggggtttgcttcttgcctttcttcagaatcacaagctaatcattagctttcctgctccttgcactttccagaactctggccagaagaggcaggcaggggtgtttactctacacgctccggagacccttttgcttccctgttagaagcttctggtgtctagcagatgcagatctcagtggagcaccagaggctgcatatgctcactgagccagtagtgggtcaaaacccttatgctgtttgtggaactccatgcatcagtttgccaaggctgccataacaaggttccacagactgaatagcttaaaaaaaaaaaaacagaaatgtgttgtctcagagttctggaggctagaagtctgagatgaaggtgttggcagaattggttctctgagactgtgaaggagaatctgtcctgtgccttcctcctaactctctcggtgggttgctgatatcctttggtgttccttggcttgtaggcccatcccctgatctctgcctgcatgttcacatgttgttctccctgtgggcctgtttgtttctgtgtcaaaatttccgcttttaataaggacatcagtcatactgatttagagcttactctaatggcctcatttgaatttgattacctctctaaagacactgtctccataaaacatcacattctgaagtactgaggcttagaactccaatagatcttttttgtggggaacacaattcaacctaacattcaggaaggatgaggctcacaccatttgtaatcaggacttctctgtagagctgctggaccactcctgcggggaggcaagtcacaggttgggagaagggagagttggagaacttgctgatgggaacaggcttaaagtgttctctcctagtgggatcttgaagtcattgtacaggggcccagacttcagttgaccattttaacaaaccggcagaattcctgagcctcgtgttgtgaattggggcacagaactgttttaaagggagtacagatgctccccttgtgttgttgcttattgtctgttggggaagatgggagagtctcagggcttgcagaagttgagggtggagtatgggggtatgcaggggaatcacagtgggccccccagctgcagaaacagacagtgctcaccgaccaggcccttctcatgtgccaggctttggtcaggtactggggtgggcggctggtggttgtggtgaggaggcatagctcagttggttgtcgtgatcatttaaggcaagcttgtccaactcgtggcccaagatggctttaaatgtggtccaacacaaattcataaactttcttaaaacattgagtttttttgtgattttttttttttaagctcaccagctattgatagtgttagtgcattttatgtgtggcccaagacaattcttcttccagtgtgacccagggaaaccaaaaggctggacacccctgatttaaggtatattcatttgtataagaatagagaggcccttgtgcatggagaatgtgtgttactatcttcagtgtctggtgtggtgcctggcactccacaaatattcaaagaattaatgctacattcatgtatgcaatattttataagtatatggtagagaagaagtagagataatgtgccttttaggggaaggagagccaactccttgtccaggacatgacagctatttttaaaacgtccttatcagttagcagtgtggggttttttttgtttgtttttgagaaagagtcttgctctcttgcccagactggagtgcagtggcactatctcggctcactgccaccctccacctcctggtctcagatgatcctcctgcctcagcctcctgagtagctagggttacaggtaccatgatgcctagctaatttttgtatttttagtagagatggggtttcaccatgttggtcagactggtcttgaactcctggcctcaagtgatccacccaccttggcctcccgaagtgctgggattatgagcatgagccaccgcgcatggctgttagcgatgtgttaatgattggtttaatatctcttgtgtgcgtgcgtgtgtgtgtgtgcgcgcgcatgtgtgcgcgtgcatgtgtgcgcatgcgagagagaggagcatgccagtctgcagccttacccctgccctccctctgcagcgttctctgtaaactaatctcagaagtgtcatatcatcacctccgctttgtgccattggtcactcacacagactaactctgggacaatgggaagggatgatccaaagggatgaatgtcaggaggtgaggattattggggccctctttgaggccactttccaatgtttttgtagtctcagatctgaagttaggatggtttctctaatactacttttacttttttaaactttaaagttcaggggtacatgtgcaggtttgttatgtaggtaaacatgtcatgggggtttgctgtacagattattttgtcacccaggtgttaagcctagtacccattagttattttccctgatcgtctccttcctcccaccctccaccctctatccttcagtcagccccagtgtgtattgttgccctctgttagctcccacttacaagtgagaacatgtggtatttggttttctgttcctgcgctagtttgctaaggataatggcctctggctccatccatgttcctgaaaaggacgtgatctctctctctttttgtttttaacggctgcatagttctgatagtacttttggagaaatctaagaattaagaaataatctagcaatactatttttgctgttttccttttcagcatatatttctctttaataagttcaaaatcataaggttttttttgaacttgcttattcagccagcattttattttagctttttattatggcaaatttcaaagttcagaaaggagagagaacaataaaatgaacttccatgtactcagcatccagtttcaataattatcagttcacagccaatcctatttcatccatacctaaatatccccctgaatcttgttatttagaaacaaattccaggcataatatcatttcattgtatatatttcatatgtctctctggaaaatggggagtcttttaaacaccacaacaatactaaaaagagcaataatttctaataacatcaataatttttaataacatcaaatctggggttcaaagtttttttattgtcttttcctttaaaagtatattttttagtttgtttgaatcaggatccaacattacaattttcaagatctttacgttttagccttagagtcttacgattttagattagaaggttggcctcggtcatttcatctgtccctacctttttatagatgagaaaaattgccaagggtcacagggctggctcatttaagattagaacctggaccttctgattcttaatctcaggtgctttttgtttttagcagaaaacgttgtgaaggcttgtctttacaaaaaagttttccatcctttggtttctgtgcattataagcaatgacatgaacataaactcacatcactgggacttgggcattcaaacatgaaggtttgaggtatctttattccagctacgaatcctgctcagagccaaaatttgatggctgtaaccactgttctcccttttgtcacctttttaagaaggttagctctgaagcttgactataacgtcagtggtgctgactttctcacaaacatcctaaatctctcccagtctagtgtgctaaatttgctgacttcctcccttagtctttctgaattctggcatttttaagtgtatatattcttttcctcatatttacttaacagtgtgggctggaaaccactccgtgtccattcataatgatcttcctcagtctgtttttataccattggattgttttaaaacctttgtagtaagttgtggatttggttctatgttaggaattttttgtcgcacttgttttgccagaagctttaggatgccgtggcattctctttcatcacaagtcactgacgaggagctcttagcttcgcattggaacagggtctttgctgtgctgtttgccttttcccagctcccaggttgaatcagcagttagttttgccattcatggggctagatctcctacctcatggtgggccatgctgggctttgggagagagcctgggtaggacttgggacacttaaatccagaagaattctgagaatccttgtcatgaactcaagtaaatgatcgtggttgctcttccctgtcctccgcaggcccgccagctcatcctgcagtatggcttgaccctcagtgatctggatcgacacccagaggtaagattgccactcagaggcagaccactgcgtatttctttccgcttttttatggctgtcacttgttcatgggctccagatatcttgtaaaatctagggaagatgtcagttagttgtaccaagttttctcctgggaccttgagtattaattttggctgaggtcacaagtgccgaggtggttcctttccaccacattccttgtggtttaaccgcaagggctcagtgtgaatgtagtgaagggaagtgggcaagcccagggctatatccagggcttcctgaggtctttgtgcagaggtataagagtgagccagctcatggagcttgccactaagtggaaataaggaagaatcatctgaggcagccatggacatttgaaaatattaaaactaagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacatggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagttgcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaaccggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcgtaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaaaaaaaaaaaaaaaagaaaatattaaaactaagttttgtggtaaagactaacacaggggcagtccagaggagactgatgttggtgagggtgagcaacatcacaaaccctacctggcattttctgagccattattatgtaccagcttttgtgctaagtgctgtacctgtattaaactgttttatttccagtattcttgaagataggataccacaattttcccattttatagatgtgaaaaaggcacagagagggtaagtcatatggctaatgccacaggttttaagtggcagaatcagaatttgaactcaggcacatcttttctagactaatgctagtttgagttttttgggaagaggtaaagtttgaattgggctataaaggccaggtggcaggggcaggagagaacattccagagagtggtagacgggaaccacaggaacagctccatgtgggcaaatggacactgctcggactggctggggtgataggacagagtgagtgtactgcgttggtgcatagtggggagagggaaagcaaagctggataggaaaagtggggtggttttatggcacctggaaaaccaggcaggttgagacttgatggtgatctggtagcccatgtttctgtcatacacatgggcctcacaggggttagtaagaactatgggaaggacttggggatttctgtgggcagagccaggggcacaggctgatcatgtgttcagcagctgtgaagagagtggtttgggctgaaggtgggcctggagcccagacagaaaaggttgccactttccatacccctgagaattgccagagtgcagcctggctctggggttaatgcaggcctggggagagcagtgcctgctgtaacttcagacaaaggctggaatctgtaaaaggctggaagcaagcatgacccatatgaaactgtattttttatacctgtgccatgccagccatgccaagcaacttagtaactgcaccatgaatagaatttgtaccctgcatactacttgctgtctttaaaaatatactcggggttcctacaatgtccatgcagagtaccatgagtgatgagaaatgtgtaactttcttgattttgatttttaaaagctagatgaacccatttgcccctcaactgcttttggggcttgtggtggagcttcctaatagagggagcgggcaagcccagacaagtggggtcttagtggcaatgccccagtaatttccagttcgggaactcatcagctttcttgtgtatctcttcatttgatcctcatgtccacttaaaattgcctgtgaggttgctcacagttagtacagagacttctgaatcagttttttttttttgcatttttcccacccccagtggaatttagtagcacagatattactgtattggccctttggtgggacaaaactcattgtaatgtctaagattttttattcccccaccaaaaactaatttttgcctcttgggggaggtgatagcacccacactgagaacacgtgctctaaataacgccagcttgtccacagagaagcccatcaatgagaaaagggaacatagtcttgtgggtaagaactgcatcccggttagagtcccaagtcctgtgctgtttccctttgatcctagtggagcagcttaacctcttgtagctcaatttcttgatttgctaaatgggagtactagaattagctaacagggctgctgagtatctgatgagctatcgcatgctcaggcaattagcagaggctcccctcgagtggtttttgtatctttacctttcccccaatacagatcgaccttgccatcgatggtgctgatgaagtagatgctgatctcaatctcatcaagggtggcgggtgagtgttgtgggggcttctgtgctaaagagtatctgccagttaatccttagcaaagcaagatggatacagaataaacaaattgccactgtgacatatgcaagtttgtctttctcctaggatattgatagcatatggccttagacccaactcagcatttctggtcattagcagcaatttactgacaaggaacctgggcctctttagtgagatcattcatcgtaatggattctctgtggatttgtgttcttttgttgattcagactttaaaaacttaaggccaaatcaaaataatactgggctagattgttaggtctgtgggcaccagtgtgtgacttttgctttaaagctgtgcttacttctgtgagcagttagggatattatttgttcctttggaaaacattaattgggtatttcttaagtgctgatttggggagtggtgggaatggtgagttgaaaaaggtgaaatcctgttctgctggttcttataatcaagcagactattgagtgatgcagcatttgtttaaaatcacactttactgtttattagattttcttacgtgttacttaatcctgtcaactgcagatgtgagatagtttagctgctaaaccctagaggtagacctggacccaaatctgctgattcagtgctctgggctctctccacttcatcaccctcattggcaagtagtcgactgggcgggttgttcaaagcgtgccctcctcagcttctagaccctcccattcatgccatgtccagatgacatctccctgaacacaatgctccctctcagacacatttggatggaattatgcctggcctgaatgggaaccttgtctgctttctaggtttctcccagacaggggtaatgtttctagagtccatttactaggagcagcatgatgggactggggatgtccctttaaaaattaaaagttaagtttctctttaagtgccaggattgagtggatttgggattcctgtatttaaccttagttcccaaactgagatttttgtcttactcctgtgttcctttgcttctttcctgcagaggctgcctgacccaggagaagattgtggctggctatgctagtcgcttcatcgtgatcgctgatttcaggtacagtttctggtgtctgagctgccaactgaggaggtagattggatccccaagccgcatccccatttttgtgaaagaggaaatggagagctgcagggactgtctgactttctgagactgatggctaggacttagtacagtgtctaggagaccttatgttctgcttgtaggctgaaggtagatgttgctaatcacagcactgttatccgcagccaggatctctagcatcgtttcatgtgttcagtggaacggggaaacagcttgtcaccctgttagcagagcatgctctcatgtgtcatgtcactcactggatcctcacagggagcctcagaggaggcagggtgtgccctgcccacgggcagtgactcagcataccctgcttcttctcgggtcagggtttgccgcaggtgactggtgtcattgatagtctttgaccaggctctcagatgctccttcaaggaatgtagtcaaaagcacttgtgctgagcatgttaatttcaaatatgtgtatgtgtatatttacttgtgaaatatagccacaggacgagcataaatattaaacacctacatacccacaagccagcaatatcagattttaacatttttgtcatatttatttcaaatagctcttttcctatatagtgaaacagctaattcatttgtagccccatgtatattgcccttgatcactttccttgccttcccaccatctcattaaccctgttcctgaatttggtgtttgcctgtactgttgagcttatttacttttattgtactttctgactccttctttccaggaaagattcgaagaatctcggggatcagtggcacaagggaatccccatcgaggtcatcccaatggcctatgtcccagtgagccgagctgtgagccagaagtttgggggcgtggttgaacttcgaatggctgtcaacaaggctgtgagtggcctggttgggccgggggtgtgctgggtgcactcaggttttcagtgtggtgtcctcccttctgttgcagttaggtcatgtgtgcttccaccaggcaattggcttttatttatttttaattgatgtatttgtttattttcggagaattggcctgttagtttctgcattcaaactcgtgtagacaagaccacacttaatacagtgcatctcctttgtacagataggggaatgattctttctctgtgcctcaggttctgacatcccacaggtgatctgacctttgtgcctgaggcctggaacaccctgattggcagctgtgaaaccctggctttgggaactgcttggaacagaaagttttttaggttccatggtgtaacttcttttctccctcttctttcctctcattctgtggttaaatgtgacaagaagtagaatttcttggggtgtgtgaactcttcccaaggaatactctccagatggtccaaatttttcgtgtttctctttagcttctaaagtggattgcgcataacttttccctctttttatacttaagtaaacaaataagcaaagacagcaatccagaagctaaccacagttacatatgtaactacgtaaacattttggaggatatcgaaaagatctgtcaccctaccctgatacatttttattttgatatattttgtccccactgtttctgtgacttttaaaaaaaaaccgtagttctgttcctagtggttgtacagtgctctgactgacgttcagattgtcggcacatgaaagaaatgtagcacaaaatggagaagtcgttcaaccttgaccctgtcagagttcttatttgaaagccacattgctgctagtgttcttattgtgttttggattctgtttcttgccctttttcttattagccaagtagtaacttaaggaagcagataagaacaatgaattttggactaaaggaagtaagaacaatgaaccagaaatcagataggaatgtggtgataattgtgacatggtcacatagtcatagtgggagctcatgtgagtaaaaatagcttgatacatttgttaagaggcttgtatcctctctctctctctcaaaaaaaaaaaaagactacaatctaagtctttctgatttcaaagctcctgcttattaccacttcacagcacacctagaaagcataaggtgggagcaggttaaaatgcatacttgtctttggttatcccctctactttcctgtccttctctgcctacctgtatctgcatccttggtcactgtggaaaattatcttctagggtcctgtggtgacagataatgggaattttatcttggactggaagtttgaccgggtacacaaatggagtgaagtgaatacagctatcaaaatgatcccaggtaacatgagtggtgttcaccagtcatatacacacccatggccttcataactggcccctacatctggccacagaaggcacaatggacatgggctttgtaaggcttggttggaaagaagaattccctttataccatgtttgggtttttaacttcacctcctttgccgtattcccttcccccaacaattgttgcttacctagcagctttgttgcttgtgcatttcacagcctgtttgagttaagatagtcctgaagctgatggaagttcagaggggacttgccttgaaataaggccatcgtctctgggtagaacctttccttccaggagctggactacagcctttttttgtgggttctcttcttaagtagcggggaaaatgactcagttaatccacattcattggatgcatgccaaaggcaagatgttgtgctgtgtgttacaggggatacttcgatctggaggacttgtaatctgtcctcaaggagaattgatgtaaacctggggaaatctgtgtgtgtgtgtagaagccatgcctacaaataagatagaatgtgctcaattctactagaggaataccaagagtctagagtgcacaaaaagtttctttttgggagaatgtgaggatgttctatggtgtagaggtggtttttcatccatgccttggcataacataagttaaacacggtgctaaacgtctaaaaatatttcctttgattcccactttgatgaggtagttacagaggagggcactggctgagaaaggttaagccatttgcccaaagacagcaccaagatgggcaccctaagttgtctgccactagaccctgaatgtttaatgcttacttgctgaagcaccaggcgaggagaggctgtgtgaaatgaacatttagagccttggggagcttctaatgcagctgtgccagggaatgatggaataagagccaggatggccctgcgtgaaggatgggtgggcagtgtagagatgagttatgaggctggagtcctggttgaggctggagtcctggtccaggctagaggaggtatcaagggctcgtacagggggattaaaaggaggaggcagtcttgagaggtatcagcttcttaggatattgcgagactaagaggctaacggaatattccctatcatggagtattcttgggccagaactggctgacaggacctttcaggccagtttaatggagcagactattctggataaggatcctaacccagctgtgctctggcgtgttaccttttagcagttagttaacatctctgtgcccgagtttcttcctatgtagaaggggctagttaattctagtgcctaccttataaggttgttgggtggattaaatgagttaaaaccgtgcccattgcagaagggaaagtgtttgttgaatgaataaatcccttgaaagaaaggtactattgttatttttaattaaatatactaagattctaagatacacctgtgctagttgggatttaaaatagtgtgaatataagctgtgtaatgaaaagctagttcttccagttctactttatttattaattttttgagatagggtctcgctctgtcacccagagtggagtgtagtggtgtgatcatggtttactgcagcattgacctcctgggcttaaacagttctcccatttcagcgtccccagtagatgggactgcagacacacaccaccaggaccggctaagttttgaattttttatagaaacggggtttcacgatgttgtccaggctggtcttgaactgggctcaaagtctcccttggcctcccaaagtgccaggatcacaggtgtgaaccgctgtgcctggccccaattctactttagtttgttattttagtttagtttgttattgatagtcttttaccacgttaagtcaaaaacatgagttggcttatactcattttcttggttagtgttccctctttagtggaagaactaaacagccaagaaggtaggaggaagagaagatttgcaaatcactgttagtaaaatgggagaacttgcccttggtgataatgcaaacaaacccagggccccaggaggaaagggctcaccaatgtggctgccgtataggtggagttcttgcagtgcccactaggtgtcactcttgctcctggttagaccttggctgcttaaggttctgaaatgtcctttgtaaggaaatttccctcatatgtgattcttcaaaaaaaagtatgtagaagctgcgtcctaaagacgttcagagttttgttaggaacttaaagtgaggaaaatgataaaagaggctagctattaaatcatataatgtgatatctacaggacaatcagagtggtttgctgtatcttttctcattttttcttttcctgattgagtccattagattcacggctggaccagtatcaggagaatagaagtagggcgagtttccctgtttatctctgttaccatgtgcattcgtacacagtatgtgaggacgcttagaaaacaactccctttgatgttttgttgtgttccacccagagcagagtgactgaattgaagggccagggctactggagttctttcccctaggttcacatttagcatcctctgctctttccactatattttatcggggagttgggggaggtcagtcacacccagcatctcagtaattgaaagagaagttgctctaaagtcttaccttagactgctgcccattcatctctgctctttctttaaagccttttctgaacctgatttaactgttttttggatcagtggatgctttctccttatattgcagacattttgaaaacgggtcttgagtggctactttgctcatctttggaaggatccagttgcataggcacagtttggtgccagggacctttatttgtgttcagcaactctttgctctgcctgttggcttttcgtcactcgatcactactccgtttcatttgtttattgggagctgtctttgggagtttttttttaatttttaaaattatttcaatagttgttgggaaacaggtgatgtttggctacatggataagttcttgagtggtgatttctgagattttgttgcacccattacccaagcagcgtacactgtacccaatgcatagtcttttctcccttgtcccactctcaccctttcccctgagtccccagagtctgttgtatcattcttacacctttgcgtcctcatagcttagctcccagttataagtgagaacatacgatgtttgggtttccatctctgagttacttcacttagaattatggtctccaactccatccaggttgctgtgaatgccattatttcattcctttttatggctgagtagtattccatggtgtgtgtgtgtatgtgtatatatatcacattttctttatccactcattggttgataggcatttaggctggttccatattgttgaaattgcaagttgttttgctatcaacatgtgtgtacaaatgtccttttcatataatgacttcttttcctctgggtagatacccagtagtggttttgctggatcaaataaatggtagttctacttttgagttttttaaggaatcttcacactgttttccacagtggttgtactagtttacattcccaccagcagtgtgaaagtattcccttttcactgcatccatgccaacatctattatttttttattcttgcgggagtaaggtggtattgcattgtggttttgatttgcatttccctgatcattagtgatgttgagcattttttcatatgtttgttggccatttgtatatcttcttttgagaattgtctattcatgtccttggcccactttttgatgggattttttttcttgctaatttgagttccttatatattctagatattagtcctttttcagttgtatagattgtggagattttctcccactctgtgggttgactgtttactctgctgactgttccttttgttgtgcagaagctctctattttaattaagttccacctacttatctttgtttttgttccatttgcttttgggttcttcgtcatgaaatctttgcctaagccagtgtctagaagggatttttcagtgttgtcctctagagtttttatagtttcaagtcttcaatttaagtctttgatccatcttgatttgattttttgtataagagatgagaatccagtttcattcttctatatgtggcttgtcagttatcccagcaccatttgttgaatagggtgtcctttcccccttgatatttttgtttgctttgttgaagatcagttggctgtaagtatttggctttatttctggcttctctattctattccattggtctatatgcctgtttttataccagtaccatgctgtttggtgaccatgaccttatagtgtagtttgaagtcaggtaatgtactgctgccagatttgttctttttgcttagtcttgctttggctatgtgggctctttgcttttccatatgaattttaggattttttttctagttctgtgaagaatgatggcggtatttcgatgggaatggcattgcatttgtagaatgcgtttggcagtatatggtcattttcacaatactgattctacccatccatgagcatgggatgtgtcccatttgtgttgtctgtggtttttttcagcagtattttgtagttttccttgtagagatctttcacctccttggttgggtatactcctaagtattttattttttttgcagttgtcataaaaggggttgagttcttgatttgattctctacatggttgctgttggtgtatagcagtgccactgatttgtgcacattgatttttgtatcctgaaactttacggaattcatttatcagatctaagagctttttggatgagtcctgagggttttctaggtatatgatcatattattagtgaacagcaaccgtttgacttcctctttactgatttggatgccctttgtcttgtctgattgctctggctagggcttcaatagtatgttggatactgggtatgtgaaacggggtatccttgtcttgttccagttctcagggggaatgctttcaacttttcccctttcagtataatactggctgtaggtttgtcataggtggcttttattacctttaggtatgtcccttctatgttgattttgctgagggttttaataataaagcaatgctggattttgatagatgctttttctgcatctattgagatgatcgtatgatttttgttttagattgtttatgtggtgtgtcacatttgttgacttgcatatgttaaaccatccctgcatccctggtatgaaacgcactcgatcatggtgtattatctttttgatatgctgttggatttggctagctagtattttgttgagtatttttgcatttatgttcatcagggatattggtctgtagttttctttttttgttatgatctttcctggttttggtattagggtaatactggcttcatagaatgatttagagaggattccctttttttcccatcttttggaatagtttcagtaggattgctaccaattctttgaatgtctgatagaattcagctgtgaatccatttggttctggactttttttgttggcagtttttttaattactgtttcagtgtcgctgcttgttattgatttgttcatagtttctgtttcttcctgctttaatctaagaggcttgtatatttccagattttctagttcatgcacatacaggtgttcatagtagccttgaatgatcttttgtatttctgtggtattggttgcagtatctcccatttcatttgtaattgagcttatttggatcttctctcttcttttcttggttaatctcactaatggtctatcgattttatcttttcaaagaaccaggtttttgtttcatttatcttttttgtattttttgtttcaatttcatttagttctgctcttatcttagttatttcttttcttctgttgggtttgagtgtggtttgttcttgtttctctagttccttgaagtgtaacctcagattatctgtactctttcagagtttttggtttaggcatttaaggctatgagctttcctcttagcactgcttttgctgtatcccagaggttttgataggttgtatcactattattattcagttcaaataatttttaaatttccatcttgatttcattgttgacccagagatcattcaggagcagattatttaatttccatgtatttgtatagttttgagggttccttttggagttgatttccaattttattccactgtgatctgtgagagtacttgatataatttagattttttaaaatttattgagacttgttttgtagcctgtcatgttggagaatgttccaggctgaagaaaagaatatatattctgtacttcttaggcggaaagttctatagatatctgttaagtccatttgctccagagtatagtttaatttcattgtttctttgttgactttctgtcttgatgacctgtctagtgctgtcagtggagtacttaagtctcccactattattgtattgccatctatctcatttcttaggtctagtagtaacagttttataaatttgcgagctttagtattaggtgcatatatatttagaattgtgatattttcctgttggactaatccttgtatcattatataatgttcctctttgtcttttctaacttgttgctttaaagtctattttgtctcatagaagaatagctactcctgcttgcttttggtttctgtttgtgtggagtatcttttcccacccctttacagtaagtttatgtgaatccttatgtgttaggtgagtctcttgaagacaacagatacatggttggtggatttttatgcattctgccattgtgtatctttttatttttttgagacagagtttcactcttgttgcccaggctggagtgcaatggcatgttcttggctcactgcaaccttcacctctcaggttcaggcaattctcctgcctcaccctcctgagtagctgggattacaggtgcccgccaccatgactggctaatttttttgtggttttagtagagacggggtttcaccatattggccaggctggtctcaaactcctgacctcaggtgatctgcctgccttggccgcccaccaagcctggcccattgtgtaccttttaagtagagcatttaggcagtttacattcagcgttaatattgagatatgaggtattattttattcatcatggtagttgtctcctggataccttgtttttttgcactgtgatattgtttcataggtcctgtgaaatttatgctttaaggaggttctatttaggtgtattgtgagttttgtatcaagatttagaactcattttagcatttcttgtaggactggcttggtagtggcgaattctctcagcatttgtttgtctgaaaatgactgtatctcttccttatttatgaagcttagttttgctggatacaaaattcttggctgataattaatttgtttaaggaggctaaagataagaccccaatcccttctggcttgtagggcttctgctgagaaatctgctgttaatttgataggctttcttttataggttacctaatgcttttgcctggcagctttcaagattctttcctttgtcttactttagatgacctgatgactatatgcctaggtggtgatctttttgcaatgaatttcctgagtgttcttcaagcatttttatttggatgtctagatttccagcaataccaggaaagttttcctcaattattccctcaagtaagctttccaaactttttgatttctctcctctccttcctcaggaacatcagttattcttatgtttgattgtttaacataatcccaaatttcttggaggctttgttcatttttttgattctttttttctttgtctttcttggattaggttaatttgaaagccttgtcttcgagctctgaagttctttttttctactcgttctaatctgttgttgaaatttcccagtgtattttgcatttctaaaatgtgtctttcatttccagaagtttgattatcttttctttatgatatctgtttctctggagtccttttaaattttctttaagttggttttcacctttctctggtacctccttgagtagcttaataatcaaccttctgaattctttatctggcaattcagagatttcttcttggtttggctccgttactggagagctagtgtgatctttgggaggtgctgtagaacctcgttttgtcgtattaccagaatttgttttctagttccttctcatttgagtagactgtttcattggaaagatctggaacccaagggctgctgttcagattcttttgtccaatggggtgatcccttgatggggtgttcttcgccttcccctaaggatgaggattcttgagagctggactgcagtggttatgcccttctggggttagccacccagtgcggctactgggctccaggctggtattggggaatgtctgcagaaagtcctgtgatgtgatctgtctttaggtccccgagctgtggataccagcacctgcttcggtggaggtggcaggagagtgaagtggactctgtgggagtccctggttgtatttttgtttagtgcactggttttcttgaatgctggtttatgctagcagtgaagttgccatgtggacagactcaggatctctggttagccaggatgttgcaggcggtggaattagctgttgtttttccctttttggagcagggttgttctgttacgagtttctgtagtggcttgagttggttggccttcagcgaggaggtggtgctttcaagaaagcatcagctgtagtagtataggggggatacaagcttgtctatgtaggccaggataagtattttggtttcttaggtaatgggcagggccatagagctcccaagagtttatgtcttttgtctttggctaccagggcaggtagagaaaaaccatcaggttagggcagagttaggtgggtctgagtcagactttccttgggcagggcttgctgtggccactgtgtggggttggggagtggttctcaggtcaatggagttatgttcccagggggattatggctgcctcttctgcgtcatacaggctgccagggaagtaggagaaagccggcagtgacagacccccacccagctgccacacagccagcaaggccagtttcactcccgccatgccccaccatggtgagcagggctgagatcttgccccagactacaggcctccctactgagaaagcaagcaggcctctcaggcctcgcccctccctgcctgcctgcaccttcggctgtgggttcttcatttgtatctgcacttcccatttgtcccccaccggattctgctcaggaaaatttgtgctcagttgaaattattacgaagttcagctagaagcttccttcatcctgtggcccctccccagttctgctggctgcctttttttcccgaaggacccctgtgagataaagccagggatggcttccctgggctcaagctggggactggaagtgtctacagggctcttcctgctgctgcttctacttttatagtttgctcagctctctaaatccatttcagctctaggtaagattaaatccgtctcctgtgatctggatttttcaggttccccggtggggatgtatgttcagaggcagacttttccccctctcacactttgggaactcacagttttttggctgtcttatggagtttgcagcagcaagccacttctttcaaagggtctgtgaattcttttggttttcctggtatgttcctgtggtggttcttggagcaaaagttcacaatgtgtgtctccacacactgttctgtctgtccaagtgggtgctgcacattaatcctgtcttctattgccattttcctgcaagttttcattgtatttatccttttgaatttgtgtagtttaaaattatgagttaaacagtggcaagtcctctttgccacttttccaaccaactagttaccctatctggaggcagccagtgttaccaaaattgtgtggcctttgagatagactttcataaacacacaaattgcaactcctcccgccccacccctttttacactagcggtagcctgctttatacatgttctgtttcctgccttgcctgtcttggagattattacacattggcttataaaagagcttccttgttccttttttttctgaatacctgcatgtattccactttacctatgtaacattatgacttaactggatcaccactagtggtcatttatgtttgcagatttttgctagcagggaatcactggatgaaaggattaatgtgtctgtgatttttgttagatggtttcagattgccgtctgtagcttgtattcacttagccttctaccaacagtgtgtgcaggtatctgtttccctgcatacctggtccattataccttttctcttacagttaaagtgttatgtcattgaagtatgtgtgagtatatgtaaatattcttggtaaaggttgtgtgtagttgttaattttcactgctgaatcatattccatcatctgtatgtgtgtgaaaaaaagtttatatctattctactcttttagttttttctctttctttctttttttggagacaggatcttgctctgtcacccaggctgtagtacagtggcataatcatggctcactgcaacctctgctcctgggctcaggcgattctcccacctcagcctcctgagtagctgggactgcaggcatgtgccagcatgcttggctaatttttgtattttttgtagagctgccatctctatgttatgtttcccaggctggtctcgaactcctgggctccatcagctccatctggagctccattgaactcctgggcttcattcccaaagtgctgggattataggcatgagccaccatacccagcctctattctactcttgatggacatttgggtattatcagtttttagctaataggaaaagtgccactatcaacatcttacacatgtcttttgatgaccaaatgtatgcctaacagttgtatatctaggagtagaattgctgagtggttaggtgtgaatccatcagcttggaagatgaacatttccaaagtgcttttgccagctcagctttcaccatcaatgcgtatgagtgtctttgcatcccagcagaatttcattacactgacttcagtgtgtgtgtagtgatatcttgtaatattaatttgtatttcctttcagtgaatgattttgagcatcttttaaaatgtttattggccattttgggtagcttcttttgtgaggtacttcttcaagtcttttgcccatttttctatggggattctgtctttttcttgatgatttataaattgtttatatttttgatatgagtcctttgtcaggtatatgctttgcaaatatctcctcccattccgaggaaatctttcaaggctggtggtatgattgaaaataactggtagtggggctccttggctggagtagtcatggagggtctctagaggatgacttgccatctgatatgtctgaaggacagagctgagccagccccttgaagtgcttgacaatgactggctcaggcagagggaacagcatgaacaaaggcctcagggcaggacaaagcttagcatgtttgggtacagaaagaaggccaaagtgggaggggagaaagaggtggcaagaagaaattaagataatcagaatctcttttcattgctctgtgggagaaaaaggctttagatttgtcattcgtccaatgctgtgtatgacagttgcttctagtgaccctgcagtctttgagtctctttttgctttgggaggctgaaacaatgtttctttctgtcctttgtcctgcaggtgtggtggacacaggcctattcatcaacatggctgagagagtctactttgggatgcaggatggctcagtgaacatgagggagaagcctttctgttgaccctgcaaggagcagagtgtgttcaccttgagtctccagcccacagccaaggtggacgtacctctccaggagcctttgccttaatgtatctctgcctggacaacttgtggtggggggtggggggaagagtgggagggggagttaaatccagtcttatgaagtattgttattaaatgtctttttaaaaagagaaatataaacatatatttttactattaaaatattcagttttttaaatgaagtagaacttgagttcatgttttatatgaaatatttaccaaaaaaaaaaaatgaggtaaactgtatttaaaacctttgacttgagtctgctggtaaagcttctgaatattgagtttgctgagaaataaaaatcaaaacttctttaagctggtaaagtgaggggcccaccagcagtgatctcctgatgccttactggaaactttgtttacttgtctgctaccctctgatttgtttttagttagtttttattgtgagcacacatagtacctagttacatcttaagatcaggtttataaaactgtggagtggagcggtatggtatggaatgacttggaatgtaagctgtcagggagaaaatgttgttacacttttgctaagatctgggggtttcttcatattcctgctgttggaagcagttgaccagaaatgcttgccagtactgccaaagcactgctgtgaaatgtgaagtactttgtttttttatttttaatgattttctttttgttattaatatttttctctgttcctttgttattacttgcatggtttggcgtcagaagtccttacctctttatattgtttgcaggtttaaataaaacagtgtggtgccattttg

SEQ ID NO: 37826 - DNA, 12549 bp, Homo sapiens
tgcaagtctgcagccagcagagctcacagttgttgcaaagtgctcagcactaagggagccagcgcacagcacagccaggaaggcgagcgagcccagccagcccagccagcccagccagcccggaggtaaggaaacggtgctcgggcagcagctctgctcggaaagaaggcacggcttctgctcttaagccaagtggtcttttcaaaggccttctttaaaatcgctcagatgggtgcttttgagtctgcgggtctggtttctgaaaacccaggctgcacgcagctgcattgcaaagtgcttttgctaattcggagggcttcacctttctcttcagaaagcaaagggcagttttcttaagtcacttgcagaaggaaatttccatgtgtatttaggaatctggtgtttatttgctgtgtggctatttaagctccagtaagcaggggaactttgcaagaacacagactatccattctgcctgaccaatttggcatggggattagcttggcacccactgtttacctgttttgcttctagtatatcagtttggaaacagataaaattggcagtaaatacgtaattccagaatgatgaacactttattaagaggcatccttaaatggagcagaaaactgctgagaatctttgtgagtccaagatgtatttgaattcagtactttgggggatttaccagagtctgtaagtccggaagctataaacgtgaatgttaaacacagcccggtcttctcttctcttgatggcacgcttgctaatctaatttgagtattgttctcttagaaggtgttaagtccaacttcaattggggttgggggaagcacacacacaaatctactattttgcaatttaaatatactcttcaggtaaaatgtggattttgttcaattttgttggcatgtgcaaagattcaaggagtgactgagagaactttggagtgaggtcagggatgggtggttagccaagacttgtaacttccagggagaatgagaagttgtaaaagtcagactggctgtctctctttctctcttcctctttctttctttctttctttccttttgctcacaacaggattacttagtgtttcaaaagtgggagagagcctccttaaatggtttacagccctttgaatgtatttggtgcagtgacatcccctgaaacttcagtctgcaaagtctcaacatggtaactttgttcttttcttttttaaaggcagatgctgcttttagtgtccctttatttattccaggaaaaatgtggacatcagctaggcacgcctagcaaagaaagtggaggctgctggtttctgtgctttaactttccatagattttaaatggataaactgcttgcccttctttcatcagaatatgagctttccccagatggaaagtcttttctaaagcaaagttgcacatgggagctctagcttggaaacaatttgctcttttttccccagtctctgccataaacacttgaatgtgcacacaactgcagagcttaatgccacaacctccaggagattggggggaggggaaagctgcccaggatgggggtgggaaagcgaaggaagatggagaaatggctgcagtttgctgcccatcagcttttctcttttaaggggcagacattgcagacgtagttttaaaaaagttccataaagcatcgccaaggcagcatgcctgtgcgacacacgcagggctttgggggtgtgttttccccgtattaacagcaagtcgttgaagcgttgagaaggtattatgatttctaatcaggcccagaacaggccaagtataggctttctgaatgaaaaaaaaaaaaaaaaaaaaaaaacccaaaacaaaaaaccctgcttaatcaggaacagtggctttttgtgtgatcattttagggcgagagctcctgttttcaagtcgacgtgagggaaattggttgaagtcactcaaacctgaggctgaagggcagtcactttataaaccttaagagtaaccgaggggaaagaaaaagacctcaaagattgcaaaactttagattttttttttgtgattttgtagaacatgaggggaatctggggccagaaggcatttgtacctttaaaccaggcaatcaaataacttagttttattattagaagcaagaatagtattaaaacgccttcaattggattgcacgtgtgtaggcataattcaggaagaaactaaagatcgtgtcatgtcaagtgttactaaagttcaggaaggaaaagacaaagctccaggacacgtattttctgttgaaataaaagaaagcaagccagaaatagacagatcaggacagggaggcgtgcaggcggtggccctgattttgaatatttgatggtttccttcagggaatgtttgatgcttttatcgactaatttggaattgaaaaaaacaaaacaaaacactattgcttcaatattaaagtgatcagggaattgcataattttatggtgacaattttaaagagccacaggtagttttggaagcagactgtgttttgttccaggcactgaaaaagtggatgggggccgagactatctcaggtggccttgaaccactgttggcaaagggacagataacgagcccagggcagtgtgggggactttgcgttttgaagtctgggtcagccagatagtaagcatcttttgcttttcctgctataacagatatgtggccatcctccctcagttgtatatgcagagcctaagtttgcacagtgtcctcctgggaaccccattgtgtctggcttagggcgggggtgaggaggctctcctagcctggctgacctcccactgcctcgtcctagtcctaagctgggtgggaatcagggctctggttacactgggccggcccagacggcagcctttgtgacgtgggaatctctggacctgctcttgtgggtatagctttgcttccctgtcgggcagctgagcacaatagaccagatcaggtttctggacgtgggatttatttgatcccccaaatccttaaagtggacgagggtgtcccacgtgttcatgtgaagtatgtctaaggaccctgggaagaggtggactgtatctgaatcaggatatagagttttctgtagttattattttttgcgttctcaagtaattcaaagcagttatgtacttgcataaaataagatcactcacggtcactagtgaatgtgtagtcaagactgttttccatttgctggcagcagaggggacagacagctacccattctgctatcagccctagcagatagtcacagagagtctgcctgggccaaagctcccctaggttacttggttggtttccccatagattcgatgtagcattggttaaaaacacacagacacacagacacacacacatgcacacacacacacaccccactcaatgatgcgcagttgcctaatggttcttcagaggtagtgtggattctcctgatctaacttgcaggctcagcgtaagcggggctggcctggtggaagaggtgttatctgctcaaggagaccagagcgtttgcttttgtagcatgattcccgctggagagtccctggagatgttggaaaggggaagagaactctgttcttagccacaagcgcaccataacccagtctcttcacccggcctggcctcagtttccaggtgtgcaaacagtgagggccactgtcccagctcttgtctgggacaataccaagtttcttcatgaaattcccttgtaggacacaggtctcacactgcagaaagccagtgaaggaggcagaagtcctgcagggcccagatggccagagggtcccccttttcggagctggtcccggggccccaggcctggcctgagttatcttatctataccactgtagaggagtgatgtgtgtgtagcagcctggtctgcacccagctaccagaccaccccactgcaaagctgcctgtggggttcgtatcacttccattctcaaagcctcctctgctccaaagccatggccttgctctagactgtcctggctcctgcatggacaagccctggtcatattccttgcccaccctttaaggcccaactcttacctccatttgctcttcgtggagagtccttgcctcagccaggctgggtgactctacccatggctgtgccttcctggaacatccttgatcacccctacctccttgaagtcccccataagccaccagagtagaaacccctcattttcctgctgaaggggcatgcaccaccttgctcatgcctggggggtgatgggcctgcgtgccttcccaattagccggcggggtctcgggggttggggggagatgtttctgatttgttgtcctcacgtgccccagagcagtgcctcctggaacaagaggctcagtccgtcaacaccagctcggtgacgatttcagaaaagtctctcctggacgcccgtctccgctgctggccacagtcgctggtcttggtggggcacgattaactgctggctcattgagtacctactatgtgcagctgtagctgtatagctgtatagctgtagctacacaaagttacagaagacttggtggggggtgcggggcctggtaggaatgaggtggaggggcaagaaacctgaacaacgtgatggtacaaaagccattccagaatagagatgtgcagtgtggggccaggagaaggtgggagaatcagaagggcagagggcatcagttgggaagagtctgtggttggagactgcaaacatgtggaagggagtttggagggacactggccaggtgcctgaacacgtggcattctctggaaggaactaaccagcgtgaggacatgctgattgcatactcagccaccacccatgaaggctctaaacctgagtacctgtaattccggcttcaccctcagcttgcagagtgagctcagggagaccatttggatgtggctaaataccccaggctgcttgctgcagcacggtcgttgtcaaggatacttggttgatgaataaaacatcccagaaacgagaggtgcatctccgagaaagtcctgcaattgacaagaggagccccagtaccatctgggctgtgagtgacagaggagtccctttgcaggccataggctggcagggatggagggctggacaggtgcttgcccaccgccggccacgggaaagttctctccctgtcactgcaacgtgcgacagggccgctaaaaaggtgacccctgtacgaaggaatgaatgagataaaacagagcaagcgctgggaaaaagggaatgaaagctgacgttcactgctttttgttctcccttgggtctctgtggtccaggaaaatgcaacatgaacctcgattgttctgtggaccattcctccctctatgaaaatttacataattcttgatgtcaaatttcaaataacacagaagtttatagagtaaaaactacaagtctccttttgttccctcctcctaccttcccagccccaagttttatacttactgcaggtctttttctatgccttcgtgcacatgtatttacatataaaaatacacaaatgtaatttttgtgtttctttctgcatagctggggttgtgctgtgtgtgcgtgtgtctggggttgtgctgtgtgtgtgtgtgtgtctggggttgtgctgtgtgtgcgtgtgtctggggttgtgctgtgtgtgcgtgtgtctggggttgtgctgtgtgtgtgtgtgtctggggttgtgctgtgtgtgcgtgtgtctggggttgtgctgtgtgtgtgtgtgtgtctggggttgtgctgtgtgtgcgtgtgtctggggttgtgctctgtgtgtgtgtgtgtctggggttgtgctgtgtgtgcgtgtctggggttgtgctgtgtgtgcgtttctggggttgtgctgtgtgtgcgtgtgtctgcgtattgtctttcactgaacagcatgtcgtaactctccctgtgcatgaagggaggcctccctctcacagctgtattatattccagatggcggagacaccaggctttactgagtcgtgcctttgttgaaagacatttacgttgtctccagtgtttgctcgtaaataaatactgctttaaaaaacatcttgtgtacatttggagacacatgaatattttgaggagagaaacgtatgaatttgtatcatcatagaactggaaagaaacgtcttttgttctgcaccccctccccttccttccccctggaatcttttatgcagaaaccttagaacctaagtgtcagaagtgggtctcattcccctgcctgccctggcatgggcactgaggccctagagacgcaggcagtgggcaggtttgattcacacccagacatgtttcttagaccctggcctcaagcgggaatggaattgctggttgattccagcagagggtgactggtctaagtggatgtctccttcaggccctgtggctatcggccttcccaacttcccagcgtaaacagaccccgcacaggctgagaggcattaagaatgtatacaaggacccgagggctggcccatccagatctgtgcggaatgcagtcagctctttctgtatgggatgaggtaatcccctgcttttgcttgaggggacctgtgatttctgtgcagggcccgctgggggttcattagaggcctccctccctctctccactttcagattttgcagggagctttgtcaccaggcttttgagaaccaggggccctgggtacacatttcatagtttgctctatgaagcttttgttcctatcagggattctgagagtgtcacttattaagatctaagcaggtaatttaggaagattctttgctccaatagtggacgcacaaccatcagtgaatggtggtcaatgaaagtgggccctgcccaccctaaacgtcctgcacgcaggctggggcggccagagcctttgtcgcaggccaccttccatgttacacggcagttccctattttgaataaggggattgtctttgtcaaataataatctgtttgctggagacagctcttgtttctgaaacctaatgcatgaaaaataccgaaatgacaaaagggtaagctatagtatgacatttttgtttttctgttttttgttttctttagctcccatttgaatttgcagaggacttgatgactgcactgtctgcttaatctcccttttcactgtactttccttcctatctgacccctggaacctttggtggtgggaagggagaggcccgtccaggccccgagaggaaagcaggtggtcagggtgtgggcctctggctttgtttcctggccagccccagtgtgggctgctgttccttgggctgactggtggttaatgattgaggatcggtgatcggtgagtgatgataggtggccggtgatcggtggggcagtgaggagctccagcctccgctctctcattcagcccttgggcagcaacagccatgcccttgttggaagtttcccactgtgccacccgggaggggagaagcaaggacagaggcgaggacggctgagcggggaagtgcctatctcagaaatactgtttttgactcagaggaccaatggtccctaaatcaaattttcgtcacccaaagaggcaaaggtagaaagccaagggctggatgggggtccctgagcccttttccacctctcagtcccactctgggctctgagaatactgaaggctgctggtagctcaaagcgggtgagtgtctattttgtgctaagagtggaggaactggaaggaaggacacactcgagatgtgggaaccaggcgtcttctcactgagtgaccctgcctcctgctggggcctgtccatgctgagcagtggccaggcgcctggccagccggcatctgacatgtctctacactggagggcaagtaagacctgagccagaggaatgtcaccatggtgggggagagaggtggggcggattcgggatccaagttcgggcgaacaaagactgagggtcatttctttctagcccctgtgaatggcccaaaccccaggatttatggcagcttctgctgtgtggctgtgccagtggggacagagcagggagcccaagccaggcgccagccgagctccctctggacccagctgctgtccctgctgctgcccagctgtggggcggtcctccattcaagctcctctgctccccgggactctggggtcagatgagatcatgggggaaagtgttttggaaaccaagccatgatgcaaatgtgtttcgttttaaggaaatgggagaaaggaacaaggattgttgcagtagagccatgtggggagagcaaaggtgaaatccttgtctcctggcatcacggggtggagagtggaacgtcagctctgggtcatttggtggccaaggaaagatggcgatagtagcttcaaggcacggcctggggttgcccgtccaccctggaggcagtctggcaggacagggtgtcctcagctccctgctgggcctacgtccttttggagttctagagctgcgtcttaggacaagtgtgccaagcctcctgctttgagtttctgtcctgaccttgacctggctcacctccatgggcagcctcccatgcttgggcatcagggcttgtcataagtccgtggtcacagggcttgattcctcctagtgggtgactctgaggacggccaggcctcccgctgcaggaccagcgtggttccctccatggaaggctttcagagtgtggaggggatgcggctgtcttgggaggcccagccctttctgtcagccgtggaggacactgagtcaggttaggtcacgaggaggggaccccacagtcatttacatcccgcagagggaagtgcccagaagcccgcaacagtctccgctaagtggggttcacgccaggtcctctgctgtgaatgtggaggctgtggagccgaggccgcgaaatttctcacttttcagggattctgttcaagttgtcccaaaggagaagcccatcaaacaacccagtctctgtgcgagctcccccgggggcatttactactcagccagtgagagccaggtttccaggggaatagaattaaacaaggttctgctttttgctgaagggaaaaaccgctcccttaggtgggagaatccccagggttctttcttcctggccagggagggagaagggggtgacgttttattgagcatcggctagggccaagctctcaattaggccctttcttctttcttcttagggtatctgtgagataggtgctgctgtcctggggaggtagatgcagacagattaactctcaaggtaaatgctaatgaatagaggagccagaatcccaacccaggaatgtctgatctcggagtgggcggcttcccagctgtggctttgcataccgctagcgtagccacccggaccctgatcccctgacccttgtccttgatcctccaggaaattctcatatgtaacctggaatccactttaaatgaactcggtaaataatgtcttgactctaggccagtcattacctgggacaggtgagggggaagggcaaccacctgactatgtcactgtcaacagtgcatccttgggctgaggttttcattttacagtggggttcaggcagggctaattgctgacccaggactgtggcctggagggatttcagggccttcccatgggcggactgacagtagaagacagcccctgtcagtctatctgaagaaatcagtgccagataacaatggtaccccgtggctgaattctggctgggagtgaaatggtgatggagtgttggtctcacctcaggtcagcagggaaaacagttgggaaaatggtcagccctcctgaaatgcagcaggtggtgatttttgtgttttgagtcttggcacaccttgctgttgaagcagttgaacaaataaaggaatggaaaaacaggtgctgacccaaagcttgagacagctggttggttgcccttcgttgaaaaccacacggccaacccagagtcttcaggtttggggcgcagttaagctgtggggcaccctgcgtaggctcactgtgtttccagaggctttatgactgcacactggggccgcctgagacccaggtttatatgtgaatttagcagacaagtaaaaagtgctgagtcacattataaatgcaaatttggaggaggatttgaaatgctttcattaagacaccaaagcaggacacttgtaatacagcagtgccaggagaggacaaccctgccattctttggggacctagataaaatggctccactgtcccctgctgagagtgagcaggccatcagcatcgcggtggccggggctcagctgcctgacgtttctttggcccctgtactgtgttgatttcacacactgggcacagccatgctggcggtgtcttgagaacacagccatgaaaagatggagaaagcaaacacagtttctgtcttggagcaccacatggatttagattcagagtatgatttattttgttttggagagttttattatgaattttttttctcccttctttgcaaagacattacagagctaaacccaaacagctgagcctatcagggccttggaaaagcatttttgcctgaaacttgagtttttcctaatgaagtgactttcctcttccatcttttttgtttgcttggttttctcataggtcatttgattgcccgcctcagaacgatggatctgcatctcttcgactactcagagccagggaacttctcggacatcagctggccatgcaacagcagcgactgcatcgtggtggacacggtgatgtgtcccaacatgcccaacaaaagcgtcctgctctacacgctctccttcatttacattttcatcttcgtcatcggcatgattgccaactccgtggtggtctgggtgaatatccaggccaagaccacaggctatgacacgcactgctacatcttgaacctggccattgccgacctgtgggttgtcctcaccatcccagtctgggtggtcagtctcgtgcagcacaaccagtggcccatgggcgagctcacgtgcaaagtcacacacctcatcttctccatcaacctcttcggcagcattttcttcctcacgtgcatgagcgtggaccgctacctctccatcacctacttcaccaacacccccagcagcaggaagaagatggtacgccgtgtcgtctgcatcctggtgtggctgctggccttctgcgtgtctctgcctgacacctactacctgaagaccgtcacgtctgcgtccaacaatgagacctactgccggtccttctaccccgagcacagcatcaaggagtggctgatcggcatggagctggtctccgttgtcttgggctttgccgttcccttctccattatcgctgtcttctacttcctgctggccagagccatctcggcgtccagtgaccaggagaagcacagcagccggaagatcatcttctcctacgtggtggtcttccttgtctgctggctgccctaccacgtggcggtgctgctggacatcttctccatcctgcactacatccctttcacctgccggctggagcacgccctcttcacggccctgcatgtcacacagtgcctgtcgctggtgcactgctgcgtcaaccctgtcctctacagcttcatcaatcgcaactacaggtacgagctgatgaaggccttcatcttcaagtactcggccaaaacagggctcaccaagctcatcgatgcctccagagtctcagagacggagtactctgccttggagcagagcaccaaatgatctgccctggagaggctctgggacgggtttacttgtttttgaacagggtgatgggccctatggttttctagagcaaagcaaagtagcttcgggtcttgatgcttgagtagagtgaagaggggagcacgtgccccctgcatccattctctctttctcttgatgacgcagctgtcatttggctgtgcgtgctgacagttttgcaacaggcagagctgtgtcgcacagcagtgctgtgcgtcagagccagctgaggacaggcttgcctggacttctgtaagataggattttctgtgtttcctgaattttttatatggtgatttgtatttaaattttaagactttattttctcactattggtgtaccttataaatgtatttgaaagttaaatatattttaaatattgtttgggaggcatagtgctgacatatattcagagtgttgtagttttaaggttagcgtgacttcagttttgactaaggatgacactaattgttagctgttttgaaattatatatatataaatatatataaatatataaatatatgccagtcttggctgaaatgttttatttaccatagttttatatctgtgtggtgttttgtaccggcacgggatatggaacgaaaactgctttgtaatgcagtttgtgacattaatagtattgtaaagttacattttaaaataaacaaaaaactgttctggactgcaaatctgcacacacaacgaacagttgcatttcagagagttctctcaatttgtaagttatttttttttaataaagatttttgtttcc

SEQ ID NO: 37827 - DNA, 155009 bp, Homo sapiens
gttcagaatacagctgagcccagagattgcatggcaccaagagaggtttctgtcaagccgtcccgttccgagatgccccatcgcaccaacgaagcaactgctgagcaggttggcactaacacgagctggcgtttgtccagaccttaagactctttaaatagcttttcatatatttaatcctcacattgcctatgtgaatataagcgtaattatctccattttacagatgaggaaatccgaagttcagggagggtaaatggtttaccaaggtcagatgaccagtgttaatcgtgaggtaattagccttagattagggagaggtagtttgatttaaatgatatctgacataatatacgggtttagacatttttggctccaaccagtgatgccagtccaggaaaatgttacacctgctcagatgttaaccctgctgcgggctggaggagaaggcaccctcaccccaaacctccccaggagaagaaaaccctgcagctatcagaagttttagtaaaacaactatcaacagtccatgcaactggctacataatttgtgtttgtgttgcaacactgtccaaattgcaacattttcatcaaaatagaaaactgaaatcccccatctttaccctatgggccaggtcctcctggggtgaagggggagctgggatttttttttttttttttttttttgagatggagtcttgctctgtcgcccagactggagtgcaatggcgcgatctcggtttactgcaacctccgcctcccgggttcacgccattctgctgcctcagcctcccaacccccaaccagtagctggaactacagctaccacgcccggctaattttttgaatttttagtagagaaggggtttcaccgtgttagccaggatggtctcgatctcctgacctcgtgatccgcccaccttggcctcccaaagtgctgggattacaggcgtgagccaccgcgcctgggcagggggtgctgggattctaatccctcatgttcaaggggttccgtggaggcttcacaggctgtggcctgctcagttgcagaagggcccacgcttgatttcatgccctgcaattgctgtcttgagattccttctccttgcttctttcttttcctttttttttttttttccggttggttggttggtttgtttttgagacagagtctccagtctcactctgttgcccaggctggagtgcagtagcatgatctcggctcactgcaacctctgcctcctgggttcaagcgattctcctgcctcagtctcccgagtagctgggattagcccggcaagaattcatttttttcttttcttttctttttttttttgagacagagtgtcgctctgtcacccagactggagcgcagtggtgcgatctgggctcactgcaacctctgcctcctgggttcaagcaattctcctgcctcagcctcccgagtagctgagactacaggtgcccgccactacgcctggctaatttttgtatttttgggtttttttgttttgttttgttttgttttgagacagggtcttgttttgtcacccaggctggagtgcagtggcagaatcttggctcactgcaacctctgcctcctgggttcaagtggttctcctgcctcagcctccagaatagctgggattacaggtgcccgccaccatgcctggctaatttttgtatttttagtagagatggggtttcaccatgttggtcaggctggtctcgaactcctgacctcatgatccacccgacttggcctcccaaagtgctgggattacaggcgtgagccaccacacccagcctaatttttgtatttttagtagagatggggtttcaccatgttggccaggctggtcttgaactcctgacctcaagtgattccacccacctcggccacccaaagtgctgggattataggtgtgagccactacacccagcccagaattaataataattatttttaacgaggggcccagcattttcattttacattgggtctcacgaagaacccagccagtcctgctgctgcctctttcttgctccttcttcctcctttttcctctccttcacaaagagctgtctgctcttgccttttttttttccttccttctttcttttcttttttttcttgtctttcttttctttctttcttttgacagagtctggctctgttacccagactggaggtgcagtggcacagtcataggtcactgcaattttaattttgaacttctgggctcaagcagtcctccccgcctgagcctcccaagtaactggaattacaagtgtgtgccaccatgcctgtctaagttttttaagagacaagagactgcgtgcggtctcaccatgttgcttaggctggtctcaaagtcctgggctctagtgatcctcccacctctgcctcccaaagtgctgggattataggtgtgagccgtaagccactgtgcccagctctcttgactttttttttttttagacgaagatcactgcacaatcttggttcactgcaacctcctcttcctgggttcaagcgattctcctacctaagcctcccgagtagctgggattacaggcacccgccaccacgtttggctaatgtttgcatttgtagtatgccgggaggacattcccctcccttctgatcctcctccctttctaagcccctctccactctcctcgacccctgggcaccttcaagcaggccttctagacatgccaatcctataccctcaggccttgcccgtctaacagtcgttccctgacctcccacgacccctcggtcccacagcgtcccagggtttgtctttctttcttgattgtctctctccctctctctttctttctttctttctcctctctctttcttttccttccttcctcttttcccttccttcctcccctccctccttccttctcttccttccttccttcctttcttccttaagacggagtttcacttttgttgcccaggctggagtgcaatggcacaatcttgactcactgcaaccgcctcccaggttcaagattctcctgcctcagcctcccaagtagccaggatcacaggcacctgtcaccacgcccgattaatttttgtatttttagtagagatggggtttcaccatgttggtcaggctggtcttgaacgcctgacctcaggtaatccacccgcctcagcctccggaagtgcggggattacaggcgtgagccactgtgcctggctttgcatttcttatgactccttagcagcatccttgttcctgctcacttctgcctcctgcctctagactatgggcttgccccttgggtccggggacctggttgattttgctcacagttgtatcctcagtacctagatttgcctggcacatgaaggtgctcagtaaatatttattgggtgggcaagtgcttagaatgtcacctacaagccatgtccctgagagtgtcaggcaccaaagggaggaaagacaagttttgccactcgatccagcaggaaacagcagggctggcgatggacctcaaaacctgcagaaaggaggggctccctaagtgttccttctaagccacgcattcctgggaaagagcaggacaaaagagccagccagggagcaagcctgtcatggggaggaggctgcatcaggatggtttagacgtgtggaaacaattctaggccccacaagatgacaagggtgaatgagctgatccactttgaatctctaagtgctaccaatacaagaataattcccaaatctatgtcacgagctaaggatctctcttgagccttgaactagtttatctaaataactcctagacatatctctcccctagcagggccccaggcacctcaaacccaatctctccaaagcaacccctaagagcaggggctggggttgaaaccctggggtcaccatttgttctctctgccatcttggccaagttaaagttctctcatgctgttttcttcgactgaaaattgagtataaacaatagaatagggccaggcacagtggctcacgcctgtaatcccagcactttgggaggctgaagtgggtagatcacttgaggtcaagagttcaagaccagcctggccaacatggtgaaatcctatctctaccaaaaatacaaaaaattaactgggcgtggtggtacacgtctgtaatcctggctactcaggaggctgaggcaggagaatcgcttgaacccaggaggcagaggttgcagtgagccaagattgcaccactgcactccagcctggcaacacagcaagactccctcttaaaaacaaacaaaacaaacgatagaacaggccaggcgcagtggctcacacctgtaatcccagcactttgggaggccgaggcgagcagatcatctgaggtcaggagttggagaccatcctggccaacatacagtgaaaccctgtctctactaaaaaattacaaaaattggccgggagcggtggctcacgcctgtaatcccagcactttgggaggctgaggcgggtggatcacgaggtcaggagattgggaccatcctggctaacacgatgaaaccccgtctctactaaaaatacaaaaaattagccaggcatggtggtgtgcatctgtagtcccagctacttgggaggctgaggcaggagaatggcgtgaacccgggtggcggagcttgcagtgagccgagatcatgccactgctctccagcctgggcgagagagtgagactccatctcaaaaaaaaaaaaattacaaaaattatctgggtgtggtggtgcacgcctgcggtcccagctacttgggaagctgaggcaggagaattgcttgaacccggggggtagaggtcgcagtgaactgagatcatgcgccactgcactccagccagggcgacagagcaagactccatctctcaaaaacaaaaaaaaaaaacacaaaaattagctgggtgtggtggtgagcgcctacagtctcagctattcgggatgctgaagctggagaattgcctgaacctgggaggttgcagtgagctgagatagagccactgcactccagcctgggcgacaaagtgagactccatctgaaaaaaaaaaccaacaaaaaacaatagaatacacataattaattaatagagcagtcctagtggcccccatagtgaaattctaatgccttgcagagaacagaatcaaactgtcaacctctgtaggctattctgtattcacagattcatttgtagaagatgcatttcattatacgttgtgtttttagcagttacagtgatggcatgttccttggcaacttcagcttggagagatgagatttgtagcagaaagcactcatctgcatttcttctcttccatctcaaagagcagtgaagaggctgtaaggccgtctggtttctgaggaacttcagctttaccctcaggcaggttccgctgctccatcaggcctatgacactgttaggggccctggaaattgttttaattaattttaaaatcagaagaaaatatgcatataataataatgaatattatgagaatgaatctagaccaaatgatgatcccttacccccgcccttgtccaggtgaatggagaaggccatgcatgtgtcctgagctgagccagtcagagcccctgccccggaccccagatggagaggacagcccgctccaggcagcaggatctggatagtaagcgctggggagctctgggaggccaggaaggtggaggggaggcagccaggggatattccagggtgacagcatggcaggccagggtgaaaggaagtataaaagcccccagacaggaaaatatctgcattcaagcagctaaaggcaggccccggagggtccccggcaagaatggtggaggaggctggagatgagatagaggcagggttggaccacctgggccttataagccagaaggagctgagatttttttttcactccaatgagcagctatgaaagggttttaagggagggagtgaccagatctgatttacattttaaagagattagcactgtggaaagtgtactgtggaggtggggcaagagctgagagccacatggagggccctggatacttctggactctgaatggggggccaggcttcagcgatgtaggtgaggatggagacaggtgggtccaagaggacctgtgggtggaggggctggagggggaaaggaaaggctgttatcaaggataaatggtggtgatggtcgtgctgttctgctcctgagctggggaagaagggaagacatgaagacttctgttcagacccattgaggtacccatggcacacacacatggaagtgtggagaaggcagtggaacatgtcagtctggagtgggggacacaggtcagggctggacgcccctggatgctggaagtgtgggtggcatcagtgcacaactggtgtttgaagccacaaatctctgagttagggaggaaatgggaatgtgctgtgaaccagaaactcagaggaaactgcccttgttgagtccctgctgaagacagagaatgaagacaagatagagaaggattctttctttcttttttttttcttttttgagatggagtttcactcttgttggccaggctggagtgcaatggtgccatctcagcccactgcaacctccacctcccagattcaagtgattctcctacctcagcctcctgaatagctgggattacaggcgcccaccatgcccagttaatttttgcatttttagtggagatggggtttcgccatgttggccaggctggtctctaactcctgacctcaggtgttccgccctcccaaaatgctggcattacaggcgtgagccaccgcgcccagcgagaaggatcctttagatctggtaatgcaagtggctcctgactttgaccagagccctctgggtggagggaggaatctggaagccaaattgggatgggaaggaagagtaaaacagcatgatcaccagtgcctggcctcatctcatccctgcctgggctctggattaaaaaacagctatgagccgggtatagtcccagctactcggaggccgaggcaggaggatggcttgagcccaggacgttgaggctgtgggtgagctacaattgcaccactgcattccagcctgggtgacagagcaagaccctatctctgaaataaaaaatatttatacttaaaaaaatagctatataggacattttgggggcaaatggggaaattggaaaatggactccatattagataatacctttttttgttgagacaaggtctcactctggcatgcaggatggagtgcagggagctcactgcagcctcaacttcctgggctcaggaagtgattctccagcctcagcctcctaaagtgctgggattacaggcgtgagccaccacgcctggcctgtattagataatatatagcagctctgaatttgttgtgtgtgataatggtgtgtggtaagagagaaactgtaggagacacacattgtagtatttagggcagaaagagtagatacttgaaactttccagtgctccaacaataacaaaaaattaaacacataccccatacacagagaaagcacagatggcaaaatgctaattggaaaaatctaggtgaagaatattttaatattttttcaactcctctttcagcttaattatttccttacaaagttgggtgcagccgggtgcagtggctcactcctgtaatcccagcactttgggaggccgaggcgggtggatcacctgaggtcaggagttcaagaccagcctggctgacatggtgaaaccccgtctctactaaaaatacaaaaaattagccgggtgtggtggtgcatgcctgtaatcccagctacgtgggaggctgagccaggagaatcacttgaaacccaggaggcggaggttgcagtgagctgagattgcgccattgcactccagcctgggcaacaagagcaaaactccgtctcaaaaaatttaaataaataaataaataaattagctgggcgtggtggcgggcgcctgcctgtaatcccagctactccggaggctgaggcaggagagtagcttgaacacaggaggcggaggttgcagtgagctagatcttgccattgcactccagactagatgacagactgagaacctgtctccaaaaaaaaactaagttgggtgcggtggcttacgcctgtcatcccagcactttggaaggtcgaggccggcagatcacttgaggtcaagagttcaagaccagcctggccaacatggtgaaaccccatctctactaaaaatacaaaaattagccgggcttgccgggcacggtggctcacgcctgtaatcccagcactttgggaggccgaggtgggcggatcacctgaggtcgggagttcaagaccagcctggccagcatggtgaaaccctgtctctaataaaaatacaaaaattagccgggcgtggtggcaggtgcctgtaatcccagctactcaggaggctgaggcaggagaatagcttgaacccaggaggtggaggttgcggcgagccaggatcacaccattgcactccagcctcggcaacagagcgagaatctgtctcaaaaaaaaaaaaaaaaaaaaaaaaagaggccaggcgcggtggctcacgcctgtaatcccagcagtttgagaggccgaggcaggcagatcatgaggtcaggagattgagaccatcctaacacagtgaaaccccgtctctactaaaaatacaaaaaattagctgggcatggtggtgggcgcctgtagtcccagctactcgggaggctgaggcaggagaatggtgtgaacccgggaggcagagcgtgtagtgaaccaagatcgggccactgcactccagcctgggcgacagtgagactccgcctcaaaaaaaattttttttaaattttaattacaaaaaggaagggtgactagcagggtcaagagaaagtttcatacaattgagaaattttttgaagaatgggagcataaatgtgtgttgaaagcaatgctcatggaagggaggaggagaaggtgattatgtcagccaggggtgagaggtgcagggcagaatcctggaggagcaggtggatggcccagagtgagggcctggagggtggcctttgcccagtgtggggcagccacacgtcagatgggcaacttggtggggggctttcctgtctgatgacttcccctctgtactctacgtaggatatggggctctctgctaagaagggccaggagagcaatggggaggttcccgcagggaaaaactggtgggatttgtgggtttgtgttgacgatctgggtgaagattgtttattggtttagggagggagacaagaggaaagattaagtccccacacctccaagactcagtttctccatctgtaacatgaggagattgaactaggagatctcaaaggactctgaactccagtacgctcatggtccctttaggaagtgatgggaagcatatactgaatagcacgagcctgggttatttaagaattaaggatagtggctgctctgcctatggagtaaccattcctttttttttttttttttttgagacggagttttgctcttgtcacccaggctggagtgcaatagcgcgatctcggcttactgcaacctccgcctcccaggttcaagcgattctctgcctcagcctcccatgtagctgggattacaggcatgcgccactaccacgtctggctaatttttgtatttttagcagagacgaggtttcaccatcttggccaggcttgtcttgaactcctaacctagtgatccacccgccttggcctcccaaagtgctgggattaccggcgtgagccactgcacctggcagagtagccattcttttattcctttacttacttaataaacttcatttcacttaaaaaaaaaaaaagaattaaagatagctagtaaaaactagacaattgcctaagacgtttctaattgaggattaaaaccaataaatacaagaaggccaggcatggtggctcatgcctgtaatcccagcacttggggaggttgaggtgggcagatcacctgaggtcaggagttcgagaccagcatgaccaatatggcgaaaccctgtatctaataaaaatacaaaaattagccgggtgtggtggcgtgtgcctgtagtcccagctactcaggaggccaaggcaggagaattgcttgaacctgggaggcagagactgcagtgagccaagattgtgccactgcactccagcatcctgagcgacagactgagactctgtctccaaaaaaaaaaacaaaaaaaccaataaatacaaagaggcacgtgaaaggcagactgctggccaggcatggtggctcacgcctataatcccagcactttgggaggccgaggcaggcacatcatgaggttaggagagtgagaccatccggctaacacggtgaaactccgtctttactaaaaatacaaaaaattaggtgggcgtggtggtgggcacctgtagtctcagctactcagagggctgaggcaggagaatcgcctgaacccgggaggtggaggttgcagtgagcccagatctcgccactgcactccagtctgggtgacagagcgagaatccttctcaaaaaaaaaaaaaaaaaaagagaaagaaaaaagaaaaaaaaagagaggcgggtgtggtggctcacacctgtaatcccagcactttgggaggctgaggcaggtggatcacctgaggtcgggagttggagaccagcctgaccaacatggagaaaccccatctctactaaaactacaaaattagccaggcgtgtaatccctggcgcatgcttgtaatcccagctactcgggaggctgaggcaggagaatcgcttgaacccgggaggcagaggttgtggtgagccaagatcacaccactgcactccagcctgggcaacaagagcgagactctgttaaaaaaaaaaaaagaaagaaagaaagaaaagaaaaagaaaagcagactgtttaaggcttcagagcacccctgggggagtgaggaggtggcccagaggccgagggctctgagatgcatgacgaggtgctgtttgggtgaacacggtgcggggtccttttcagagtatatactgctttctccttgctctggccgaagttcacatcacacagcatgaagtgaaacagcacatcaatgtgatgaacacggttaacactgaagaaacctgtatgtgcgagcaaatatagcatgaaagggttcagggaattttttttttttttttttttgagactgagtctcactctgttgcccaggctggagtgcagtggcacgatctccgctcactgcaacctcccacctcccaggttcaagcgatttttctgcctcagcctcccaagtagctgggactattggcacgtgccatgatgcctggctaatttttgtatttttaatagagtcggggtttcaccatattggccaggctggtctcaaactcctgacctcatgatctgcccaccttggcctcccaaagtgctgggattacaggcatgagccactgtgcccggccgtcctgttttttggtgtgtgtgtgtgtgtgtgtgtgtgtgtgtgtgtgtgtgtgcacgtttgagagggagtctcccactgttgtccatgctggagtacagcagtgtgatctcggctcactgcaacttctgcctcccaggttcaagcaattctcctgcctcagcctcctgagtagctgggattataggcatgtgccaccacgcctggctaattttttgtattattagtagagacagggtttcaccctgttggccaggctggtcttgaactccaggcctcaagtgatccacctgcctcagcctcccaaagtcctggtattacaggcatgagccaatagtgcctggccaatagtttttttttatttttatttttaaagggacagggtctccctctttcacccaggccgtaaccctgaactgcgaggctcaaacgatccttctgccttagcctcccaactcccaagtagctaggactacaggtgcacaccaccatgcctggctaatttttaaattttcggtagagacgggatcttggtatgttgcccaggctggtctcaaacttctggcctcaagtgatccttctgcctcagcctcccaaagtgctgggattacaagcgttgtgccacagtgctcggccaacaatagatttataatatcactgagggcagggattgtgagtcatcaccagctccccagtgactggcagcatgccaggaatgggggaggggagagagggaaggaagggaagcttctcggcctgacagttcagccaggtgcaggcactgtcatgttcatggccaccaggcatctgccaagcaccaggctctgtgctgcccactttacacagatggtctcatttggccttgatgacagcctgtggaggttggtattatttactccaagaggaaactaaaggcagagagtttaagtaacttgccaaaagtcacatggcagaatcaggatttgagctcagatatgttaaactgaagcttgtgctcttgactgcctggctgtgcagtcttccagaagagcacggcatggacttctggaattcttgcagccactcgactcaaaagcagttagcatagtgctgagcacaggtaatagggcatttgacaaatgccagtgactgtagaccgaatgattgacagtctgaaagaatgaatgagtgaagtgacttcctgtcttgtgaggtttttctcttcaaatggaagatttccccatagcctttgaatgctcaatctaattaaggcaaaaaggcatcagagaattgcagggcctttcctttattaactgtcaagtccaatctggaggctgtttatgtgccaaggtcagagatcagtctttagctgctctcctctcattcatctggccaacctcagaacataaagtttattgatgcaaaactgattggcaggctgggctaacgagctggcgggaacagggagtatcagaaagagttctaagccagcgtcggctcggcccggctcctctgctgtcctaacttccctgtgctctaggttgcagggtcgcacctttcagaagtgaaccccagaagagtagcaaatactgcctggccttttggcagttcttatggagcccagtcaagagcaggagggggagcagtcctttttcctggttttgtctattaacgtggaaagagcgaggcatggaagattaggtagtatagtctttttttttttttttttttttttttttttagacagagtcttactctgtcgcctaggctggagtgcagagtgcagtggtgtgatttcggctcactgcaagttctgcctcctgggttcgtgccattctcctgcctcagcctcccaagtagctgggactacaggcgcccccccaccatgtccggctaattttttgtgtttttagtagagacggggtttcaccgtgttagccaggatggtcttgatctcctgacctcgtgatccgcctgcctcagcctcccaaagtgctgggattacaggcgtgagccaccgcgcccagcagtatagtcttaagacttcacaaatcaaagaaattcctgtgtaagcctcgtcaggcctaggggtcgtgaagaggaaggtaactgttatgcctacagtttgcagccaacccattagtaagcagcgcctgtctgtggggagctcctggcagtgcctcctcctccatgcccagcaggaaagagaggctgggaaggatgcatgggccacatgcctggctctacttgcagtgcccccaggataaaagccaggaggctggccgggcacggtggctcatgcctgtaatcccagcactttgggaggccaaggtgggtggatcacgaggtcgggagatcgagagcatcctggctaacacggtgaaaccccgtctctactaaaaataaaaaaaattagctgggcgaggtggcacgcgtctgtaatcccagctccttgctaggctgaagcaggagaatctcttgaatccaggaggcccaggttgcagtgagctgagatcgcaccactgcactccagcctaggcgacggagcaagaccccgtctcaaaaaaaaaaaaaaagccaggaggtgggcagtcaggagagacaggtggacctgggagctgtgtcttctactcaagatagggaaagtacaactcccctggttattatcaggaccaattgattttgcctgatctgagagaaaacatcctgaccacaggtcacttgaaatgccctgtaattcagaaacagtggctgtccacagcagacagctatctggatttaagaccccaaattcacacaccacaccacaaattgtccacttacaagcaaaaaaataacaaacagccaagcccccaacccactctcattttattcccttggttccaggtctcctctgagcaggtcatgtctcctggtgtgtttgcgtacaggctgtggggctggggggaaggagtcctttttcctcttaccccaggcagggctggctccaggttgcagagctccacagagaaaactgctcactgcagagaagggcatagtccagcccaagctctactctgatgagctctgagatcgggggtggtgacttcatcttctatctatggcttggaacaatgatgatgaccatgaccctctggtttcagttcagtcaatgaatggggagcaaattgctattgtcaggcactaggctagggaggtgattcagaaaggctcccagagacccacacaccaatcactaaactaatataacacgctaaatactacatctacagtagggataaagtgttttaggtacacaaagggagttgagaaaagcttcagaggttttcaaagtggtttccagaccatcatcaaccagcctcacctggaaagttgttagacatacaaatatcagccccaccccagactggctgaataaaaaattctgggggtggggcccagcaatctgcgtttgaacaagccctccaggtgattatgatgcaacctaaagtctgagaatcacgtagaggttggaaaactaccttgcaaccagcaacctgtttttgcaaataaagttttattggaacacagccataatccatcattcagacattgtttgtggctacttcccttttaaccagcagagttggtagttacgacagagacaatatggcccgcaaagcctgattctgccaaatgactagactagatttcccatactagggagcatagcctagattttttttcttttcttttttttgagacagaatctcactgacacgcaggctggagtacaatggtgggttctcagctcactgcaacctccaccttctgggctcaagtgatctcccaacctcagcttgccgagtagctgggaccacgagcatatggcaacatgcgcatctaacttttgtatttttttttgttaattattattttttgagaccgagtctcgctctgtcgcccaggctggagtgcagtggcgggatcttggctcactgcaagctctgcctcctgggttcatgccattctcctgcctcagcctccccagcagctgggactacagacacacgctgccttgcccggctaattttttgtatttttagtagagacggggtttcactgtgttagccaggatgctctccatctcctgacctcgtgattcacccgcttcaccctcccaaagtgctgggattacaagcatgagccaccgcgcccggccctgtatttttttttaatgacataattttatttatttatttacttttatttgagagggcgtctagctctgttgcctgggctggagtgcagtggtgcggtctcggcttactgcaagctccacctcctgggttcatgccattctcctgcctcagcctcccaagtagccgggactacaggtgccagccaccacacccggctaattttttttttatttttagtagagactgggtttcaccttagccaggatggtctcgatctcctgacctcgtgatctgcccgcctcggcctaccaaagtgctggtattacaggtgttgagccaccgcgcccggcctagaagacggaagtttgcatgttgcccaggctggtctccaactcctggggtcaagtgatccactgcctcggcctcccaatgtgctgggattacaggcgtgagccactacacctggcctcttttttttttttttttaagagacaaggtttcaatatattgcccaagctagactcaaactcctggcctcaagcaaccctcctgcctcagcctcctaagaggctggaactacagacaggtgcacgccactatgcttggctcctgtctatggcggaggttgcagtgagcagagattgtgccattgcactccatcctgggcgatagagccaaactttgtctcaaacaacaacaaaatccccttagagctctttcctagcaaccaaacgtttttccattttgttaggaattggaagaagagaggaaataactggctaagtaactactctatatcaagcacggttacaaggcattttccaacattatttcaattttaatgaaagctgctcatgaaattaggtttactgggtcacagttttcagatgaggaacctgggacaggtgaagggacagaattggaacccagttctgtcataccacagatgccccacctgttctacactggcctgtcaagaataacaataataataattattattttagagagaggcctgctgtgttggccaggtggactgcagtggcacgacctcggctcactgcaaccttcgactcccaggttcaagcgattctcctgcctcagtctcccgactagctgggattacaggtgcccaccaccacgctcagctaatttaaaaaatatttttagcagagatggggtttcaccatgttggccaggctggatctcaatctcctgacctcgtgatccacccgccttggcctcccaaagtgctaggattacaggtgtgagccaccgcgccaggcccaatgattattttaaataataattattttttttgagacggagtctcgctctgtcacccaggctggagtgcagtggtgtgatctcggctcactgcaacctccgcctcctgggttcaagcgattctcctgccttagcctcccgagtagctgggactacaggcgcccgccaccacgcctggctaatttttttgtatttttagtagagacagggtttcaccgtgttaagacaggatggtctcgacctcctgacctcatgatccaccgcctcggcctcccaaaatgctgtgattacaggcgtgagccaccgctcccagccttaaataattacttttattttattatcattatttttgagacagggtctcactctgtcacccagaatggagtgcagtggtgccatcttggctcactgcaacctccgcctcctgggttcaagcaaaattctcctgtctcaacctcccaagtagctgaaagtacaggtacgtaccactatgccgagctaatttttgtatttttagtagacacggggtttcaccatgttggccaggctggtctcgaactgctggcctcaagtgatccacccgccttagcctcccagagtgctgggattacaggcgtgagctaccgcacccagcctactttgaaaaatgggatcatcggccaggcgcggtggctcatgcctgtaatcacagcactttgggaggccgaggtgggcggatcacgaggtcaggagttcgagaccagtctggccaacatagtgaaactccgtctctactaaaaacacaaaaaataagccaggtgtggtggtgtgcgcctgtaatcccagctagttgggaggctgaggcgggagaatcgcatgaacccaggagaaagaggttgcagcaagctgagattgtgccactgcacttcagcccgggcgacagtgtgagactctgtcaccaaaataaaataaaataaaataaaataaaaagatcctctagcccaaatccctccatcacagaagcagttggagaagtttgaaaaggttagatgataggcccatgtggcttgtctgtggaaagagctaggctgcaagacacctctgactccattgagtgctttctcttactctcctttcccgatttaagacattaaatcatttaagacagtgtcatttggtcgagtgcggtggctaacgcttgaaatcccagcactttgggaggctgagatgggcggatcaactgaggtcaggaattcgagaccaacgtggccaacatggcaaaacctcgattctaccaaaaaagaaaaaaaaaaaaaattagccgggcctggtagcgcgtgcctgtaatcccggctactcaggaggctgaggcagggagaactgcttgaacccgggtggcagaggttgcagtgagccaagatcgcaccactgcactccagcctgggcgacagagcgagactctgtctcaaaaaaaaaaaattttttttaaaaagacagtgtcatttgatggagttgctttcttgatcgttggctgcaattaaagacctagcctcactgtcttttgtgttgccttggaccggctcttaggttctaccgccctaacaggcagtggaggctggcctcgagtggtagtcctccatcttgccctcttttcctaccctctacccccaacccgcgagctgctctcctgtcttcttccaacactgttctctttgggaatatgcatgtccaacttcccaagcagtctgggatctggagtaagatgactcttggtttaatgaagtttttccacagtgcttgcatgtgccccaagggtttggaaggttggagaactaacaaaaagcaaagagccatcctgtgtcgtttcggcaggtctgtgttctgttaaaatatggaagaattaagagaagaacgaagaaataagggcagaaactccactggggagtacttgtctaaccctgaaaaagttcaaggctgttgttcaaggtctgaatttttcccttgagatttgcttgtagtccttaaagtcatcttcagacatctgatcaaggcagcatccgcggaaaattataaggtgggtggctgcactggagcctgtcctggctcaggggcgccggtgaagagtgatttttttcccttggccttgggggatcagagggggtgccctctgctatgcaggaagccctccttgcccgctagatagttctcattcctcaggagatactctgtgaggggccggcgtgttttctccatcttggcacttaccctcagaccctcctaagtacccgggagggccgtgtttttcatcggaggttgaaatggaacctccccctgggtgcccggggagagtaccttgggggcagcgcccctccttccggagggcagcatccccgcgggggcgggggctcggctttgatcccagggcaccttttgtccctggagacgctctgccagccaggtacgtggagggagtgcagcccgccctcccgggcgacgcgcggggctggggcgggccggcggctccggggagtggcggccgggagcccgcgaacgcgggtgggcgccgtcgcctcactaaccgggcgcctccgggaagtccgggcggggtccgccgctcacacataggattagcgtcctctaaactccatccctgggaaaagccgccgcacttctcacccaaactcgcggagccgaggggctgggcaggggttgggcgggcgcgggggccggcgaggcggatccgggaacgggtggacccgggcggccaagccccttcagcgccggcccaaccgccccggcccgggccagtccagcggggcgggggccggcgacacaaaggcggcggcgggtcctccgggcctccggcctcgggcagtcgcagggcgccccgggccgccggacctcccctcgcgttgcggcccgtcagccggcgccgcccgtcgcccgccctcagccgtccggcgaggcgcggcttcctccgccggcgcggggtcccctggttaacccctgcccggcagcgcggccgctgattggagaaggcggggcgccggggcagcggggacccccccccaccttcctcgtcccctccccctgctcccccactgtcggcgcttcccccacccccccaggaccccccccgcctcccagccgtgcaaatctcgcgaggaaacacgcggtttcactagtgtgtttacaccgatcactactaatccggaccgaaccgatccggattaaggggccggaggcgggtcctgggcaccagcggttccgacccccccgccctccgcgccgcacccgagtggcccccagccgagcgggcccccacctcctggcccggcctgggccctcctgcgcctcccttggcctttgtccggcgccaggaggccggtcccgcgccccccgcggccgcccgggcccgggcccgcgtcgggcgcctggctctgtacgcgagcccggggatctgcggccttcgtgccccccctcccccgcccgccctctcgtggagcccggcgccggcggcggctgcccgggcggggggttgcggcgctcaggagaggccccggctccgccccgggcctgcccagggggagagcggagcggtccgcagccgggtcgggtcggggcccctcccgggaggagcgtggagcggcggcggcggcggcggcaggtgagaggctgagccccgggcgggggaggactccaggcctggggcattaaccgtcctggggacccctttggcctgaggagcctgcgacctgggcccagctcggggccggctccggaccgcagctcctgggcgctgaggcgggaggggctccctgagggctgcgggtcgctgaggggccgggcagaagatgggggaggcccaggcggccccggcctgggattggggccggcggccggaggagagacgggggcccccaggcagctggaggcctcggcagcctcccgggcgcccccgagagccggccctcccttcctccgtgacaggtgggcctggagttggggaaagtttggagccggcgaggggcgccgggaccaggccccatcgctcctgcttcccggctgtgggctgcagggaggatcccagtccaaggccccgctggaattagacggagtggctatttccttaacatgagttgacattaaacggaataaccgccggggcgtcattttccgggccgggcctggggatggaggtttgggaagtgttgcgagagaccttggggtttgggagagactgcaacctttgccattccgacctcgattagggcagggcaagacgcgaggaaggccacgggggaaactcattctcccagtctcttttttttccttctttttctttttgtaaagatgcatttcaacctttctgagaatttcctaattctctctctaacctgcacttgcatgtgtgggtgaaactttaatttgtcaccttttcattcccctttgccccaggctctcaatccaggaagggaaatgaaactgaaggacttgtaagggggttgttactggagattgtagagttgttggattgcagaggagaatgttcgattcatcttttcagtaactttaaaatcacaccaaccattccaactacttaataatgtgttcgaaggggttctatgtaatatgtttcttttccactgttaatattaaagagaggttttaaatgggtcgtgtaggagttggtctcttgcaaaggatgaacatatttgctgaaagtagcctgtgcattaattggttatggaagtttaaaaatggtgtcctcctgcccctccctgcttggaagaagggctaaaagcagatgtccagaatcaagagaaaactactgcagggagtggtcagaaaaagattttttaaagggattgttatggagctatattaatttactgagtgaatggaggtggatggttttaccgtgggctctctattaaatttaaaataattccttttctcatgagctactgtgagctcttcagagacaggagctgtataatagtgattttgcagttatttgtagcttctgattcatcctatattcttttgaaattattgtcaatgattcatatttttagtttaaggactacttcctgagtgggaaataaatatctgaagatacttagctagattaaggctgatagaaggaattttctttttgcaggctagttcttgttttgttctttcccctgtgctcaacttttacagaaattatatgaagggtttgaggggtttatttttgctgttaaaatcaaatcagaactagggaagaaaaagtggctgtcatagaagaggacttctgagctgctttaaaacttttcaatatattactgtttgatgcagcacatagtagtctaccacttgtatgctatatttacttgagatttacctgcatttgatctttcagtgaaataattactgtgagttttgttctacagaaaattgcctcctcacattttagtgtttatggtttcacagcctactttttctttttcagcagaaatgatggaagaattgcatagcctggacccacgacggcaggaattattggaggccaggtttactggagtaggtgttagtaaggtgagtaaaatgatgatcatgaacactattcatattctaatttaaacacattttttaaatgattaagagcaatttgggtaggcccttctgatagtttgcaggggagaagatttgggtcttaatttcagtgaacttttagatcctactggtcattccagtagtcatttaacatagtaggtttgaaaatgttctatatgggaatatatgtttcttcttcctttctggtataggagaggtttctcatggttcttgttacaaggaaactaacaggatgtgtgtatagattctatgccatattttgttaaaacttgtcagccattcagaaagaaaattacaaggcattgcatagctttgttacattggactttggaggtagttacatggtagagtattgaaaaattggcctctgtgaagtctgcagactctttactggttgcacccccagactggtttgttgctcttctcattcttccttcttagtttttatttttgttgcaggagcataatattagattaggcccccattaacgggcacgtatgaagttaagcaatgttatagtttcctatgcatgtttatgtacccactggtccacccctctgctctcataggatgattttacaatgtgtaaaatgtttgattttaatacagtatgcaaagtatatttacgatattttatttaaaagctttattggtccaagatcatattacttgggcttgagatgtgtgaacgtatgagctactgaatttttttttttgagacagagttttcctcttgtcgccgaggctggagtgcaatggcgtgatctcggctcactgcagcctccacctcctgggttcaggtgatgattctcctgcctcagcctcctgagtagctgggattacaggtgcccgccaccacgcccagctgatttttgtatttttagtagagatggggtttcaccatgttggccaggctggtctcgaactcctgacctcaggtgatccacctgcctcagcctcccaaagtgctgggatcacaggcaggagccactgtgcctggctgagcttttgatctttaaccagtgtgatacaacatttgtttctgtgcttttcaagaaatcctgtctcatggtaacctgggtgttgatctcgtgctttagttagtagcttctccaaggagaaggcgtgttgaggtttagttggaaaaatgggcttctttgatgggtctcacagttttggtgagccgggatagcttgatagggttttgttttttttttttttgagtcagagccttgctctgtcacccaggctggagtgcagtggcacaatctgggctcactgcaacctctgcctcctgggttcaagcgattctcttgcctcagcatcctgagtagctgggattacaggcatgcaccaccatgcctggttaattttttttatttttagtagagacagggtttctccatgttggccaggctgggtctcgaactcctgacctccagtgatctgcctgtcttggtgttccaaagtgctaggattacaggcatgagccaccacgcccaaccagcttgatagtttttgtttattcaacaaatattgagcacctgctgtatgctaggcattgtgcaaggtgttagggctgatgcttgagcacagtacctccacatctgcagtatggggagagagagatgataccgtgatgagatctgtattagagctgtgacaaggtgctgtgggaacacaggatttgttacatattcttaatttctttggccacttaaacagtttacttttgtggcactttagagtggctgtgcccctggacgttgtatactgaagttacatttacaaatgtaaactctctgatctaggtgaagtagcttcaaatagaagtgagcaatatatttgaatactaaattgatctctaaatgacctctgatgtgtctttttaacttgaagattgagcataaggctaatgtccagatctgtctgtttaaatggtccccccacccccgcctcccgtaagtcagtaagtttgtattcaaattttacatagttaagctcactgatctttggattagggttgttgttctgtttttaggttcgtgatggctgtattcaagtatacttttgatggagtagggcataagtgataagaatgagtgacattcaacatgttgctgtctagacccaacttaaagtcatgtaactaaggtatcagaaaactttaatacagtaacctatctgtttaataggaaattctacctttaacatagaaagaagttctctgtacagaaaaagaaatttacctatttccagtttttttgtttgtttttgagagggtctcactctctagcctaggctggagtgcagtggcacgatctcggctcacctcaacctccatctcccagtctcaagcaattctcctgcctcagcctatagatagctgggattacaggcgtgcgccactaccaccctgttaatttttgtatttttagtagagatggggttttaccatgttggacaggttggtcttgaactcctgacctcaaatgatccacctgcctctgcctcccagagtgttgggattacaggcatgagccactgcacccagctttatttccagttgtttttattccattagttgttttttttttgagacagagttttgctctgtcaaccaggctggagtgcagtagcacaatctcggcgcactgcaatctctgcctcccgggttcaagctattctcctgcctcagcctcctgagtagctgggactataggcacctgctaccatgcccagctaatttttgtatttttagtagatggggtttcaccatattggccaggctgatctcgaactcccgaccttgtgatgtgcctgcctcggcctcccaaagtgctgggattataggtgtgagccactgtgcccagcttaagtagtcgtatgttactttgatatttccagtcacggtaagtatattgattacaatgaatttgttatttgaggactagcaggagagtattttttttttccataacaaagaaacttgaagaaaaaaattaattctgtagtttgcagagccgggaaaagaaaatctccatttcgtatgacttcttttttttttgagacagagattcactcttgttgcccaggctggagtgcagtggcgcgatctcagctcactgcaacctccgcttcctgggttcaagcaattctcgtgcctcagcctcccgagtagctgggattacaggcacgtgccaccatacccggctaattttttgtatttttagtagagatggagtttcaccgtgttggccaggctggtctcgaaatcctgacctcaggtgatccacccgcctcagcctcccgaagtgctgggattataggtgtgagccatcgcgcccagcctttgtattacttcttttaccagtaagacatcgtacctctcagactattgatttgaaatgggggtgtggaggggatgatgatactgggagaaaagggtgcttttggaaaaactcctctccctggctttgaattctcattttggatcattatttcccaataagaatatcactgtgttagggccaggcacggtggctcacgcctgtaatcccagcactttgggaggctaaagcaggcagatcacgaggtcaggagatcgagaccatcctggctaacacggtgaaaccccatctctattaaaaaatacaaaaaattagctgagcttggtggtgggtgcctgtaatcccagctacctgggaggctgaggcaggagaatggctgagcccgggaggcggggcttgcagtgagcctgggcgacagagcaaggctccgtctcaaaaaacaaaacaaaacaaaaaaagaatatcactgtgttgatgacagctttgtttttcaaagatcaaaaaagatttcagcccctgcagctccaaataagagagcagagtgacttccctgtgatggtgccatctagtgggactggttcagcctcttgggctgtctcttgaatttctcctaactattcataacatttttcagtactttttgatgtccatagaaggaagaaagtcagtgccactgtggattctttcctagtggacaagagtgttacaagtagctacagcctttgaactttctggttgttgtaaatcttctgttgtataactttcgagttttttccacctgcaaattagatatacactccattacttagactaaaacaaaatggccaaatctccacatctattacttatatttaagttgctcattacctatatttaggtttttaattttttatttctaattttcttgcatagtgcaaatttttaattttcttgcatagtgtgtttataggtaggtactcagtttctcagcatatttacttcataataatggtaaaacaaaagtcatttattttgggctttgggatgcactatttggtttttgtttaaaagattgacgttttctgtcatgaactgatgaggggaaagtagtaatgtgcacccaaaagtctatagcaggctctctagtctagctgcccctttttaggaggacctggagccatcgtcttagcagttttgaggtgataaggttaaactgggttgtgaacctagtaattttctggttttttttttttttttttttttgagacggaatctcactctgtcgcccaggctggagtgcagtgatgcaatctctactcactgcaagctccgcctcccaggttcacgccattctcctgcctcagcctcccgagtagctgggactgcaggtgcctgccaccacgcacagctaattttttgtatttttagtagagacggggtttcaccgtgttagccaggatggtctcgatctcctgacctcgtgatctgcccaccttggcctcccaaagtgctgggattacaggtatgggccactgcacccggctgctagttctttatgtcttgttgacttgacatgtgagctgtcctacctctttttttgagacggggtctcactctgtcacctgggctagagtgcagtggcgcgatctcggctcgctgcagcctctgcctcccaggttcaagcgattctcttgcctcagcctccccaagtagctaggactacaggcgtgtgccactattctcagctaatttttatatttttagtagagatggggttttgccatgttagttggccaggatggtctctctctcttgacctcatgatccgcccgcctcggcctcccaaattgctgtgatgacaggcgtgagccaccgcgcctggcctgtcctacctctttttaaagacctcttcctgtaagcactggatgatctacttctagtaatgtgaaactgactatatcttgaattcatatgttttcaatcaacctgttgcagtttatatttcacaccctgctcccttttgacagtttaagtacagatagtctcagcagttctggagaccatgtaaagtaggcagaatttcacccttgcatgcattgttacttgtacctagttggatatcaatgctaatacagtagcaaatacttataatactgtgtgccaggtactgttccaacagtacaacaaaagcaataagaaatgaatttagatcttttataacagggataatggttaacaaatctgtacataatcaactcactggattaataggcattctccattctctctttataagccatactgactgatgcttatcacattgctcccaccagttgaattatagccatgtcaatgatcattttacaataacttacacttgtgttgtaattattctatttaatacacaattgcataatgcaatgaaatatgattgcaggctgggcgcagtggcttacgcctgtaatcccagcactttgggaggccgaggcaggcagatcacgaggtcaggagatcgagaccgtcctggccaacatgccaaaacccgtctctactaaaaatacaaaaaataagccgggcgtggtggcatgtgcctgtaatcccagctactcaggaggctaaggcgggagaatcacttgaaccagggagtcggaggttgcagttagccgagatcatgccactgcactccagcctgggcgacagagcgagactctgtctcaaaaaaaaaaaaaaagaaagaaatatgattgcaaaatgaaagaattgtttccaagagaactaagttaaccgccctagaaagactagataagtcagcacgcgcctgtagtcccagctgctcaggaggctgaggcaggagaattgcttgaacgtgggaggcagaggttgcagtgagctgagatcgcgccattgcgctccagcatggccaacagagtgcgcctccgtctcaaaaaaaaaaaaaaaaagtaagtcagcaaggagatatctgtaaaaatttatgatattcttttaatctgcaggaattctttacttaaatccttggcaagtatcttttttttttttttttttttgagacggagtttcactcttgttgcccaggctggagtgcaatggcatgatctcggctcaccgcaacatccgcctcccaggtccaagtgattctcctgcctcagcctcccaaatagctgggattacaggcatgcgccaacacgcccggctaattttgtatttttattagaggtggggtttcttcatgttggtcaggttgttcttgaacttccgacctcaagtgatctgcctacctcggcctcccaaagtgctgggattacaggtgtgagccagtgcgcccggcggcaagtatcttttaagttctcacttttttttttggagacggagtttcactcttgtcgcccaggctggagtgcagtggcatgatctctgctcacagcaatctccacctcccgggttcaagcgattctgctgcctcagcctcccgagtggctgggaggtgcccgccaccatgcccacctaatttttgtatttttaatagagacgaggttttaccatgttggccaggctggtctcgaactcctgacctctggagttcacccgccttggcctcccaaagtgctgggattacaggcgtcagccaccgtgcccgggccaaggaactctttttctatcttttataaatttttaagtctgatacatcacattatataatcaaattgacttctgaaaaggtatttaaccaactgatacctttcttttcatgtagttcattgcagcaattagaagctttcagttatgaatatctagtgtcagctttttcacataccaaagtcactttcattttttaaaaatgtttgtatgtcttacatttaattacatgcctgacaattctcaacaagtatgaatgctgagaaatggcctatacttatattgatgcattttaaggaactgtggattaatttactttagtatttatttgatttcctccttatttcacatgtagtcaagtaccaacacgtgcctctttctctgaaatttctgaagtgtttttctgcccccattgctactgccttaatccagactgtttttattcataacttgaaattctagtttggaagtcttgcactctttctgttcttttattggttaccacagaaattacaacagatatttttaacttatcaaaggttaatgttaatacctttgtcttcctcttggtcagtacgagggccttgaagatttttttttttttttttttttttgagatggggtgtcactctgtcacccaggctggagtgaagtggcatgatcatggctcactgcagccttgacctcctgggctcaagtgctcctcccgcctcagcctcctgagtagctgggcctacaggcacacaccaccacacttgaataatttttgtagtttttctttttataaatttagaaaaaaaatgcctcccatcagcatcttgcaaatttttgtattttttgtagaaacagttttgccatgttgcccagactggtgaccttgaagatttaactccatttattcccctcacaattcacacgccattgctgttctgtatttaattgtacgtgtgtgtgtgtgtgtgtgtgtgtgtaaatttttttttttttttgagacatggtctcactgtgtcacccaggcttgagtgcagtggtgcgatttcagctcactgaaacctctgccttctgggctcaagtgattcttctgcctcaacctcctgagtatctgggactaaaggcacgtgccaccatgcccggctaatttttctttttttgtatttttagtagagatggggtttcatcatgttggccaggctgatctcgaactcctaacctcaggcgatccgccagccttggcctcccaaagtgctgggattacaggtgtgagctactgtgcccagtctgtatgttttctagagctcttttaggtttatagaaaattgagcagctaatgcagagttcctatatacttcctcaccctattttctcattattcacattttgcattattacaggtgtgagctaccatgcccagcctgtatattttctagagcacttttaggtttatagaaaattgagctgctaataacagagttcccatatacttccttaccctagtttctcattattcacattttgcattattagtgtctttgttacaattgatgatacgttattaactaaagtccattgttcacagttgtctactggcttccattgggctctttatttttatttttatttttttgagatggagtcaacttgcccaggctggagtgtggtggtgcgatctcatctcactgcaacctctgccttcaggttcaagcaattctccctgtgtcagcctcctgagtagctggaattacaggcgcccaccaccacgcctggctaatttttgtatttttagtagagattggtttcaccatgttggccaggctggtcttgaactcctgacctcaagtgatccacctgccttggcctccgaaagtgttgggattacaggcatgggccatcacacccaaccagttatagaatattctcagccgttatcttgtcatatattgcttctgtcttattctgtcttctctggcatgctaaacatatactagaccttctcattgtgttttctctgcctcttaccctgtctcttgtattgcttgtctttttgttttcttatctaaatacttggtagtttcttgtgacctatcttccacttgattaattttctctttagatttgcctaatctacataaacctatacgttgaaattttataagagctgagtcactcttatcctgagggtgtagcccatgggtcttctaatgtatggggtggctttcccacactcccctcattgggcagggtctgggctttgactttcttctctctctatactcccaggcctcttaaattatagcttaatttcatagatttttctttttctttttcttttttgagatggagtcttgctctgttgccaggctggagtgcaatggcatgatctcggctcactgcaacctccacctcccgggttcaagcgattctcctgcctcagcctcccaagtagctgggactataggcacgcgccaccgcacgcagctaatttttgtatttttagtatagacaggatttcaccatgttggccgggctggtctcgaactcctgacctcaggtgatccaccttcctcggcctcccaaaatgctgggattacaggcatgagccaccatgcctggcctaatttcaaaaatttttctttagaatttaatctgcaaatgacttcaaattgaaatcattttttatttttaaattttaacttttagcgacaggacttcatccccaggctggcctcaaactcctgggctcaagtgattctcccacctcagcctcctaagtagctaagacaacaggcatgtgccattgcacccagcagaagtgatttttttgagttctggtcttgtgtctctggattcttgacttcttacagaagtaattctttatttcattgctttgcagtcaataatataaaactaacacttagtgtgtgtgaactcttgtgtcactataaagtttacctccttgtgactttcacttctcatctgcttccttcttccttcctgcctataagtggttggcattggcgttgtcatcactcttggcctttaaagtcatttatttcctattctctgtttacttttagttaaattcagattaaatggaaagatttcttaaaattttatttttaagaaaggccatgagagggaaaacaaataaggtatattatcagtggtttcttatttcatacctgggtctagggataatttgacttagttctattcttcctctctaccttgtctgggtcttaaattgttaggttcctcctggtggtatgtttcacttgatcctggctactactagatgtgatgggattagtttggaatctacttcctaatatgttggccatggttagctaagtacttcatatatttatttatttatttttgagacagtcttgctctgtccccaggctcctcgagtgcagtagcgtgatctcggctcactgcaagctccgcttcctgggttcaagcaattctgcctcagcctccctagtagttgggactataggtgggtgccaccatgccctgctaatttttgtatttttagtagagatggggtttcaccgtgttggccaggatggtctcgatctcctgacctcatgatccacccgtcttggcctcccaaagcactgggattacaggcgtgagccctcacacccggcccccatatcttactcttaacatatcctttttctaaaaaactgcatatattgcaaagtattggagtaggaataatataactttgatactagaatctgctaagaagttagctagctctagttaacttaggagtcatttcaattctctgggcacttccaatttaagaattttatgtttgatgaactacacaaaaagaggaagccagatttgagatacaggataataaattccaaaaattccagttaagtattaatagtgtgaaagaatgagtggtggtattaaaatataaaccttcaggaacaaaggttctataggataaaatctgccaaaattatttccttcattttgtatatatatagccttttgggaacatgggttgcatacaataaaataacgatattagaaaaataccataggagcaagaaaagtaccttgttttgcccattaaatatactccgaagacagcagtgaggaaaataaaggtgaaacatttttctaaaaatagtctcagaataaggatggtgtctgttttctagtcctaactagatgagggagatagagatttgttattaaactgtttttttttttgttttttgagactcagtcttactctgtcgcccaggctggagtgcagtggcacgatcttggctcactgtgatctccgcctcccaggttcaagcgattctcctgcctcagcttcccgagtagctgggattacagggacctgccacctcgccgggctaatttttgtactttagtagagatggggtttcaccatgttggccaggctgttcttgaactcctgacctctcaggtgatccacccaccttggcctcccaaaatgctgggattacaggcatgagccactgcgcctggcccagaactttttcatcttcccaaatcgtaactccatgcccattaaataataactcccaggccaggcacaatggttcaagcccataatttcactattttgggaggccgaggtgggcagatcacaaaatcaggagttcgagaccagcctggccaacatagtgaaaccccaactctactaaaaatacaaaaaagttagccgggcatgttggtgggcacctgtaattacagctacttaggaggctgatgcaagagaatcacttgaaccgggaggtggaggttgcagtgagccgagatcatgccactgcactccagtctagtcgacaaagcaagactccgtctcaaaaaacaaaacaatgacaacgaaaaaacctcccaataactccccaggccctggcaactatcattctgtttttccatctctgtgaatttgactactctaggtactaatgtgaatgaaatcatagcagtatttgtccttttgactggcttgtttcacttagcatagtatcttcgaagtttatctgtgttgtagtatatgtcaaaatttcatttccttcctttttaaggctgagtaatatttcattgtatgcatataccacatcttgtttattcattcatctgttgatggaccctcgggttacttttaccatttggctattgtgaatagtgctatgaaaaaacaaatgctgctgctatgaaagtggctgtagtcttgcagtgcctgctttaaattcttgtggctgcagacccagaagttgaattgttggatcatattaaactgtactcttttgttgacctcctctcaggccttattaataagggacagctagaaaatagtggttcttttaattcacattctacaaaagctttagaagtcttagaaatcctgttaacatatgcagatgaactagtaatgacagtcaaattgcaactattacaaatagtattattggcccagtaagtaagaactaagctaccatgtaacttggcaagttacataggatagtctttttttttttgagatggagtcttgctctgtcacccaggctggagtgcaatggcacaaccttggctcactgcaacctccgcctcctgggttcaagtgattcttctgcttcagccttccaagtagctgggattacaggtgcccaccaccatgcccggctaatttttgtatttttagtagagacggggtttcaccatggtgagccactacgcccagccataggatagactttcatgttagtcaaaccgtaggttacttttagaatatcacacatttgctaatttgctatccagatttgctgtactagaattttactgtattctattttgttttgtttttgagacagagtctcactctgttgcctaggctggagtgcagtggtgtgatctcagctcatgtaacctccgtctcctgggttcaagcgattcttctgtctcagcctctcaagtagctgggactacaggcgtgtgccgtcacgcctggctaatttttgtatttttagtagatatggggtttcaccatgctggccagactggtcttgaactcttgacctcaagtgatccacccgccttggcctccgaaagtgctgggattacaagcatcagccaccatgcccagccagaattttattttaaaattgagtacatcagtacctggctgatttttgtattttcagtagagatggggtttcaccttgttggccaggctgatctcgaactcctgacctcaagggatctgcctgccttggcctttcaaagtgttgggattataggcatgagccactgcgtctggccaatatttttgatagagaaggggtttcaccacgttgcccaggctagtctcgaactcctgacctcaggtgatccacccgtctcaagtgattcacctgccttggcctcccaaagtgctgggattacaggtgtgagccaccgtgcctggcccagatgcattgtatagtcttgaggcatttataatcagacaaacagggactcagatgcctatggcacatagctgaggatggatatgctgatgggaaggtattatgatcccagaataagggagtataattaacttgttcattgtgtattgctcagaaagcagaattaagattactgtagattggctgggtgtggtggctcatgcctatcatcctagcactttgggagaccgaggcaggtgaatcactggaggtgaggagtttaagaccagcctggccaacatggtgaaaccccgtctttactaaaaaatacaaaaattagctgggcatggtggtgggcacttgtaacctcaactacttgggaggctgaggcaggaggatcacttgaacccgggaggcggaggttgctgtgagccaagattgcaccactgtgctccagcctgggtgacagagcaagaccctatctccaaaaaaaaaggaaacgattactgtagataaacaacctcatggccgggcatgaggtggtggtgagccaagatcacaccattgcagtctagcccgcgcaacaggagggaaactccatctcaaaaaacaaaaaactcagaacaattttgatacaatattattaggaataaattaaagaatgattagtataggatagcttggttttgaagcttagcaaaagagtttagagtccagggcagaggccttttttattttttatttttatttttagatagggtctcactctgtcacccaggctggagtgcagtggcgcagtcttggttcactgcaaactctgcctcccagcctcaagtgatcctcccacctcagcttcccaaagtgatgggattacatgcataagccaccacgcctggctgaggcgtgtttttaaataattaatcttgattagttttcttgaagtctaggtatgtggtaaaaaattttaaaaattatatatatatatatatatattggagacggagtcttactctgtcacccaggctggagggcaatgtcatgatctcggctcactgcaacctctgcctcccaggttcaagcgattctcctgtctcagcctcccgagtagctcggattatgggcgcatgctgccgtgcccagctaatttttttttttgttttttagtagagacggggtttcaccatgttgcccaggctttggtctcgaactcctgagctcagacaatccacccacctctgcctctcaaagtgctgtgattacaggtgtaagccaccatgcctggccccaaaattaaaattttttactagttaatatatagtacacaattcagaatctttcacagatatacagtgaaacatctcttctacatttctcccttatccacctggtttccttcctagagacaactgttaaaaagtttcttatatttgagagatatatctgcaaatacttatgtatattcaacccttccatttttaaaaaatgcaagtatattatataaactattgtgcattttgcttcttgtgcttaagatatttcaggaattgttttacattcatacatatagagcttctttgttctttttttcaaggctgctttgtatttcattgtatggctgaaccgtttcctgttgatggacacttagatggacagcagtgttttgttgatataaatagtgctatagtgaataatcttgtacataatgtcatttaacacacattcagatacatttacaggataaatccctagaagtggaattgcttttttcaaggatgtatgcatttgtgatttcagtagatatggccacattcttctccatggagaggaggaatttgtctcccatagtcaagtatggcaaggggtggacaggcatcagggtccttgaactctgtgaaatgataggtaaatatttgtgtgtgtgtatatacatggatgtatatttttctttagaaagagtccatggttttattacgttcttaaaaagttctttggggctgggcacggtgtctcacgcctgtaatcccagcactttgggaggccaaggcaggtggatcacgaggtcaggagattgagaccatcctggctaacatagtgaaaccccgtctctactaaaagtacaaaaaaaattagctgggcatggtggcaggcgcctgtagtcccagctactcgggaggctgaggcaggagaatggtgtgaacccgggaggcagaacttgcagtgagccaagatcgcgccactgcactccagcctgggcaacagagtgagactccatctcaaaaaaaaaaaaaaaaaaaaagttctttggccagggacagtggcgaggcccagcattttgggtggccgaggcaagaggaccattgagcctaggagtttgagaccagcctgggcaaagtggtgaaaccccatctctccaaaaaatacaaataattagccaggcatggtggcgtgtgcctatagtcccatctgcatctgtccgggaggctgaagtgagaggattacctgagtcttggaggtcgaggtcaaagccagagtgagttgtatatgcacttccacacttcagcctgggtgacagagtgagaccctgtctcagaaaaaaaaaattctgtgactcaaaataggttaaagaaaccactgacttatagttagttgacctgaattaagtacactgctttgtttttctctacacagtatttttctcttacagaaagtatttgagcagaagctatgcacataattattagagatgttgtgtggagaatcattgtggaagagactggactaaatctaattcccaaccttttactgttattcctcccactcttgagaccatgttttaaaaggctttttcccccattattagactgaatttattaagcagtactttatttctccaattttattaatgagagctttagatagtttgtggtaagttttactacagggagttgaaatcctttcatctattaggagttgatagaagttgagctaaagtcaagccaatctgacatttgtattgtattgtattcttttgagacagagttttgctcttgttgcccgggctggagtgcagtggcacgatctaggcttactgcaacctccacctcccaggatcaagtgattctcctacttcagcctcctgagtagctggggttacagtcccgtgccaccatgcccagctaatattttgtatttttagtagatatggggttttaccatgttggccaggctggtctcgaactcctgacctcaggtgatccacccaccttggcctcccaaagtgctgggattacaggtgtgagccaccgtgcccagcccaatctgacattttaactagattgtgtcagtgaaaaataattcagaaaccctcattattacctcttggacttactgaagatatgaagaacaaacctttatacctgataatgtccatgtttcttttgaattctgtgtgtgtaaaataggtttaaatgagggcttacattaaattctgcaagtactattgcaaggaaaatttcattcaccgtaacagattccttagggctttcaggttttgggatattggaattaatttgtaatatacatattatcaaaagttataattcctagtttttaggtcttggagagaaaacagtagcaccatgtaatgaattagaaagttaaaagatttagttaacttaaacatagttgatagtgtcgtagaaagcccccctttttttttttttttttgagacaaagtcttgctctgtcgcccaggctgtagtgcagtggcacagtctcgggtcactgcgacctctgcctcctgggctcaagcgattctcctttctcagcttcccaaatagctgggattacaggtgtgcgccaccacacccagctaattttttgtgtttttagtagaggtggggttttgccattttgcccaggctggtctcgaactcctgacctcaggttatccacctgccttggcctcccaaagtgctgggattacaggcatgagccaccgggcctagccaagccctgtcttttttactgtattattacttggtagctcattttgaaagaggatttttctagagatgattagaatattttatgtggggaaaagtgagttagacctgtatgtcttgcttgatactggagcaaaagttaaaaggtctcagctcttgatcagcgatttctttggtttatttgtttgtttgtttgagacacagtctctctctgtcacccaggctggagtgcagtggcgcagtcatggctctctgcagcctcaacctccagggctcacgagaccctcccacctcagcctccctgagtagctgggaccacaggcatgtgccactgtccccagctaatttttgtattttttgtaaagacgaggttggccaggcgcagtgactcatgcctgtaatcccagcactttgggaggctgaggtgggtggatcatctgaggtcaggaattcgagaccagcctggcgaccacggcaaaaccctgtctctactaaaaacatgaaaattagctgggcttgttggtgtgcgcttgtagtcccagctactcgggaggctgagacaggagaatcgcttgaacccaggaggtgcagtgagccgagattgagcttctacattccagcctgggtgacagagtaagactccgtctcacaaacaaaaaaaaaaggacggtgttttgccacgttgcccagcctggtctcgaactcctgggttcaagtgattcgcccacctcagcctcccggagtgttgggattacaggtgttaggcaccgtgcccagcctattttttacctactaatcgtgctcagtaaggaaaacaaagaaaattgttacatactctggaccagaactcaaggagccatttgttgtatagtattatttgtttgccaggcaaggtggctcacgcctgtaatcctagcactttgggaggccgaggtgggcggattgcctgagctcaggagtttgagaccagcctgggcaacatggtaaaaccctgtctctactaaaaatacaaaaaattagccgggcatggtggcatgtgcctgtaatcccagctactcgggaggctgaggcatgagaattgcttgaacctgggaggcagaggttgcattgagctgagatcgtgcaattgcactctagcctgggcgacagaacgagactcagtctaaaaaaaaaaaaagaaaaaaagaattatttgttgtgaaaaacttattttaacaagttctccaaagttttatttatttctaaaataaaagattagaacaaaattcttattatgggccgttcttacagaactttttagagtgccatttgctataatgggatcctgcttttactagcaaaccttttattacaatgaatttcctagatcgagtctttattattattattttattttttaaagagatgagggtctccctatgttgcccaagctggagtgcagtggtatgatcatagttcactgcagccttaaactcctgggctcaagtgatcctcccgcctcagcctgccaagtagggaagactacaagtgtgtactaccacacctggctaattgtatctttatatttaaaagaatggaaaaagatactgtataaacagtatcactaaatataaaaaagctaagtataaacactaagtataaaaaagctagagtgatttttattagacaaaggagacctcagaacaagaaaaatattgctaggagtaatgaagcatgattcatcacgaaagaaggatcaattttttgagaagacacagcggtcctaaatgtatatgcatccagtaacagagtggaagcaaaaactgacagttgaaaggagaaatagacaaatccacaattacatttggaaattacaacattgttccttaataactgatagaacaagcaggcaaaaaatcagtaaggttatagaagatttggacaataccctcaatggactatacttaattgacatttatagaacactctgcccacattcttttcaagtgcacatggaacatttaccaaaatagaccatatgctgggctacaaaacacatttcaacaaatttaaaaggattgaaatgtgtagtgtctactctgactacaatggaattaaattagaaatgaaaaagatatctggaaaatctccgaatatttgaaagtgaaataacatacttcaaaataacctttaggtcaaagaattcacaaaggaaattagaaaatattcatagctaagtgaaaatgaaaacacaatatatcaaaatttgtgagatactagaaaatatttgtgagccgggcatggtgactcacacctgtaatcccagcactttgggaggccgaagtgggcggatcacgaggtcaggagatcgagaccatcctggctaacgcggtgaaaccccatctctgctaaatacacaaaaaattagccgggcgtggtggcaggtgcctgtagtcccagctacatgggaggctgaggcaggagaatggtgtgaacctgggaggtggagcttgcagtgagccaagatcgtgccactacactccagcctgggtgacagagcaagactccgtctcaaaagaaaaaaaagaaaatatttgtaattaaatgaaaatgaaaacacagtatatcaaaatttgtgggatacagctaatacagtgctttagaaggaaacttcagctttaaaataaaggtctaaaatcagtgacctaacattttgccttaatagaaagagaaatctaaatagaagagaaataataaagagctaaagtaaatgagatagaaaacaaggccgggtgaggtggctcactcctgtaatcccagcactgtgtttggccaaggtgggccaattgcttgagtctaggagtttgagaccagcctgggcaatatagcaaaatacaaaaatactaaaatacaaaaatactggaagaaaaaacaaattaaaaaaaaaagaaagaatgagaatctgaataaccccatatttattacagaaattggattaaaaatcttcccacaaggccaggcacggtgactcatggctctagtcccagcactttgggaggctaaggcaggaggatcacttgagcccaggagtttgagaccagcctgggcaatatagcgagactcatctctacaaaaaatataaataaatgaaaattagtcaggtgtggtggtgcacgcctgtggtcccagctacttgagagactgaggtgggaggattgcctgaacccaggaggttgaggctggaatgcagtggcacaatcagtgtcacaaacaaacaatcaaacaaagtcttcctaaaaagaagaatccagacctacatggctttgttggtaaattctatcaaacatttaaggaaaaaataccaatttttttttttttttttacaaatttcacaagacatttatgaggccagcattaccttgataccaaaccagaccaagacattaggaaaaaagaaaactgtagctcaatatccctcaacatatatatagaaataattaacaaaatactagaaaattgaatctagcagtgaataaaaccataactaattggattatcccagttgcaaagttgatttagcattagaattcattgtaattcaccatattaatagaataaaggagaaaagctaagtggctttgtaatagttacctaaaaagcatttgactaactgttaacactatttgtgataaaagctctcagctcactaggaatagaagggaacttctttaatctgataaaaggcatttatgaaaaatatataagtaacatcatacttatggtaaaagagtgaatgctttctatataatactccaaacaagtcaatggtaattgttttcgcaacctctattaaacatgttccaaaggtcctagccaatgaaataagacaagtaaaaggaataatcttacagattacaaagtaaaagtaaaactatttattctttagatgtcatgattgtacacatagccttaagcaagctataaaaaagctactagaatttaagtttagttagaatataaatcaatttgcaagatctagttgtatttctcatactagcaatgaacaattggcagttgaagtaaaagcgaaaaagaaaagcaaatcatttataatagcatcaaataatgtgcaatgttaaaacattccccaagaacagaagaaattattttatattcttgtttcatggatgaaggcattcaggtgcaaaggattaaagaacattaatttgttcataagcatgtctttataaacatctatgtagtagatactgtgctagggatatagtagtgaataaaaacattgacccgtgccctcataaaatttataatctaatggaaattgaagggagaaataaatgtaggacctcagtttccggctttggcttaactttttttttttttttttttttttttgagacggagtctcgctctctcgcccaggctggagtgcagtggcgcgatcttggctcacggcaagctccgcctcccaggttcacgccattctcctgcctcagcctccccagcagctgggactacaggcacatgccgccatgcttggctaatttttgtatttttagtagagacggggtttcactgtgttagccaggatagtcttgatctcctgaccctgtgatccgcctgccttggcctcccaaagtgctggaattacaggtgtgagccaccgcaccgggcctggcttaacattttttatttagatgagtggttcaaagcttttactttttagttataacttttttttttttttttttttgagacagggtctcactctgtcacttaggctggagtgctgttgcacgatctcagcccactgcaacctctgcctcccgggttcaggtgattctcatgcctcagccaccctagttgctgggattatggacgttgtgccaccatgtctggctaatttttgtgtttttaggagagatggggttttgccatgttggccaggctgctcttaaactcctggtctcatgtgatcctcccgccccagtctcccaaagtgctgggattacaggcatgagccacagcatctggcctagttatatctttttttttttttttttgagacagagtttccctcttgttgcccaggctggagtgtaatggcgtgatctcagctcactgcagcctccccctcccaggttcaagccattctcctgcctcagcctcccgagtagctgggattacaggcatgtgccaccaccccagctaatttttttttttgtatttttagtagagacggggtttctccatgttggtcaggctggtctggaactcccgacctcaggtgatccacccgccttgacctcccaaagtgctgggattacaggcgtgagccaccacgctcggccagttatatcttaaatattgtgacttgttgaataatttggcccctatgggtggcaagttattttgttgtaatacatgcttggtagttcatagggtggttgaaactggttggttggttaaaatttcatgttaaggatggtccatgcaggactcccatataggggaaaagaagtaactaataatcttcattgagcaccaactatatttcaggcactgtattaccctcatccccaacatatagtactgttttatttaatccttgaaacatccataaggtaggtggtttttactcttgaaatccacagatttcaagaagagctaatagaacttcagtgatttgcccagtttcatacagtggttcagagatttagtcctacacctatttgactttaaactgtcaggaccagctgttctctgttgatcatacccttggaccatcccatgtgttcctagtcaggaggaaatgcaagtaaatgagattaattttttaggcagggcatggtggctcatgcctataatctgtgcactttgggaggccaaggtgggtggatctgtagagcccaagagtttgagaccagccagggcaacatagtaggaccccacctctaccaaaaaattaaattaaaaaaagccggacatggcggcatgaacttgtagtctcagctacttgggaggctgagatgggaggattgcttgagcctgggaggttgaggctgccagtgagctgtgatggcaccactgcactgagcctgggcgacagagtgagaccttatctttaaaaaatgtatatatatagtgctaattttgagtctattttattatttatttatttattactttgagactgagtctcactctgtctcacttagtggcgtgatcttggcttactgcaacctccgcctcgcagtttcaagtgattcttcttccttaaccacctgaatagctgggactacaggcgtgcgccaccatgcctggctaattttggaagtcttggtagagacagggtgttgctgtattgcccaggtctcgagttcctgacctcaagtgatccacttgactcagcctcccagagtgttggaattacaggtgtgagccactctgcctggccgtgattttattttaaaagtacgtcactcacaagaaaaaacactgtcaggatttcttgtcatgcacctcacagctgatatgtcaaaatgccagttttatttcttattttaaaattttgttttagaggcaggatcttactctgttgcccagactaaagtgcagtggtgcagtcatagctcactgctgtctcaaactcctggacttaagtgatcctcacaactcagccttctaagaagtgaagactacagtcatgcactaccatacccagattttttttttttttttttttttttttggtagagaccgggtctcactacattgctcaagctgtcttgaagtcctggcctcaagtggtcctcccgccttagactcccaaactgttgggattacaggcatgagccaccacatgcagctcaagacaccagttgtttttttcttcttcttttattctatttttttgtttttatttttgagacaccattttaaaaatgcttttaatacactgttttcaaatttttttgagacatattcttgctatgtcacccagaatgttgggtggaatgttgactcctgcatcttattgttataccaattccaggctggagcgcagtggtgcgatcaaggctgactgcaacctccgtctcttgggctcaattgatcttcctacctcagcctccttagtagctgggactgcaggtgcatgccatcatgcctggctaattatttattttttttgtagagatggggttttgccatgttgctcaggctggtctcaaactcctgggctcaagtgatcctcctgcctcggcctcccgaagtgctgggattacaggtgtgagcctccgcacccagtcaatacactttaatccaagtcagtgtctatttaaattttaagttagtttaactctgagccatgggcctgtaccttggaaatatgtaatttagagtcataagtaacagttatctagctgagagtcatatgtgggttataccaaatgtactgccatcatgtgattataggttagtagtgtaatttttggaattggcaggtcacagatgagattgccatggcttggtggaaagctctcccaactgtcttctccagacagataggtagaacctggaaccagtgctaggacgtgtgtgtatgtaggaggtagtcattggttatatgaacttaaagttgctatcttaacttctgggccttgaaggaaggccatattagtgacatctgcttagttctttatagtaaacttgttaacgcttgtgccacagtcaagaaccagaactggaatgttgactcctgcatcatcttacaccagttccagtaggaattttgttatacagtttctgctggagatggcagtgggattttttttcttttttttcctcatatgtgaagtaatagtctgttcacaacagaagaagccacaaaactaaacttattggtcactgaattttcttcaaggttacatacctcttgggtattttaaatctagattatgttcatttttatatttttgttctcatttttctatttctttgttttctttactgtgaatgtgctccaggattttgtacagagcttctagtttctgtctgtaatttaaatattgaatttgttctcgataaaagagaactttttagcataaagagaaagctaaaaacatagattataggccccataatgaaatgtgtagtagttgcatatggctagtgcttctctgtgtattggaattgtactgttttcccttagaatttgttttttctttaatgagtaattttcagttatataaagaatgtttgcatacttttataataatgagaactgtaatagctcattttccactcagcagatgattttggagatttactaggtagatgttgatacatacagacctagtttgggtcattgttctttaaataatcatcctgtaaacacatttatttacagtgttttgtcacttattgaaagtggggttttttttggcggggcgcgctgagtcacatctgtaatcctagcacttagggaggctgaggcaggagaatcgcttgaacccaggaggcagaggttgcggtcagccgagatcgtgccattgtactccagcctgggcaaaagagcaaaactttgtctcaaaaaaagaaaaaaaaaaggtaaactttttttcacttgacctagaactcttctgtttatacacatcaaggaagaacttaacagatttcacatctgtttcacttctaggaatgctgcaaggtctctgggagtcaaactattttgatggctattttgactctggtatggtatgaaaaggtagtactactagtgactaaaataaaaagcatagagacctttagtttttttaaatggcgttatcttctttactggagtatggggtagtttgactttgttggcagctatgcttctttatacctaggcaggcgtaacttttgtcttctgttctcagtcccttttaagcagccaatttggtctaaggaggaaatgaaaactttagaaactcagtaaatgttgacatttaaacttttacaggagtgaaagattaacctttggcctctattctacaagtttttcttagtttatatgagcctccttcgtggtgctaaagggctggtagtcaacatttgcatcttaacctcagtgttcatggatttataatttatccacagaattttctctaggcttgtaactaaagtattttttaagatccccctagaaaaaaaagtacattttaagtatattagaaacatgttttatttttgcaaactgtactcttttaaaaacaagaaacttgactcttgttcatcttctaaactgtccatttgatttttttacttagaaaattattatcagcaggagacaggggaggtagtttaaatgttgtcatagacaatataacttttatggagagatcttatcaaaattagttttgatttaacaaatcagactagttaaatttgtttaaatttgtgaaattaacaaatttaaaccagtaaattaaaaaaatttcctagtttttttttttttttttttgagtctgtgggtggctcttttaaaggataattttccctcccaagtgatatggatattagtaagcattctcccagatagctattatatagcaaatgacaagtaacagactattttactaagaaaataagataaaataccacatagttaaacttaaataatgtggacaaagaagcatttaatgtacaagagtatgaatttaccattcaatttatggttttaggaaaactagaaaagaggaggaaaaaacaataaatatgcaagaagaaataaatacattgcaaaacagaagaatgggaaataatcaagagttggaaaattaggaaacaaaaggcaaaatgaaggagagtacatcggatataacaaaaggtactgaggacttacaaaaagaaaatactggaagtgaatgttgttagttatatgaaagtctcaatgaataaataatttcaaagatactaggaattaatactgacgaaataagacataaaaatcagaataggggccgggcgtggtgtttcacgcctgtaatcgcagcactttgggaggccgagggcaggcggatcacctgaagtcaggagtttgagaccagcctgggcaacatggtaaaaccctgtctttactaaaaatacaaaaattagccaagcgtggtggtgtgcgcttgtaatcccagctacttgggaggctgaggcacaagaatcgcttgaacccgggaggtggaggttgtagtgagccgagattgcaccactgcactcctgcctgggcaatagagtgagactccatctcaacaacaacaacaacaaaaccagaatagactcctgtaaccaagaaaaaaattgaggcgattataaaactacttcctcctctctaggtgttggtgatttctcctaaccttttattttatttatttatttatttatttttcgagacagggtcttgctctgtcacccaggctagagtgcaatggtacaaacatagctcactgcagcctcgacctcctgggctcaggcagttcccctacctcagcctcccaagtagctgggaccacaggcatgggccaccacacccgggtaattttctaattttttgtagagatgggatcttgctatgctgcccaagctggtctggaacccttggggtcaagtaatcttccctcctcagcctcccaaattgttgagattataggtgtgagccaccactcctggtctctcctaacctttaagaagcggatacttctcatgttgaataatatgatagaagtaaacaactctgacagcaaaatgacaaacatgaaaaagtaaaagtgaatgtatagatgtttaaaataaaataaaaatactagtaaatggctacagcagattattcctttgttttgtttcaagtaggttatcctaggaatgtcaaacaagttcgtgtttaaaaactcagtaatatttctagagtcagtgctgtggtttgaatgtgttccttccaaaattcaggtgttgccagtgtattaagaggtgattaggtaaagagagctcctcctctcatgaatgggactaggtatccttttaaaggcttgatggcgtaaccttgtctgtttttacaccttgccatgtgaggacagtgtccgtcccctcttgcccttctgccttctactttgtgaggatgtaggattccttccctctggaggacacagtgttgaaggcaccatcttggaagcagagcctggaccctcaccagacacctaacctgctggtgccttggtattgtacttcccagcctccagaactgtcagaaattaaatttctgtttttcataaattacccagtctgctgggtgcagtggctcatgcctgtaatcccagcactttcggaggtagaggcgagtgtactgcttgagccattcgagaccagcctgggcaaagtggtgaaaccccgtctctacataaacacaaaaattagccagacgtggtggcatgtgcctgtaatgccaactacttgggaggctgaggcaggaggattgcttgagcccagaggtcaagactgcagtgagccaggattggaacactgcactccagcctgggtgacagagcgagaccctgtctcaaaaaaaattacccagtctcaggcattctgtcataacagcacctacagactaagtatggcttaatggtgagaagtactttttttgaaccagatagccttggttcagatcttggctttgcttcctaatgactgtgtgaccttgaatgagtttactgatcttcttatgctttcctcatctgtaagtgagtaataagagcagctacctcacaaggtagggcaaccataacagataccacagactgtgtggcttaaacaacagaaatttattttcttatagttctgaagactagaagtgcaatagcaaggtgtcagcaggtttggtttcttctgaggcctttctccttggcttgcagatgtctgcctccttcctgtggcctcatattgtagtccctctgtgtgcatacatgtctgtgcgtgctcacttgctctctctcattctttgtcctgatctcctctcataagaataccagttttaatggatttacgcttctatctccaaatacactaaagtactggagattagggcttcaacataggaattttgggaggacacagttcagctcataacaggttgttatgagggttaaatgccctgatatacctggccctagcaaatgctacctaagtgttggttatcattattattactttacaataataagtaatacataaaaccccaaaaactttagaaaaatcttttttatttcagagtaattagagattggcaggaagttgcacaaaatgtataggaaggttctgttcatgcaccgtgcatctctcctcatgtataattctagtatgttattaaaaccaaaaaattgacattggtacaatccataggactaattcacatttcaagttatacatgaatcatttgtgtgtgtgtattacacttctaggcaattttatcacatgtgtagcttgtaaccactacagtcaagttgcagaaactacttcatcataaggctctttcctgctacgcgtttgtagccacacccactcactctcccttgaaaacttaattcttgacaactacagatctattttcctctataatttcattatttcataattaatatatataaatggagtcacaaagtacacaaccttttattttgagacagagtctcaccctgtcactcaggctggaatgcagtggtgcaatcttagctcactgcagcctctgcctcctgggttcaagtgatcctcccatctcagcctccagagtagctgggactacaggtacacaccaccacgctagctaatttttaaattttttgtagagacagggtctcactatattggccaggctggtcttgaattcctgggttcaagcaatcttgctgccttggtctcccaaagtgctagaattacaggtgtgagccaccgcacccagcctacagctttctgagattggcttttttcacttggcataatttccttgaagttccaagattttgcatatataaataggccattcctttttattgctgtgcagtgttccatggtgtggatatagtacactttacttaaccattgcctccatgaggacatttggtttgtttccagtttttggctattatgaacaaagctactctgaacattcttatagaggtttttacaccaacatgtttttctttctctggaataaatgttcaagagtacaattgctgggtcaaatgataagttttaagtgcatttttagttttaaaagaaaccgtcaaaaaagctttacctttttacattctcactagcaatatatgtaagtgattcagtttctctacatccttgacagtgtttagcgttgttgctattttttattttaaccattcttaaaggtgtgtaatgaaatctcattgtggtttaaacttttatttccctaaaggctaacgtgttgaacatcttttcttgtgctcattagccatctttacatcacccctcctttttttttttttttttttttttttgagatggagttttgctcttattgcccaggctggagtacaaatggcatggtctcggcttactgcaacctctgccccctgggttcaagcaattctcctgcctcagcctcccgagtagctgggattacaggcatgcaccaccacgcctggctaattttgtatttttcagtagagacggggtttctccacgttggtcaggctggtctcgaactcctgacctcaggtaatccgcctgcctcagcctcccaaagtgctggtgagccaccgcccccggcctacatcctctttagtaaaatgtctattcatatttttttgccaattttctaattggaattctttagatagtctaatctcaagttccttggtagatgtgtgacttgaaaatattttcttccagtcagtaatttgtttcctcatcctgtttacagggtcttactctgtacttttgatgagcttccatttatcagtgtttccttttgtggattagagcttttggtgtcaagtctaggaactgttggcttagttctaagttgtagagatttttctccccttttttcctaacagttttatgttttacatttaagttcttgatctattttgtttttttctcttttaaaaatttattaattattattattattattattattattattattagagacgaagtttcgctctcgttgcccgggctggagtgcaatggtgcgatctcagctcattgcaacctctgcctcccaggttcaagcgattctcctgcctcagcctcccaggtagctgggattacaggcacccgccaccatgcccagctaactttttgtatttttagtagagacggggtttcacaatgttggccaggctggtcttgaacaccagacctcaggtgatccacctgcgtcggcctcccaaagtgctgggattacaggtgtgagccaccacacccggccgagttaatattttataaggtgtaagcaaggtgtttttttgttttgttttgtttgtttgttttgcctatgcatctagttgttccagtagcatttatttaaaagtctctttttttcaatttatgtaatttattaaattgcctttttttttttttttttttaaagagacaggtttttattctgttgcccaggctggagtgcagtggtgtgatcataattcactgtaaccttgcactcgcactcctgagctcccgcctgagccttctaattagctaggagctaggactgcagacagtgccaccatggctggctaactttttcatttttttgtacagatgggatctcgctttgttgcccaggctggtctcaaactcctgggctcaagtgatcctcaagctatcctcccacctcatgctctcaaagtgttgggatcacaggggtgaaccctattaaattgcttttatacttttgtaaaaaatcagttggatatatttatgtgggtctgttttttttgttttgttttgttttttgggatggagtctggctctgtcacccaggctagagtacagtggtgcgatcttggctcactgcaacctccgtctcctgggttcaagaagttctctgcctcagcctcctgagtagctgggattacaggcacctgccaccacgtccagctaattttttgtatttttagtagagacagagtttcaccatcttggccaggctggtcttgaactcctgaccttgtgatccacccgcctcagtcacccaaagtgttgggattacaggtgtgagcccaccgtgcctggccaagggtctgtttttataagctgtgacgattaaatgtgctaatatagaatgtcttgcctgtaaagtgctacattatgtgagcttttgaggattgtgtttaaaaaaagtgctacgtgttagttattattgttattactttacaacacagcaaataaataataatttttttttttttgagatggagtctcgctctattgcccaggctggtgtgcagtggtgcgatctcagcttattgcaacctccacctcctgggttcaagcgattcttctgcctcagcctcccaagtagctgggactataggtgtgtgctaccatgcctggctaatttttgtatttttagtagatatgggggtttcaccatgttggccaggctggtctcaaactcctgacctcaaatgatccaccacctcagctgcccacagttctgggcttacaggtgtgagccaccatgcccagtcaataataattaaaaaaaaaaaatttggataaactcaatagtcattcctactttgtaattttaaaaacaatacagtttcaaaaactttttaattgtggtaaaatacacataacataaaatttaccatcttaaccttcttttttttttttttttgagatggagttttgctcttgttgcccaggctggagtgcagtggcgcgatcttggatcaatgcaacctctgcctcccagcttcaaaccattctcctgcctcagcttcctgagtagctgggattacaagcgcccgccaccacacccagctaatttttgtatttttagtagagatggggtttcgccatgttggccatgcttctctcaaactcctggcctcacgtgatccacctgcctcagcctcccaaagtgctgggcttacaggcgtgagccaccgcgcccagccctgagccaccgtgcccggcccaccatcttaaccatttttaagtgtacagttcagtagtaaatacattcatattgtttgcatccaatttccagaactttttttgcctaggaaaatgaaaactgaaatgcccattaaacaactcctcatctctaccttcctccccaacccctggcagctaccattctactttctgactctatgaatttaactattataggtgcctcatctatcacaaagtatttgtcttcttgtgactggcttattcacttagcataatgttctcagggcttatccatgttgtagaatgtagaatttcatgtatacaccacattttgtttatccattcatatgttgatggatatttgagttgcttgcaccttttggctattgtgaataatactgccgtgaacatggttgcacagctatctctttgaggccctgctttcaactcttttgagtatattcccagaaatggaattgttgtatcatacgataattccgtttttgaggaactgccatagttttccatagtggctatgccattttatattcccatcaacagtgtgcaagtattccagttactccagatcctcactaatacttgttattttgtagggttggttggttttttgttttcttggtagtggtcacctcaatggatgtgaggcggtgtctttttgtgagttgcagtttcctaaaattagtgattttgagcatcttttcatgtggtcgttggccatttttatatctttggagaaatatctgttcaagtcctttgcccattttttcattgggttgtttattttgttgttgttgagttgtagcagttattcatatatttgggttattaatgccttaccatatatgtaaattgcaagcattttctcccattccatgggtttcctttttattctgttgattgtgttgtttaatgcacagattttaaattttgatgtctattttatgtatttttactgtttttatctctgcttttggtgtcacattcgagaaatcattgctaaattcaacgctgtaacactttctccctgttttcttcttcttttttttgagatggagtctctgtagcccaggctggagtgcagtggcgcgatttcagctcactgcaaactcctcctcccgggttcaagtgattctcctgcctcagcctcccaagtagctggaattacaggcgcccgccaccacgcccagctaatttttgtagttttagtagagatggaatttcatcatgttggccaggctggtctcaaactcctgaactcaggtgatccgctcacctcggcctcccaaagtgctgggattacaggcatgagtcaccgcgcccggctctccctgttttcttctaagagttgattatagttttagttcttttttttttttttttggctgtaaatttattcaatgcaaaagaatcctctccagttttactgaggtggctgaccacgtccacaaccaaatccgcctctaaactagaattcggttgctgacccagccccagcctcggctttcttgtcggcaccaggtagcacagcactcctcatatacagacctttaggccgaggcctgccagtctctggacggctacggcgtagggtggcaggcacaatctccgggggcagatgaaggtaatcacggagatactggatacactcattggtaaggtaccagtagaaatgtctccaggcaaagtgttctttcacgtagcctcggcacttgagagactgcatggccttcatgacatgaaggttgggcacattcttgtctgccagctccgggtgcttaggcatgtggacatccttcttggccaccatgactccctccttaaaaaggagttcataaatggcaatccagttcttcttaggcatcaacatctctgcagctgcagggtccggggccggggctggaaagctagttttagttcttatgtttaggtctttgatgtgttttgagttaatttttgcatgtggtaatggtccaactttcatttcatttgcatgtacatatccagtttctccagcaccattttttgagaccgtctcactctgttgtccaggctggagtgcgctggcagtaatctcagctcactgcaacctccaccttgcaggttcaagtgattctcgtgcctcagccacccgagtagctgggattacaggcgtgtgtcaccatgcccagctaatttttgtatttttagtagaggttgggttcgccatgttggccagactggtctcaaactcctgacctcaagtgatccgcctgcctcaccctcccaaagtgctgggattacaggcgtgagccaccatgccagcctccagcaccaggttttgaaaaaattgactttcaccattgaatagccttggcaccttatcaaaaatcatttgaccatgtatgtgaggatttccttctggcggtccattcttttccattgatatctgtctgtctttaatgccaataccacgatgttttgattactatagctttgtaattttttattttttattgatttatttatttattttgagacggagtctcgctctgttgcccaggctggagtgcagtggcgcgatctcagctcactgcaagctccaccttccgggttcacgccattcttctgcctcagcctcccaagtagctgggactacaggcgcccgccactgcacccagctaattttttgtatttttagtagagacggggtttcaccgtggtctcgatctcctgacattgtgatccgcccgcctcggcctcccaaagtgctgggattacaggcgtgagccaccacgccggccgaattttttaaaattaattattattattattttttgagatggagtctcactttgttgcccaggccggaatacagtgatacaatctcagctcactgcaaccttcacctcccaggttcaagcgactgtcctgcctcagtctcccgactagctgggactattggtgtgcaccatcccgcccgactatgttttgtaattttagtatagatgggatttcaccgtgttggccaggctggtcttgaactcctgacctcaggtgatccgcctgtctcgacctcccaaagtgctgggattacaggcgtgagccattgcgtccggcatgtagtaagttttgaaatcaggaagtgtgggacctccaacttagttctttttcaagattgttttgtccgtttggggttttagcccatttatgcttagtgtttcattattgggttgctaagcttgtggcagttattgatatcctactgttcaaggtcatcaccaaggtctgatttttcacagaaaaaatttgcaacctcgggcataaatgggttaatatagtttttaatggtaaagcattagaggtgttaccatgaaaatgaagaacggaaaaatgttttctatgattattatttcatgttttattcagtgcagtaaaatgtaaaacaaataagaggtataaattatagaaaggaagataaaaccttgttatttacaaatgctatgattttatacctagacaactaaatggaaaggaacaaactgggcctggtgcagtggctcatggctataatctcagcactttgggagtctgaggtgggcggatcacttgaaggcaggagttccagaccagcatggccaacatggtgaaaccccttctctactaaaaatacaaaaaaattagccaggtgtggtggtgtgtgcttgtaatcccagctacgtgggaggctgaggcggaagaattgcttgaatctgggaggcaggggttgcagtgagctgatatcacacctttgcactccagcctgggctacagagcgagactccgtctccaaaaaaaaaagaaagaaaggaaaagactgaaaatgattaagaagaacaattcagtaaagtgactggctaaataaaaaccatgaaaattaataatttctgtatatcagcagtaacataaaaataggaaaaattgcttttaaaattaagtaataaacatgtttttattttactcataactgttttgttttgagacaaggtcttggctctgtcacccaggctggagtgcaatgtgcagtggcgcgatcttggctcattgcaacctctacttctcgggctcaagcgatctgcccacctcagcctccaagtagctgggaccacaggtgcacaccaccatgcctcgctaattttttgtatttttggtagagatggggtttcaccatgttggccaggctggtctctaactcctgagctcaagggatccacccaccttggcctcccagagtgctgggattataggagtgagccactgctcccagcctgttttgagttaatttttatgttgatgtgaaggaagggtacaacttcattgttttgcctgtggctatctactcctggcaccatttgctgaaaagactattctttccctcgttgaattgtgttggcacccttgtcaaaaatcatttgaccacaattatggatttattcctggactctcaattctattccattgatctaaccttatgctagtactgtactgtcttgattactgtggctttgtttttaggtgatgaagtatgagccttcctgctttttcaggattggttcctagcaattccatatgcatgttagaatttgcctaccaatttctacaaagaagtcagctggggccgggtgcggtggctcacgtctttaatctcagcacttcgggaggcggaggcgggtggatcacctgaggtcaggagttcgagaccagcctggccaacatggcgaaacaataataaattattattgtttataatataaaattatttcttcctcttgatgctactgtgtatggaattattttcttcattttcagattgttcaattgcaagtataaaaaaatggatttttgtctatcagtcttgtattctacaaccttgctgaactagtcattagttataaaacgaaggctccttgtggctgttttatgccctgggtctctcctacaaactagccagtctacagtctaggctgtatcttcattacatccaggaacctctttccacttgcgtagtaccacaacccctattgtttttgggaacacccttagactgaaacttgtcacactcttgcaagtgaagttaggtcctttgagatactctgtgttcctgcttcttcccttaggcaaagtatctgagccagggttctagtggtagactaggtggggacaatagcaagcttttctgtgaatgctaccccagctctaggagggtatggggcaggtcagcagcctggggtcctcttggcttgtctctcctgttgtggaaccactgtcccatgagctgggagagagggtcgttggattcccagtattctcagtgtgtcatgcctatgaaagagccccttttccacaagtagggattgagcagaagaagggagcccctgcctctgagagtacttgcctgagacagcctcagcaacagaagtcagggcaggatgagaaacactgaagtcgcattcttcccaggaataaagaaagccctcagggatgggtgcggtggctcacaactgtaatcccagcactttgggaggtcgagacaggcagatcacctgaggtcaggagatcgagaccagcctggccaacatggtgaaaccccatctctactaaaaatacaaaaatcagctgggcgtggtggtgggcacctgtaatcccagctactcgagaggctgaggtgggagaatcacttgaacccaggaggcagaggttgcagtgagccgagatcacgccattgtattccagccggggtgataacagtgaaactctgtctaaaaaaaaaaaaaaaaaaaatcatcaggcttcttcttcagttttgctatcctcttaggattaaaatttatttatttatgatttttttttctttcagggaccacttaatagtgagtcttccaaccagagcttgtgcagcgtcggatccttgagtgataaagaagtagaggtaagaagctatgttcatggcaggacttttcatacttgtacgtttgggccaggtttggtggctcaaggctgtaatcccagcactttgggaggctgaggcgggcagattgcttgaggctgggagttggagaccagcctgggcaacatagtgagaactcgtttctacaaaaaaacttagcagggtgtggtggtacacacctgtggccccagctacttggaggtcggaggatcgtttgcacccgggagaatgaggctgcagtgagctgtgatggcaccactgcactccatcctgggcgacagagtgagacccccatctcacagaaaagatagcactgcttaattaactccctgggtgctgttagactctgtgtaaattgctcccctttgagctgtgtgctctttgcatacgtacagttatgatgtggccctcacgggtttttattataatcatgtgtggatcttacatgtcttaaaatttttgcatagttgccatcagtaaaggatagaaatttgcaatattgttcctgtttaaatggaagataaaattgattgactgattttatttttacaacttttttcgagacatggcctcgctctgtcatgcaggtcagagtgcagtggtgcaatcatagctcattgtaacctgacactcctgaactcaagcagtcctcctgtctcagcctcctgagtagctaggtgccaccgtgcctggctaatttttaaaaatatttttagaggcggggccttgctatgttgcccaggctggtctggaacccaagccatcctcccacctcagcctccaaagtgctgggattacagacatgagccacagtgcctggcgaagactttttgttcatttgcttaactattcacagccctcatgcatgagattttttttttttatttggcatataacctagctgcctgtagatgggtctaagtgtaagtctgtagccacctactttgtactttgcagatctctcctttttggaaaaaagattggatttaaagtagaagtagtgtaacaacagttttctgagaacttaacatatggtggacatttgtcctacatttgtgctctattaaatatcttatgaaggttttgtagcagctctgatttacagatgaataaactcaagctctgatattttaagcagtttgccaaaaattgtgtggatggtttggttctagaccctaatactctttgttatactcagttttaagaggaagacagtgattcaggacttgtctgggccagttatatctgtttatatattcaatattttgtgtatactcgctgtttttcctaacgtgaaaaatttaccaaaatgctaattgtgacttatatggtatttgacagactcccgagaaaaagcagaatgaccagcgaaatcggaaaagaaaagctgaaccatatgaaactagccaaggtagtaataatttcgtatcaacaaaagtactcaattctaatgtacttagatagaattttctaactcatactaaataattagtttgtacacagggattcctgataaaggaggtttgtgtatcttaagggaatatcagactgtttattacagacttgccatttggtatacacctgacagaacagtgttagttcttcggggactcttttgttttccctgttgtaagctaacaatcttcttaaccacaggtttttctttacaccaaatatatattgtacaaaaaagaggttatgtcagagttttaactcttgtcttttgttagatcagtgatttgttaatgacagccagctaaaagtgcttcatttacattactgtcctttctgcctactgttcttccgtggcagttgtttagttgaatattggaacccattgggataaatctgtaaacatgatggttataatgccaaatatctttatataatcaaagaaagaaaaaatggcttggctttttttcctcccattctaaggaatagaaagcccagtcttgttgcatccttcttatcttttaaaatctacagataattcattttgtctttgggagcaaaattctcccaaagtgacaagaaaaattacagaatcttaaagctgtgaaaaattcttcctttcactgcttgttcagtcctttattttatggaggaaatagtctgttcttgggctaaggtattttggctcatttgttacaagtaaagctgacacttgggtttatagcaatgtatgtagttactgaatgtatagtacattttagtgaatgatggtttatatgtgtattggaaaaactgtatttactttggtttcattttcagggaaaggcactcctaggggacataaaattagtgattactttgaggtaagttacattttttgaaaaaacaaacaaacaaaacaaaacaaaaaaactctatagtgattttttttaaaaaaccctaaatccttgtgttcatttgaggctttagaaagtaatattttggccaggcgaggtggcttatgcttgtaatcccagcactttgggaggccaagatgggaggatcgcttgaacccatgagttcgaggccaacctgggcaacatggggaaaccctgtctctacaaaaaacagaaaaaattagccaggtgtggtggcacacacttatagtcctggctacttgggaggctgaggtgggaggatcacttgagcctgagaagtcgaggctgcagtgagccatgatctactgcactccagcctgggtgacagtgagaccctgtctccaaaaaaaagaaagaaagaaagaaagtaatgttttgcctttactgtactcttcttccctttctccccatcttcatcagttaatgctgccccatctctcaataagagaaaactgctgctgccttcctaaatttaaatttattatgtgtcttgtctgtgatgatataagaattcacaaatgaggtgatttttctcttggccagacgaggttttgtgtcttacaaagattgaggtggaatgacttggactcttcttttgtcctcctccctttagtacagtggaacatgtagtgagttccctgacccatcgttagtggttactaaagacactaacatccactgcaccactgcatttctgcttcgtgtatttggagacaagaagggaaaacattcttctctcatgtcctttcaaaatcatgtataccttcagctttctagccatgttttctttatatcttggtatatttctgctggagctccttcttaaaaatctcattaaaaattagcagaatttgacttgtgtggcattttctctctagagtaagatgtgttaacttaaaggggccatataattaagatctgtttgtgtattaatcttttactctccttatctgaagcatagtactgttttgaattattcatatcggtttttccctgttggccagtttgctgggggaagcgcgccaggaaccagccctggcagaagtgttccaccagttgcacgatcctcaccgcaacattccttatccaatcccttaccggtaagcattcacctggagaaatttgacacctgttgtaggagacaagatgcccagaaacactcaagcaaagtttctctttcattaattacccacagggaatgaagcattagggagaaaagttcatagttttacctatgaatcccttactttgattcaaatctgttgtcagtaaattagctttttacagaagagccaatcctaatatctctatataataaattacctctaatcctacagctcagtagtctatcaaagaattgattccaatcgaaacattaggttttttcccttgccaaatttgtatgttcctttagggtttatttttattttaaaatttgaccagcttctggcataattgagttatctccagagcttattcagtaatgtactagaaaaactaatgctatgcagatttgtgataggtatgtttccagcctgtaaaagagatctgaaggtcttaaaaacattatacctaagttaatggttctcagttggtggcagttttgcccctcaggaacatttgtgaataactggagtcattattggttgtcactgctcggaggtatggggatgacactataggcatctactgggcagaagtcagggatgctggtaaacattctgtaatgttaggacagcctccctgcaaagaagaattacctggtccaaaatatcagtggtgccaaggttgagaattcctgagtaagctaacataggattatgtttatttgctccagtgtcttcgcattatttgttgatactgtgtaagacctcttactcaagagtgtgctctatcccctaataccttaggtattgcctctgggatcttgggagacagggtctctgggacagaagtttttattttagatcactgatttttaggaaagttgtttttctttgccttggtagagttgtgtaatagtactcatttcctaagcgatttaggcttctgtattgttaaagtattttaaaatgtactttctccccctctactgtctcataaaaaccttcattaggattattgtaattattaaagcacttatgaaaacataagttaaacttatgaaaacaactaagaagttttggctattactgtgtcatccttgccatatatatgtaatttttttttttttttttgagacagtcttgttctgtcactcaggctagagtgcagtggtacgatcatgactcacagcaacctctgcctcgtaggctcaagtgattctcccaaatcaacttcctgagtagctcgtagtacaggcatgtaccactacgcccggctaatttttgtatttttttgtagaggcgtggtttcaccatattgcccaggctggtctcaaactcctgagatcatgtggtctgcctgcctccacctcccaaagtgttgagattacaggcattagccattgtgtcagaccatccttggccatagtttaaaatgttagaaatgtttgtttgatcatagatccaatttgggcaggttgaggtttgttagttaactgttgaagaggcctgtgtctctgtttttcttaagtttcaaaccaattaaagtctaaaagatattaaatgagattgcagattatctatttgggacagatacgttttgtagaatttctcgatgttgtctatcactcttttcttcctgaaatgcctttttcatttggtttttaatggtgtgaccacccatctctcatgtgtcagtttaggttgaatcttacctgaagacaaaagagatgaactcaatgatctgtagacatttttgccagctatatgaatgtggctgagcctcatcatcatgcaaatctgagtatagatgaggtgttaaaatagaaaccaaagcttaatcctccaccttttccttgcctgcctctaggcaactcagcatggttggaggaaaacacatacaccaaggtgactgactgatctggtcatgagcactggcctcatgtatacctctcactgcctgccagtcctactgtatttctacttagttccctttcctccatgaatatgtcctatttttgtcatctcctgcaaacctccagcaattcttctgctaactgatggccttccttttttatgttactgagaaaatagaaacaatcagaagagcatttccacatgctcctactgcagatttgccaagctccttgcatcagtacccacatccatctgcctttgagatgaatgaacttgctagcccttcacatggggtctggtctccccaataattatgtatccagctgtctacttgacatttccacttgtactgcttgagcatgtccaaaaaggaactcttgctttcccttccctaccataacaataacattgaactgctcttcctgtaatctgccttgtcctggtaaatgacaggttacaccatctggtttttcaggtcacagcctcatgccccaaatgtaatccatcagaaaatcctgtttttcctttaaaatatattagaatatgaccacttttctatttttccagttcactgcattagctttcaaagtagtctccttgtttttgcccttgtttcacctagtcttaatgtaatagcccgagtaattgttaaaatgttcagacacatcccagcactcgtctgctcaacacttcctagactgaagtctttatgtgacctaaaagctcctgcgtgatctgtgcttcccatcgtccacctgattctgacatctgcagccattctccctctccttcatgccactgcagccacactggcctccttgagctctgtgaaaaacgcttttgctatagggtctttgtacttgttattccctcttccaggaacattcttttctcagataccagcaatctcttcatcaggttgttgctcaaaaatgaccttagctaagcggtctcccttagccaacttctctaaaatagcagtccctcataccttgtcaatttgttcctaactgtactttattttaattctaagttattggcacttgacacacccatgtacatacattttaatatatatttaaatttttttgttgattcatatttatacgtacagaagagtacacattgtaagtctacagttcgcatgaattttcacaaactctacaagcacaagaaatattaccagtgctgcagaagtccccctgagttccctttcagttactaaccccctccctgccgctgtggctagccactagcctgacctctaacaacatagatgaatttttttttgtatcttgtgtaaaagacattcagtgtatactcttgtgtctagctccttttgttgcacgttacttttgtgaggtttatccatttcattgtgtattttataggtcatttattttcattggtgtgttataagtttaattttcatttaataatttatatattttaattttgtactatataattagttaattgcccatcttccgactagattttttttttttgagacggagtttcgcttttgttgcccaggctggagtgcagtggtgcgatcttggttcaccgcaacctccgccttccagtttcaagcgattctcctgcctcagcctcccaagtagctgggactacagacacgcgccaccacgcccagctaatttttgtatttttagtagagacggggtttcaccatgttggccaggatggtctcgatctcttgacctcgtgatccgcccgcctcggcctcccaaagtgttgggattacaggcatgagtcaccgtgcccagcctagaatgttaatctcataagaatggggattttgctttgctttgtttactgctgtctcttgttacataaaggtgtaatttttaaactaatttcccccacttgacatgtaagcaataatgtcttatttcattttcagtctccagcatccaaaacagtgcttgggacacaataggtgttcaaaattgtgctgacagggaagaatagatggataaaaaattattttcacctttttccctataaaagattattttgtatttgtgttaaatataaaaaataaagtatgtaaaacatgaaagttttcatgcaggagttggcaaaagacaggtcacagctggcaagctaggaatgatttttatttttttaaatttatttcattttaatttatgttatttttggagacaaagtctcactgtatcccccaggctggagtgcagtggcgcaatcttggctcactgcaacctcagcctcccgggttcaagcgattctcctgcctcagcctcccgagtagctgggactacaggtgtgcaccaccacgcctggctaatttttgtgtttttagtagacacgaggtttcgccatgttggccaggctggcctctatctcctgacttcaagtaatccacccgcctcagcctcccaaagtgctggaattacaggcgtgagcaactgcgcctggcaagctcggaatgatttttagatttttaaaaggttttagaaacgaaggatatatgacagagactgatgtggcctgcaaaacctaaaatatttgtctggtccttcacaaaaaagctctcagaaaatcactataaagttaactctatgtaattgttacataggaaggtagactatttccagcagctggaaacctacatgctgttccctgatcacaactcccactaccctagaagtgatcacttggctggtttttgtggtaatcatttttgttttcgtgtagtttaaactatccatgtctgaatccataaacaaaatagttcagttttgccagtaggtaaactcagtgtttaaatcttaggtatttttatttttggctgttctatcaattattaagagcggtgtgtatatttgtatctctcgctgtgattgtggaagttgtctgtttcttcttacatttatattaaattttgttttatgtattatgactctcttcatctctttaaagctctttgctttattttttaattttaatttttatttttgagacaggttcttgctctgttgcccaggctggagttcagtgcacgatcttggctcactacaacctccgcctcctgggttcaagtgattcttgtgcctcagcctcccaaatacctgggattacaggcatgcatcaccatgccgagataatctttttgtatttttagttgggttttctccatgttggccaggctggtctggaactcctggtctcaagtgatctgcctgccttggcctcccaaagtattgggattataggcatgagcccctgagcctggctgaagccctttgctttaaatgtggtttatctgatatttaatatatccaaatcattgtgaggtataactatttccattcttaatactgtcaaatttgcattatgttttctatcttgggcaaataccatataattagatttttttctcttaagtctaaaattttttattatcctatttacattcaatataattaccaccacattcagtttagatatatcattgtttaatgtgttttttatttatcttgcctgttctgtgttcctttttctttaatttcttgcttccatttagattggattttttttttaagtcattttctgttttcctcctctgctagtagctaggctgtctttggtgtttctcttagaaagtaccacataccgccgggcgtggtggttcacgcctgtaatcctagcactttgggagacctggggacccacgtgggaggattactcgagctcaggagttcgagaccagcctaagcaatatagtgagatccctgtctgtacgaggcaggcaaatcatgaggtcaggagttcgagaccagcctggccaatgtggtgaaaccctgtctctactaaaaatacaaaaacttagctgggcttggtggcaggtgcctgtaatccctgccactcaggaggctgaggcaggagaatctcttgaacccgggaggcagaggttgcagtgaaccgagatcacaccactgcactctagcctgggtgacagtgcaagactgtctcagaaacaaacaaacaaacaaacaaacaaaaaacaacatttaaaaattagccaggcatggtggcatgcaccttgtagtcccagctactcaggtggctgaggtgagaggattcctcgagcctaggaggttgaggctggagcgagccatgatcacaccactgcgctccatcctgtagcatagagtgagaccctgtctcaaaacccccagaaaagaaaaaataagaataaattaccacatgccaaaatttgaagtcagttgtatcttcatcctctaccaaataaaataatgtccccagaacactgtttactctgctactgatttggtggtagtggtgtatgtttttattttgcctttttttggtctcataaaatattactgttcagtgctatcagtgttcgtttaggtttatctatgtatttacctctttgtacttctttcctttttgcatcctacaccttccacctggggttgctttccttctgcctaagtattcctttagtattcttctagaatatatctgctagagattaactctctaggtttttgtttactgaaataactttattttgctcttattcctgaaaggtatttttggctgtgtatatttttaggttcgctttctttttttttcttttaacacaattgagcagtaattcattaccatgttctaaccctccattgttactattaagaaatcagctgtcatttgcctgttgtttctttgaaggtatctgctttttttcccctggctgctttaaaagtctttagctatggtgttctgtagttttatgatgatgtgtcatttcatttctcttgcttgtgatttcttggacttctggaatttgtgggttggtatctttcatccgttctgaataattagccattgtctctttgaatattatctctgacttgttcttttttccttctcttatgaaattctaattaaccatacattatactttctaattttattaccatggcttttgactttttttgtatttttgttcttcttgtctttatatactccatcatggataatttcttcttgcctttcagttcccagatcctgttttattgtttctaatttgctattagctctattgaattggttactgccttttgaagaaaaagaattacatttcctgcagatattttcaagcctgtcttttattttttaaaatatggtagacacaattattttataatctgtttgataattctagcatctgaagcttttatgaatctgtttctggtgtcccttgtttttcttagttgttgttcatggctttatttcttttatgctttgttttttaactgtgtactcctcattgttcttgaaaaattttttggggggtttcttcaagatctaggatgaatgaagatgtgttaattcagggaaaatttttatttgctccttccgagtacctagagattttacctcttttatataccactttagtgaatttatggcttatattttgtttagtttattttgtttgcttatttcaactgctaggaaatattgatttggattgtgtcaacatttctcaagacaacccccaactcttacactgccaaggcaacttcctggcagccatctgagggtgggggtaatttttcttttggtttaccctttccttgagaatgtaggtagctctttggaggcccagcttgaagtgggaagggtttcctattgaaccctctcccttgggtgggctttggtctgtgactatctgcttgataccatgttgccctgaaaatggaaattcaagatctgcaagtgcccttaggccatatgtggctttggtacttcttttacctgtcttatgttcctaatttcccttagattttgctctggcagatccctaatactttatcaactcttcagtgcttttaatgtttttttgttgttgttgttgttgttgttcgcccatattttatcctatctgtatagtttttttccccccccagggagacgttggttcaaacaggaaaggctgtagcctacatagtgtatttacagaaatgtttttaaatctttcaatccttggcaggtatttattgaatatatggcagaaggtttaattttactgttgcagctcgttctcccatgcagtgagaatgttgtcatcaatgggtatcacaggtgttctggagcctgggtttaaactgttacatttgctggggtaggactctactcatagattcaaaaactaatttctttgtcaggatcattttacttttattttttttgacatgaaaacgttaaagaactattcctgattaaggaaaattatttcctttattcatgcagattatgaaagttcaacaattcagaaatggtgaaatagaaagttccctccaaaagaactgttattagagagtatggtgggcaaatatttctagactttttgagatatacatgtatgtttatataataggttttcttatttccattgtattagtttatttaaccagtatcttgtaagcatttatatctataaatagtgctgcaatgaacatccttatacatacttattaacttacgcatttttcctagataaatcccctaatagtaattcccaggtcagaatatgatcatttaaaaatgtcatcacataaattgctagaaggttattagcagtttgagagtaccaattttttcacaccctgctaataatactgaattttatcattgtaacctttggcataaagaaaaataccttgttttaacttgcatttgttcattagttatgtatattaaacatcatatgtttaatggccttttggatttctcttttaatgcttgttcaggtcctttgcatatgtctcttttgaaatacttgtgtgttttggtttttgttttactgataggtaaagcattatttattaagatttaataaattatttatattattaatttgttatattgtaaatatttttgcttgtttgtaatcttgtcttttaactttatgttgacttttaccattcagatgcaaaaaaattgaagtagttaaatttatcagtgtttttcctttatgacttatgggatttgtcttattcttagatgttcccatatggtgtattcctatacggggtgtgtgtgtgtgtgtgtgtgtgtctgtgtgtgtgtgtgtaattttttttttttttgagacagggtcttgctgtgtagcccagtgtgtgtgtgtctgtgtgtgtgtgtgtaatttttttttttttttgagacagggtcttgctgtgtagcccaggctggagtgcagtggtgtgatcttggttcactgcagcctctgcctcccgcgttcaagtgattctcatgcctcagcttcccgagtagctgggactacaggcatgtgccaccatgcccagctaatttttgtatttttagtagaggcagggttttgccacgttggccaggctggtctcaaactcctgacctcaagtgatttgcccatcgcggcctcccaaagtgctgggattacaggcatgagccactgtgccccgcccatggtttatatttttaatgtcatgtttaaaaagtcctttaccactagaaaattctaaaagcatttgtttattttttcttcttgtaattttttatatatgataaaaggtaggaatcttcttttccctttttttctaatatctgcacaaacgtcctaccatctttttaataagttcccgctaatatgaaatgcacattaatcacaacttatatatctatattatatagatctgtttctgaattctgtattctgtgccactggtcaatctgtctgcttctgtatctgtatgatactgttttagttaatgtaacattgtagtatgtttcactatccggtcaagtttccctgatactttttctcaaaaattatgtggctgattatgattatttttttaagtgaaccttagaatttattgtgaaattctacaaaaacaactgcccaagaaagcatgagagagaacctagatgaccactataccaccataagactaccccttggaagagaaaaaggccaaacacaaaatttaaaacattaaacttgggttttagagaaatttgatgtttgtagaatctgaacccaggaacatgatattaccgtttaacttagatcatcttttatattcatctgtgaagctgtatagtttttcttcaaaggtgttctgcatgtttcttaagtttgctttcaagtattttacagatttttgtttgctactttgaatctgcttttccttctgttacatgctctgattaaaatcagttggggaagctatcaattttagtgtatttattttgtatttggccatcttactgagctccttttaattgttatagtaatttttccattgatttgcttggtttcctttgtgaatggttatatcatccaaaaatgacactaaaaatctttaatttctaatatttttacttcatttttttcttttttacattggctaaaactttcataataacgtttaatatgagaatgtgttacttttgtcttgttttctagctttaattgaaagggtctccagtcttagcaccattaattatgatattttaatttttgaaaaacatactcttcattgcattaaaagtggataattccagtcttttttttttttttttttttttttggagatagagtcgctctctgttacccaggctggagtgcagtggcgcaatctgggctcactgcaacttccgcctcctgggtttaagcaattcttctgccttagcctcccgagtatcttggattacaggtgcccacgaccacgcctggataatttttgtatttttaatagagatgggtttcaccacgttggccaggctggtcttgaactcctgacttcaagtgatccgcctgccttggcctcccaaagtactgggattacaggcatgagccattgtgccttgccaattccagtcttttaagagttgcctaacagtgtgtgtatcctttttggtatccaacaggaagaatcttaatttatccctccctaaagttaatgtaatgaattacattagtagatttgctaatgttgaatcatttttaggtttctggagtgagttatgcgtaattgtgatgtattatccttttagtatactgtggaacttgttttgcttgcatttattttagatttttgcatctaaatatagtacagcaagaacagaattgagagtgaaataagcttcacctataaagtcacgtgacaggccaggcacggtggctcatgcctgtaatcccagcactttgggaggctgaggcgggcagatcacctgaggtcaggagttcgagaccagcctggccaacatggtgaaaccccgtctctactaaaaatacaaaaaaattagccaggcgtggtggcaggcacctgtaatcccagctacttgggaggctgagacaggagaatcgcttgaacccaggagacagaggttgcatgcagtgagagcagagactctccattgcactccagcctgggcaacaagaatgaaactccatctcaaaaaaaaaagaaaaaagaaaaaagaaaaaaaagtcatgggacaatgtcttaattttcatttacctacaggatagaaataatatttcctgtgtagggttgagggcattatgaagttgatttgtagaattctacaaagtaacatgtaaattcagactctcataaatatagaaccattaaaatataatgtcaaagaatttgagtaagatagtcacatttttagataggttataatacaatgataatgttggtatgctctccataattatttttagagaggcctttttaaataaaccattcatcttatatttgataactgtttttaacccgttgcatgtttgggcagtatcagattatctttctcatgtcatttgtgtgtttctttactgttttccagcgacgagtagaacagcccctctatggtttagatggcagtgctgcaaaggaggcaacggaggagcagtctgctctgccaaccctcatgtcagtgatgctagcaaaacctcggcttgacacagagcagctggcgcaaaggggagctggcctctgcttcacttttgtttcagtgagtacaaagcctaagttaattcatatcctttccattgccctagtgctccttgatgaggttggattaattattttgatagagagatagggacatttctaatacttttttttaaaatgtgatctccccttatcatcattcccaaacatgtctaattctacatcacttctaaatatattgtgtttttcccagtctcccttggttcaagctcctgagggagactgctttgtcaaagcctgaacccacaatgggaaggaaggaaagcataatcttagattgacaaagaagaaaatacagatcaaattccattagtaaccaagatataattaaaaatagagtctccgagttccagccatcatctatgtaagttaatactcaagtcagtacagttttagtatgtaggcaggcattctcacagcaagttactggtcatttaccccgtgtagtatttgggctatgtacacacttgctttctcaccccttcagagtgttggtacacttaacctttctcaggaatatttggctacctgttcgctcctttcagcttacttctttctctatctttgaagaacaagaatttgagtattatgaaagtttgacctcatttcataaggcgctatgagtgcaatttgaaccaaatgttacttttcctggtttttgggccctgccaggtcacctgtttgttgccaagggtgccagagtaacagaaagccccgtcgccgtattcctattccactttcaggggcatctttcacaactaagtcaccactcatccagattttgtccctcttactggttcattttgtccagttataatttaagtttcctgtttatttatcctgtggtgtctataagtctccaatccacactccaccaactgtgttcaaaaaggtgctgaaaatggtggttgtcttaaggaaaggaaatagaaataataaaacagttaaccagataggaaactattgtgcatgatatggaatgttttcttatagttatgatagctttaccttaagaaagagatacaacgctccttgaataacgtcatttcattcaacatggtttcgtgatagtgttaattagacactgtgagctgacgccactgtctgtgtggagtttgcgtgttttctccatgtctgtgtgggttttcttagggcactctggtttcctcctgtatcccagagatgtgtgcattaggttcactggtgtgtctacggagtcccagtctgagtgagtgtaggtgtgtgtgtgcaacagaatggcttcctgtccaggtctggtttctgcttgcaccctgagctgcctgggataggctctggcttttcaccactctgtactggaataaacagataaatcattatcttacttgtttttattaatcttacttaaatgtatgtagagctcacttttatttcagtgtttaatgttagaagtgttttgatctttaatcatcaaaggaatggggaaacttcttgtgtgaagacagtatatcctatccccaggtaacaaaggaaatatacatactttaaaaatgggagaattgacctatataatattgtgagagggactgacagcagtatggaatagttcctttgagaatgcagtatgctatagtattgttctaaagaatgtatgtgtgtcattcacacatttcgagattgttaatgtttatcatacacttacttttgttaaatctttgttttttttttttttttttttgagatggagtctggttctgtcgcccagtctggagtgcagtggcctgatcttggctcactgcaagctctgcctctcgggttcacgccattctcctgcctcagcctcccgagtagctgggactacaggcacccgccaccacgcctggctaattttttgtatttttattagagatggggtttcaccatgttagccaggatggtctcgatctcctgacctcgtgatccgcccgcctcagcctcccaaagtgctgggattacaggcatgagccaccgcgcctggcctttgttaaatctttatcttggatcttacttttccagaaaaaaccttggataattagggagttatttgtcttttggtcatttttaaggcattaaaatgacctctttttcacttgagaggaattctgtttgtttactccacaaatacgtactgagtgcccactgtgtaatgagcatagttaaatacacaagatttggtcagcaagaacttgttcccctttccatcttctgtaaaaagtatggtatgtaggcttgtggtggatgcacgtgaaggaccacctacttagtcctatcagctgacgcactccgttatcagaggagtagcagatgctatagccgtgttgttctcatgtggaaagaggtggcagagactagtaacaaaatgatcatgtatgaagaaggaacatggaaacagtatgaaaaccaaaagtctaaatgctctggtacagttttgtttctctttgcttctcagcagtaccagccagcatataagcttagtagtataaggaaagaaaatagtaaaagggttagtattaatatacaagtgtaaatcagcaaaggaaagcagattcttagaaaagtaggcaaagactgtttttgaaaagaaggcaagtggctaataacatgaaataatgctcaattttggccatagagaagtgcaaaataaaacaagataacatttttgacctagcaaattggcaaggattaataagtttgatagttcttggtgtaggtgatagtttagagatatattcagttttattctgtctataaattgttgaagtcatgtggacaacttggtaatgtatctcaatgttaagtttacatatccttgggtccagaaattccattcccataaaattacacaaagatatttattgaggtattgtttattgttgcaaaaaatctggaagcagtttcccttccagtatttcagaggatatgaccttcgcatcagacctcatctgacgtaattcattagcaactattgatcacttctttcttctctaagcatacggtctttcactcggcttccactcttgatttttcctcacattctctatctctgaacattagagtgttccagggctctgtcttcagactcatttatctaccttcattttcttcttaacctccctctctttttttttttttttttttcaattgagacagggtctcactctgttgcccaggctggagtgcagtggtgcaatctcagctcactccaacctccatctcctgggctcaagcgatttccccacctcagcctcccaagtagctgggagtacaggcgttggctaccacgcctggctgatttttgtttttagtagagacagagtattgccatgttggccaggcaacatggtcaactcctgacctctatggtctcaaactcctgacctcaagtgatcctcccgcctcggcctccccaaagttctgggattacagacgggagccaccacacccagccttcttaatctcatctagttcctttgttactaaaatttaactcctatgtgcagaggacttccaagtttatgcgtctagccagggctctgccctgaatttcaggcctgtgtcagttgcctccagtcatttcctttctatgtctaacaaacatgtcaaatgtaacatgttcaaaactgaactcttccttctgttccccacccgaaacccatttctcctacagctgcctttctcctcctcctcctcctcctcttcctcttcttctttctcctttcttctttcttcttctttctttcttttcttttttttttttttttttaatagagacagagtattagtgtgttacctaggctgttcttgaacacctgaactcaagtaatcctcccagtttggcctcccaaagtgctgggattttaggtgtgggccaccgtgcctgacttccacagccttctacatctcaataactgtcaacttttctccttctaattgttacagctaaaatccttggagtcattcttgtctttctcttctttttatattatatgccaaatccaaatctatcagtaaagcttattgattttaccttcaaaatatgttcagaatttttttttttttttttttttttgagacagagtcttgcgttgttacccaggctggagtgcaatctgggctcactgcaacttccacctcccaggttcaagccggttctcctgcctcagcctcccaagtaactgggattacaggcgcgtaccaccatacccagctgatttttgtatttttagtagagatagggtttcaccatgttggccaggctggtcttgaactcctaacctcaggtgatccacccgccttggcctcccaaagtgctgggattacaggcatgagccactgcatctggcctgtgttcagaattttaccacttctaattctcttcactactgccactccaacttaaaccattgtctcccactgagataactggacccattgctttgatctttgttttcttttaatctgttcttaacaaagcagagtgattgtgttgaaacgtaagtccagtcatgccactcccctgtcgaaaagtccttaaagtggccctgcatggtttgttttcctccaccctgacatgttttactaccatctacctttctcatcagattccatgcacgctagccaccttgttttctcaaatactctctctcagtgatgctctcacctcggggcctttgcgttggctgttgcctttgccctaacattcttcacccatatatcatcatgccctgctctctcagttccctctggtttctgcttatatttaccctattagagaggcctaccctggccacactataaaatagcaacttctccccacccatcccacctgttactgagctcctaggccctgcgttgtttttctccttagtctacaccagctgacgtactatgatggacttttgtctgacttccccccactggaatgtaagctccatcaggtcaaggactttgctttgttcacttgtgtatctctaatgcccagaacgggacctgctctaataggcactcagtgtaattatatgttgcatgagttagtaaaagcattctttatagaaggactggttaaatgaatcgtaatatatttgtacagtggaatgctatacagctggcaaaagaagtgaggtagctgtatatacaccaatgaaagatttctaaatatgtgttgataaaaatagcaggtggcagaatattaagaatttgatcttttaaatgtttaaaattattacataattctatgttttaacataggaaatttgaggttttatttttaagagagaggtctcgctatgttgcccaggctggggtacggtggctatttacaggtgcaatcatagcattatagcatactatagccttggaacttctgggttcaagcaattctcttgcctcagtttccagagtagctgcaactagagtgcaccacagtagctgcagctagagattgcaccactgcactccagcctgggtgacaaagtgagactcagtctcaaagaaaaaaaaaaattagtatttggactcacagtctagtgctcattctgtaccaccacactagctcccagtatgaagactatctgtttgtacaaagacaatatatatcaggctagagaataagatatctgagctgacctctcacttttaactttatggcattacaacatacataaagatccagtaagaagggagatgtagagggattagaaaaaggtcatttcctcttctattggtgagaatgttgtcagggaaaatcataagcaaatagtttcctaaattatgaaaatagaacatgcacatgacccgcaagaaattgaggagatggagaagcgtaaaattcttcccttggatttctcagagagataactactgttaacagtttgtgttttggattttctaaggattaccattttaatgtcaaataatgtgttccttatttaatcttatttatttattggtggagacagggtcccactgtgttgcctaggctggtcttgaaccatcctcctaccttggcctctcaaagtgtggggattagaggcttgagccactgtacctggccttatttaatcaactttaagtaagatctgtttactcctcgttatgaaagacaaatttaacataactttcacccagtctttctttctttttcagttgtttagttattgttacagtatgagtgtttgatatttagtttgttattttaactacaattgagtcttttctgctttgtaaattattctaagacttgaaaagaaggaacatttacaatattatgattgtttcattgtttggcattgcaaaaccaaatgattttattggactcactgaaaagaagagagacattgaattagtttagattgaaacagttctggttgtcaaggtctactggatctttttttcccttaatggcaagtctgttgtttccttaaaacttgtgtcttttaacattatgcagatgttcttcaaaacttgattttttaaaaaggtagtttgctttttttatgccaaagtattttaaaatacaattcagaaatcttgacctcctatctctaaatagttaaataggcatttttaaaaaacatgttaacattttgctagatagcgaaattagcattataacatgtctattagcatctataaaatagaactttcttatcatctgtgcctgttgctctacactgacatacatttctagaaagacaggctaaatgcttagttctttccttttaattactaatgaggcttttaaatttttttttaacttttaaagtagggagttgtttgatagctgtgacaaatagctttctctttgattatcatggcttcatggattttcatgggtgtacatcagtaaatagaatcgttcttttttggtgccagttggtcacggctttatccttttaccagtcgatggacatttaggttgtttccacttcttggctattatgaatgatgttgctatgaacattcatgtataagactttgtgtagacatacgttttcgtttcttttggatatatgctggagagtgaaattgccaggtcatatggtaactgtttttgaggaactgccagactcttccacagcagctgcaccattttacattccccgcagcagtacattccaatttctccatgtccttgccagtacttgctattgtctctctttttcattatagccatcctagtgggtgttaagtggcatctcattgtggttttgatttgcattccccaaaaaactggtgatgttgagcattttttcatttgctaattgggcttttgtgcatcttctttggagagatcactattcaaatcctttacccatttttaaattgtgttgcctttattgttaagttctaagcattctttatatattctgaatattagatctttgtcaactatatgattggcaaaggttttctattctgtgggtggtcagtttacttcttgacggtgtcctgtgaagtacagaagtttttaattttgagaaaagttcaatttatctgttttttttcttttgttgcttatgcttttagtgttgtagccaaggcttcacctaacctaaagtcaagaaaatttactcttatattttcttctatgtgttctatacttttagctcttatatttaggtcttttttccatcttgtgttaatttttgtgtgtggtatgaggaaggagttccaacttcattttttttgcatgtgtatatcctattgtcccagcaccatttgttgaaaatactgtgcttttaccattgaactgtcggcaccgttttcaaaaatgaactgacttacagcaagaggtttatttatggactctaaatctgctccatctatatctttgttatattagcccattctcacactgctacaaagaactacctgagactgggtaatttatgaagaaaagaggtttaattaactcatagttctgcaggcttaacaggaagcatgactgggaggcctcaggaagcttacagtcatgggagaaggtgaaggagaagcaagcaccttcttctcaggaaagagaatgagagagtgaaggggaaagtgccatgcacttttaaaccatcagatctcgtgagaactcactcactatcatgagaacagcaagggggaaatatgccctcgtgatccaatcagctcccaccagacccttcccctgacatatgaggagtacaattcaacatgagatttgggtggggacacagaaaaaaccataccacctgtctttatgccaggaccacactgtctgaataactgtagctttgtaataagtcttgaaattgggaagtgcaagccttccaactttgttgggtttcaagattgtattggctgtttgggatctgttgcatttccctgtgatttttaagatcatcctttcagtttctataaataaaccagataggatttgatagcaattgtgttgaatccgtagatcaatttgagaagtattgcctttttaacagtattaagtctttcaatccatgaacacaaaatatctatttaggaccctttgatttctttcaacaatgttttgcaacttgcaatatatagtcctatatttcttttgttaaaattattcctaagtatttattctttttacgctattgcaaatggaatagttttcttagttttattttcagattgctcattgctagagtatagaaatacaattgatttttgtatgttgatctgtcatgatggagtcttgctcttttgcctaggctgtagtgcagtggtgcgatctcagctcactgcaacctccgcctcccgggttcaagcgattctcctgcctcagcctcccgagtagctgggattataggtgcctgccactatgcccaactaatttttttgtatttttagtagagatggtttcaccatgttgaccaggctggtctcgaactcctgatcttgtgattcactcacctcagcttcctaaagtgctgggattgttttaaaggtttaagcaagttttaaaacgttaattgtaaagaaaattctgtgtgtaaacatattagctaaagttaaaaaggtatcatccagtttttctgggacatccttgtctttcttgttcatgatttttaagggaaaatatgaggtctttaaaaataaatattacattagccaggcatggtggtgtgcacctgtaatcccagttatttgggaggctgaggcaggggaattgcttgaacccaggagacggaggttgcagtgagctgagattgtgccattgcgctccagcctggatgacagaacgagagactgtctcaaaaaaaagagaaaaagtatcatgtttactgtatgtttttcagaggtggtcattttttaggttaacaaagttcctcttgttgttgttgttgttgttgtttaaagacagggtctcattttgtcacccaggctgttggagtgcagtggcctaattgtggctcactacagcctcaactgcttgggctcaagccatcctcccacctcagcctccccaaatagctgggactacaggtgtgtgccaccacgcccggctgattttttgtttgtttgtttgtttgtttgttgagcaaagtcttcctttgccactgaggctggagtgcagtggcatggatgtcagttcagtgcaacctctgcttcccagattcaagcaattctcctgcctcagccttctgagtagctaggattacaggctcacaccactgtgcctggctaatttttgtatctttagtagagacagagtttcaccatgttggccaggctggtcttgaactcctgacctcaagtgatctgcccgccttggcctcccagaatgctgggattacagtcatgagccaccacaccatgtcctaatttcttttgtagagacagggttttgctatgttggccagggtggtctggaactcctgagctcaagctatcagctcgctttggcttcccaaagtactgcgattataggcgtgagccactgcacccggctgagaaagttccctattttgagtttgttgattgttttttttttttttttacataatgaaaagggttttttatttcagagaaattttgttttactgtttctttgattatttcatttcctctgttcttttctctagaaagccattagatagtttcagggtctctgtgctattcatgtttcttttcttttgtgctccatttaaccttttgttttatcttctgggagattttcttattttctttttctttctttttttttttttttgagactgagtctcaccatgtcacccaggctggagtgcggtggcgtgatcttggctcactgcaacctctgccacccaggttcaagcgattcttctgcctcagcctcccgagtaattgggactataggcacataccaccacacccagctaatttttaaaaatatttttagtagagacggggtttcaccatgttggccaggctggtctcgaactcctgacctcaggtgatccacctgtctcggcctcccaaagtgctgggattacaggcatgagacaccgcacccggcctcttctgggagattttcttgacattgtcttttaggttactggctgtgtattcagctgtgtccattttgatatttaacccacctattaaatttttaaactttgataatcttattttgtcaatttgattattcatgttctttacttttttaatttttgtagctacagtatacttttgatcctctctgaacctattttatttttttcatcttaagaacctttaatacagttatctaaatgcagagtttcagtttatgaaatgaaccaaagcagtttgtcatttcatactataaactattgaaaatcaagtgctaaactgatactttacttttaaagttgtttattgaattatcttttaactcttatgattaggtattgttttttcgtcttggatttttccttttgtgctgttggggttgtcttgaaaatgtatttagcttagtggaatgagggattagagtgattaggtgttggcatggattttttttttttttctttttggtaacatagtctctttgttttccagtttggcatttctagattttaacacaggaccaggcacagagggtcacatttaatgttgaatgaatgatcagttacagcatttttttctctaacggatctgagcattgtcacatgagatccctatattgtgtagtaccttttaccttttgaaaacattgttttcattttcatgaggattttctgcttcccaactgaggaatttcctaactgccaacgtcctcagttaacttttgcatttttacttatcaatgagctatttatatgtgtatttttacagaaagctttaatttggaaacatctaacacccttagtttgctggaagacaacttagagtcagaaataagcatatttaaacccatataccatatatcaagaaatctgtaaagggcctttggatccctcttctatgggatctggcaacacagagccattcctacaactcccaaaagcagatctctatccagcacagacagacccgggtaggctgatgatcaataaccaatggaggggtgtatttgctgcataggaataaatggtaaccttagatagtctatgattcccctttgtcttctctatttctctgttggtatctgattgtttgtattatattcagaacttgcattatgggtaattaaagtcctttggaatgtgctttaagtttttgaggcttttctttacccttctagtgtattggagcagaaatgcttatactgcagcatggtgttaaggaaagtgcgcacactgttttttgtttacggtattccacggaagttaagtgctcacactttgaacttcctaactgcctacttcctcagtttacttttgcattttacttatcattgggccatatatatatatatgtgtgtgtgtgtgtgtgtgtgtgtgtgtgtgtgtcttttttatttttattttttttttgagctggagtctcactctgtcacccaggctggagtgcagtggtacgatctcgactcactgcatcctctgcctcccaggttcaagcgattctcctgcctcagcctcccaagtagctgggactacaggcacgcaccaccacacctggctaattttttatatttttagtagagacgaggtttcaccatattggccaggctggtcttgaactcctgacctcatgatctgcctgtcttggcctcccaaagtgacaggattacaggcatgagccactgcacccggccctatgtgagctttaatttagaaatatctcactacatcactttctaacaccctcagtttgctggaagaaaacttagaatcagatataagcatatttaaaccaatataccatatatctagaaatctgtagaagtgtcttttaatcatttgattcttttttttattttttattttttgagacagagtcttgatgtgtcgcccaggctggagtgcggtggcatgatctcggctcactgcaacctccacctcctgggttaaagcagttctcctgcctcagcctcctgagtagctgggattataggcacccgcccccacgcccagattatttttttttgtatgtttagtagagacagggtttcaccatgttggccaggctggtcttgaactcctgacctcatgatccacccacctcagcctcccaaagtgctgggattacaggtgtgagccactgcacccagtctaatcatttgattcttattggctcttattataaatatagttcagacagtcatttgtatagaaacacattgtagggccgggcgcggtggctcacacctgtaatcccagcactttgggaggccgaggtggggggatcatgaggtcaggagatcgaaaccatcctggctaacctggtgaaaacaccgtctgtactaaaaaaaaaatacaaaaaattacccgggagtggtggcgggtgcctgtagtcccagctactcgggaggctgagtcaggagaacggcgtgaacctgggaggcagagcttgcagtgagacgagatcgtgccactacactccagcctaagtgacagagcaagactccatctcaaaaaaaaaaaaaaaaaaaaaaaaaaaaaaaaaaaaaaatagaaacacattgtaaaaggagaggattgtaaaagcaatcaaatgataactgaaggaaatcttcagttatacaaatgcttgtatcctagtgcattataatacttgaggttcataatgatgacccttaattagtaaggaaagattggatttgctgcatcctagagtagagaacatatttagttatttggaattatatagacttggtgctcccccccaagacccccaccgcaagacggagtcttgctctgtcacccaggctagagtgcagtggtgtgatctcagctcatcgcaacctccacctcccgggctcaagcaattctcatgccccagcctcctgagtagctgggattacaggcgcccaccaccacgcctggctaattttttttgttttgtattgtttttttttttttttagtagagatgagatttcaccatgttggccaggctggtcttcaacttctgatcttagctgatccacctgcctcagcctcccaaagtgctgggattatacgcctgagccaccgcacccagcctcaaatcataaacttttttttgttttttgagacgaagtctcactctgttgcccaggctggagtgaagtgacacaatcttggctcactgcaagctccgcctcccaggttcaagcgattctcctgcctcagcctccccagtagctgggattacaggtgtgcgccactgcgcctggctaattttttgtatttccagtagagatggggtttcaccatgttggccaggctggtcttgaattcctgacctcaggtcatccacccacctcggcctcccaaagtgctgggattacagacatgagccactgtgctcagcctcaaatcataaactttttaaaggtttatccctgaccctctaaattaggttatgtgccttgttatatgctcttttagcacttatcctaattgtgattgtgtatttattatatgattgtttattcaacagtttctttcaacaaatatttaccaagtgtttagtaaatcttgttttggattgtaagcttcattaaggcagagtaaggactgggtctgtggtttctcttaccatgtgtacctagcacctagcacagtgcttagacatagggagtacttaataaatagtcattgaatgtatacattaaaatggcgttaataatgctgcctatctgatgaggctgttgtgagccttcaatgaaatcgtgtgtaggaagtgctagtttgctcacaggctggtggtaacagtctactgtggtcattgagagcagttattgtggacacaacccccagttctggtcaccccacccactagctctgtgaactcacataggtacttaatatctctgatttttattttatttatttgtaaaatggaactaataattacaaccaccttataggacagagtcttgctctgtcacccaggctggagtgcagtggtgtgatctcatctcactgcaacctccgcctcccaggctcaagcaattctcctgcctcagcctcctgagtagctgggattacaggtgtgcaccactgtgcctagctaatttttgtatttttagtaagatagggttttgccatgttggccaggctggtctcgagcttctgtcctcaagtgatccacctgattcagcctcccaaagtgctaggattacaggtgagccacctgacccagtctccttataggattttgtaagaattaacctgtgacaatgacagtgaaacatttaggttacagtaacttgttcaatagttggtggttataccattgttaatatgttaatgagtaagaacagtaatcaaaagaatatgtagaaagtatcagaagaaattcacatgtggaaatgctgtattctctgatgagatagtagtactgtatttttaccattccatgattctcagaatattgaatattttctacttatgtctgtgatgggtcatactttgttagctgcagttttaccttgttttaaaaagtactgttaggctaggtgtggtggctcacgcctgtaatcccagcactttgggaggctgaggcgggcggatcatgaggtcaggagatcaagaccatcctggctaacacagtgaaaccctgtctccactaaacatacaaaaaattagccaggcatggtggcgggtgcctgtagtcccagctactcgggaggctgaggcaggagaatggcatgaacccgggaggcagagcttgcagtgagcccagatcgtgctactgtactccagcctgggtgacagagcaagactacatctcaaaagaaaaaaaaaaaaaagtattattgagaatataatataattaacctgaataggttaattatattgtggaacctaaaccgtataaatttaaaatgccttagaatgcccagtcagcaagtgacagtattagaaatcaacctggattttagaccgctgtgtgttcatggataatgtttgtgtgtttaggagactattctgaatagtggttcacagtcctttacatgcatcccctgtgcattggatgcttcactagccttttctgactaaagcatatgaaaatacaagtgaaaaaggcaagttattacaggaataacttttcattttctctaattttcatattttaaaaattcatttgtaagcatttgatactttaaacctgtttacaggaacttggtataaaccaccatgtccagccctttgtctcatatttgaattgttttactttcttcttggccacgtggccctgacttctcactttcataagaaggggtttgtattgtggagatacaaattatggagttgtttgcattaatacaagtgtttgtggaaaaagatgccaaactttcctgtgattggtaatgcacctttattgtaggctcagcaaaacagtccctcatctacgggatctggcaacacagagcattcctgcagctcccaaaaacagatctccatccagcacagacagacccaggtaggttggtgatcgataatcaattgaggggcatacctgctgtgtaggaataagggctaacctgtgtagtctgtcattcttctctgacttctctgtatttctctgaccacctcattatttgtgtgtattatattcataacttgcattatgggtatttaaagtcctttggaaggtgctttaactttttgaggcttttctttactcttccggtgtattgtagcagaaatgcttatgctaaagcatggtgttaaggaaactgcacaccttttttttttttttttccctacagtattccacagaagaaaagtacctacgctttgaaggcctctaagttcagattctggcctgggcctcagtttttcttagtacaaatcatctgtgaaaatatggttgattctcatgatctcagacagtgtatacaaaatgtttattagtagtgtacttgtagtaggctttcaataaatgttaattctctaatttatgaaagtagttaatgtattccttttcctgcttacttatttatacctggctaaacttctctcagatgtgagataccaacatggtttactccttaaattgtgttcagaaactctttaatttaggtagtgttctgaacatttgaggattgtatctgcaaaggatggtggctatagcttccattttgtagttttgagtatactgggttttcttgaaggctcttttgatactatatatattaccttcaagacaggatcgttggcaatctaggagaatttcttaaatctcaagaggtatacaactccctggagcacatttgaattttatctaaatcaccagctcttgtacagttcagttagatagttgagcactcaggtagcttcttctcttcccttctgattgctctctgtttccaccagatggcgcatttgttccttagagagttgtgtgtcaagtctcctgtgagatccttttctattcaaagttagtttcatttctggagtaacgtgtttctacattgttcagtgcacagtagtgagaattcatacatttgattccagaattaacatgtgtttgaagtgtaggtgtagtgggacataaggaacccagcagaggacttgaagaatgagatgagacaagcagatttcatttcttaagccatgtgattctaggccatttgtgtgagcaagtgctttttcccacccccccgagaaaggtaatgagaagagtgtgatgacatataacatgttgagactaatcctaaatttgttttacctttgtctctgtagtccgacctcacaatagaaaaaatatctgcactagaaaacagtaagaattctgacttagagaagaaggagggaagaatagatgatttattaagagtaagtattaaaatgtaagagattttatagcaagcaccatttgttatatatatttggattatgtacatatcatagaagtaattactatagccaaataacaatgaaataataaacatttgggtatttttctttaattgagggaatctgagtaggaaccaggttcctgcattctaaacactacctttaaattggaaatcttatactgtagtgttttaatgattgaatttatattggagaaatagatatgtggagtgttatatttcatctagaactgtgggaataagtataaagtgttgttttcccattccagagaagttattttaatattgttgaattttataagctatttcaaaggacttattagcccattttgctttttgtaccttttataacctactcacccaaacttttttgtgcttacaaaagaaacctttaaaatgcttcatctggaattaaatagataccactagaaaatatcaatatattttgaatatgcaatttggcatgactgactcatagtttttaaagagtaaaaagggccggacatggtggttcacacctgtaatcccagcactttgggaggccaaggcaggtggatcacttgaggtcaggagtttgggaccaccctggccaacatggtaaaaagaaaccctgtctctactaaaaaaatataaaacgttatcctggtgtggtggcaagcggctgtagtctagctacttgggaggctgagacaggagaattgattgagcctgggaggcggaggttgcagtgagctgagattgcgccactgcattccagcctgggcgacagagtgatactttgtctcaagaaaaaaataagaaagtaaaaaggaccgggcatggtggcccatacctgccactttgggaggctgaggcaggaggattgcttgagatcaggggtttgagaccagcatgcatgacacagcaagaccccatttctataaaagaatacaaaatttgccaggcatggtggtgtgtctgtggtcccagctactgggagcgtgaggtgggaagatgcttgagcccaggacctctaggctacagtgagccaagttcacgctgctgtgctccagcatggacaacagagcaagaccctgcctcaaaaaaaaaaaaaaattatacatgctctttacaaaatacagaaaaatgtgtcactcataattccattaattgggattaaacatttggtacattttttttttcagtaattttgagctgtttgaagtagatatgtgtgtgtatatatacacacacacacacacaaatgaatatatacataaatgttactgatttatgaataacattggctagcatttttctctttagtgatttagaaggtataggtttaatccttatttgtgctaatgtggtagttaatctgactcttcagggtcctgaaacctccagggctactgtgacactgcaaggtggggatcggcagccttgcctttgtcagtctttcttactaggctttgggtacaattttgtttgaatatatgtttaataatacagattataaaagtcactgtactcatgatgatctgacttccaaaattgttttacttgtattatatttctgtacttaatgaaaacatagggtaaaatagtgtattttgactcctttttatataaaacctggaattcagcacatagctaaactaagtctggcctttattagtaaagtctggtgtgtttatattattattaatttttttttttttttttgagacagagtcttgctctgtcgcccaggctgaagtgcagtggcgtgatctcagctcactgcaacctccgcctcctggggtcaagcaattctcctacctcagcctcctgagtagctgggattacaggcgcccgccaccacgcccagctaatttttgtatagtagagacggggtttcaccatgttggtcaggctggtctcgaacccctgaccttgtgatccacccacctcggcctcccaaagtgctgggattacaggcgtgagccaccgcgcccggctattattattaattttatatatttattttgagacaggatctcactctgtcacccaggctggagtgcagtggcgcagtcttgcaagctgtgcgctccccagtccccgcctgatgtgatcctcccaccttggcctcccaagtagttgggactataggcatgtgccactacatttggctgtttatattattaattaattattaattttttgagacagagtctcactttgtcacccaggttcaagtgattctcctgcctctgcctcccaagtagctgggattacaggcatgccccacaatgcctggctaatttttgtatttttaatagagatgggtttttgccacattggccacactggtctcgaactcctgacctgcagtgatcagcctgccttggtctgccaaagtgctgggattacaggcgtgagtcactgcgctcggcctatattattattgttaaattaccattcttactgctatatatgatactaagttcttatgtatagagtataggcagaggcagctttatgaccaaatttgtagtcattgttagacttgtttattcaactgatttcaaaacttatcagcagtattttttttatttatagtttttgttttatctgttgatggtggtacatttttaagtgattatttttcagcaaggatttgtcagtgttaaattttctctgccttaccgacctgagaattctctcttttgccctcccgtggaaagacaacactgtgtgcaggatttttgtgtcataaccccttgttctattcgttctgcctctcaaatataacacgcattctctctctctgtttctccttcagtttttcaagcatttcgtatttcagagaggttcatgaccaaagcagcaaacaccataatttgttaaatattaccccagggtgtctctatatgtgggtttatatatttttatttggaaaatgtgtgattatgtctaactatgcttttatccctctttatattggtttcttcttgactcttagcttgaatctctgatttctctcctttatttctcacatgttatgtcttattttaatatgattgcccctttcttctgaatctcattaaacactgtcttccatatatttctggcatttactgcagctcgtgtgaattttgattttattgtttacatttttattttttgagacagtgtcttgctgttgcccaggctgggtgcagtggcaccgtcatggctcactgcagccttcatctcccaggctcaagcagtcctctcacttcagcctcctgaatagctgggactacaggcatgtgccactgtgcttggctaatttttttattttttgtaggaacagggtctcattatgttgtccaggctggtcttgaactcttgggctcaagcaaacctcctaccttggcctcccaaagtgctgggataacagacgtgagccaccgtgccaggcctattatttacattttaaatttccctgcttttttccctcatctaatatactttcttaccccatcttgtatattctctagggtttttggttcctatttcctagatatcacgtctttttgcattttatgaaatatgacaagaagtattctaaaatgttcttttgatttctatgggtgatcattttcattgttttcaagctgattttctgtattccttgggcctatttttgttgttgtttttatttactattgttatttttatttcctttcctccatctttgaatgaggagacccatatgtagtctcagcactgtgttgtatttttcattgttcggatatgtatacttgcatggagttgctcttattcctgtttttattcatctgggtgctggttgaattgccatcgaagatttataatgaaatggtttgtgggtgtaaaaagctccttgccaaattccagtatctgtcagggttttgtacagagaagctctgctgtactgaggaagaattgtgggcgtgcctttctccatcatctgactctttaagattgagatgacagagtatgagaaaaacttgaatcctaacttggtactgctttaggagtttcaaaaaaatgtttgcttatgttttctaataagcaatatgtttccttcactcactactgtcccttctactccgtcgtcttcagactgttgcagtctttatttgtatgtagagcagtactaaaggagtagataaataaaaaaggaagacacagagggcagctgccttgtttttaggttgattagaacttgtgcttctagaagatctagaggatcgacagtgagggaaagactacatgtcttgtatattctttcagacgtcattcattgaattttgccattttaataagatgttgggtatggctgcattgggagctactagccagctgctttttttttttcttttttttaattaaaaaaaaaggacacagtgtcttgctctgtctcccaggctggagtgctgtggtgcaatcacagctcactgcagcctcgacctcccaggctcaagcaatcctcagcctcccgaacagctggcatcagaggcgcatgccaccacacatggctaattttcaaaattttatagagactaaggttttgccatgttgccgaggctggtcttgaactcctgggcttaattgatgctcctgcctcggcctcccagagtgctgggattataggcatgagccacgctcaccagctgccagctgttactttaaacatgaactcctcgaagacattagtgtcagaagccacaaaaacttagaattattaaaattttaaataactgccaagaggttgatggatttcatacatttgattatagatttcaagggaacactcaccttatgagtagactgggttttccatatacattaaatgatctttgcttcgtagattctttactatgaatttggtaatcacacttacccaaatgtagttacactctgtctttgataatatggttctgtacaaaaactaacaggaagaaattatgctgatggggagaggagaaacatttggagacagaagctgtttctcatgggttactttaaaaatgatgctatattatacaaaagaaaaaatgataaaaatttttaatgaagctacaaggtctcaaaaattgagtatcgtgtgatatcttctgtttgtgccttttagtattttaggaacacataacaggtttttctttttcataatttaagtgagtttttatgaggtaacattatttgctagaagagctgagatcttttttttaacacaaaaggaataaattcaggacttgcaagtcaaattcgtccttgggttagtggttctttccttctctgttattgcaggaggctttaagtttttagtccacactgtaggcttctgaccacagctaaattagctgtatatttacattctggcattcttgaaccaggacgttgtttgtttgttctgtcttttgtgggcatgggcgtgcctggcttctctggtgaggaacatttatgcaaatttatctttcttaaatgcgactagaaaaagaacaaagcaaacataaaattcagtaatttttttgtatgtgcttaatcactctttgtattttaaacattcattgtagtttattttttttttattttttatttttttttttgagatgaagtcttactctgtcacctaggctggagtgcagtggcgtgatcttggctcactgcagtcttcgcctttgagttcaagcgattctcccgcctcagcctcccgagtagctggaattacaggctcccgcaaccatgtgtggctaatttttttatatttagtagagatggggtttgaccacgcaggccaggctggtcttgaactcctgacctcaagtcatctgcctgcctcggcctcccaaagtgctaggattgcacgcatgagccacgattcccagctttaacatttttttaattattattttgtgatagcttaggtgtttgtgattacaagagtagctgtaactggttattggcaggagcaaaatatgatcagtagaaaaacatgcccaaattagtaattcaatttatcatttacaaatagatgatatgttatgagagaataaaggaatgaattatttactttttctaagacatagttacttcttacctgtttgaactttaattttgcttttgataaaacaacatatagaaatgatttttttttctctccctagaaactgcttttccattaatcttcttccttggagctaattaaaaatttttttctcattgaaggccaactgtgatttgagacggcagattgatgaacagcaaaagatgctagagaaatacaaggaacgattaaatagatgtgtgacaatgagcaagaaactccttatagaaaaggttagtgaataatgttggtctaaactctgtatcccaagatactcaatgtgtgtcattgtgtggcttcttattccttacttgagatgaaaatatttaaaagtagagctttttaggaacatgatttgacaattagaattttttccttacatggacaccagaccaaccatccagagtgttaatttgggatatgctttgttgctgtgcattgctttgagtgtgatattgaacagagacagcttgtcctagttgagtttatttggggtattgctctcctatattcttatattcattctatcaattgaagtgagtatcctattactattagaatcattaacaatagttgcatttttgtttcagagatggcatttagaataacttatgtatataataatgtgataattaatgctttgtgcattaaaaaattaaagttgtcatatacctgcatatgattacttaattggctgatgtcctctttattatattcattggttaattatcacttatctctgttaataggtattagtaactattagaattttttttttttttttttgaggctgagtctcatccaggctggagtgcagtggcatgatctcagcacactgtagccttcgcctcccagattcaagcaattctcctgcctcagcctcctgagtagctgggtttataggcgtgcgccaccatgcccggccaatttttgtattttttttttaattatactttaagttttagggtatatgtgcacaacatgcaggttagttacatatgtatacatgtgccatattgatgtgctgcatccatcaactcgtcatttaacgttaggtgtatctcctaatgctgtgcctccccactccccacaacccacaacaggccccggtgtgtgatgttccccttcctgtgtccatgtgttctcattgttcaattcccacctatgagtgagaacatgcagtgtttggtttttttgtccttgcgatagtttgctgagaatgatggtttccagcttcatccatgtccctacaaaggacatgaactcatcattttttatggctgcatagtattccatggtatatatgtgccacattttcttaatccagtctatcattgttggacatttggattggttccaagtctttgctattgtgaatagtgccacaataaacatacatgtgcatgtgtctttatagcagcatgatttataatcctttgggtatatacccagtaatgggattgctaggtcaaatggtatttctagttcaagatccctgaggaattgcggggtttcgccatgttggccaggctgggcttgaacttctgacctcaagtgatccacccgtctcggcctcccaaagtgctgggattacaggcgctcaccactgcgcccagcctatttcttagaagttttaagaagacagtacttcctaatgacaatattacaagaacaaactagaggtttgagatatactggagatttattttcctgaaatgtttggaatgttgttaaaaagacaggaaacactgtctttcagtaaaagtgaaatgaattattttattgaggccgaagatactgggggaaattttgtttcattctttgactcattaatcaactttatagaaaagaaaccactttttaaaattttttctgagagtgagaaaaaataaaatatatgctaatccagataatttctttgaagttttagaatacttcctgaaatcagcagagattcagccagttgttctaaactctaaatagcatactacaaaaagtaaacataatgctgtctctgagttctcacaggaaaacaactttctctttgctaggagtagtatataacaaaatttaaatttgtttccaaaagaactgaaattgtagtatctacttactgactttctaaatagggagtatttattgagtatctgctacaccgtgatgcaatataaagcagcataaatggactgggtgtggtggctcacgcctgtaatcccagcactttgggaggccaatgagggtggatcacttgaggtcaagagttcgagatcagcctggccaacatggtgaaaccccatctctactaaaaatacaaaaattggctgagtgtgggggtgtgcgcctgtaatcttagctactctggaggctgaggcacgagaatcacttgaacctgggaggcggagattgcagtgagcctgagatcatgccatttcactccagcctaggtagtagaatgagactgtctcaaaacaaaaaacacacaaatgaaaatgcaatcatagagtgcaatgttatctttcatagaatttgaatactttaaaaattttaaaactcttataacttaatcataaaaagacaactcattaataatgagcaagagacttgaacagatagtttacaaaaaaagagtgtataaaaatacgcaaatggcaagcatgaaaagatgtttaatgtcattatccatcaggaaaactcaaggtaaaaccagcgtgagatagtactacaaacccagtagaatgactagaaataaaaaaaacctgacagatccaagggttggtgaagatgaggggcagcctgatttgttacaccaatagaaatgtaaaatattacagctacttcagaaggtttttggacagtttttctatttgagataaatatgtactaaatcctgtgatccagcagttcctctcctggcatttacccaagacaaacaaaagcaaatgttggccgggcatggtgactcacacctataatcccagcactttgggaggctcagggaggaggatcacttgaacccaggagtttgagactagcctgggcagcacagcaagaccatctttatttttaaaaacagaagaaagtaaatgtccataaaagtacttgtatgagaatattcatgggaattttattcatagccaaaaagtggaaacatcctaggtgtctgttaacaagtgaatgtagatacaaattattatattgtcatacagtggaatactactcagtaataaaaaaagaatgaatttctcataatagaacagcttgcatgaatctaagaaacaaaagacacagttcctgccatcagagggttaacagtctacatgagggtgggcgaataagacacattcacatatataaggaaacctattcagatgagcagtgcacatattaagaattcactaaaattagctgggtgtggtggcacacacctgtagtcctagctactcaggaggctgaggtgggaggatcattggagccaggagttggaggctgtagtaagctgtgattgcactgctgcactccagcctgggcaacagagtgagaccctgtctcttaaaataaaaaaaaagaaaataaattcactaaaataaatcaagggcaggggactaattggagaaagctataaagaagaggaaaaatgtgttctgggcatggaaaactgcagctataaattgcctgttggttgaaatagacaggacatctcaaggacttttatcccatggtatcatctctcacagtactttattcttttcctttgaattctttaccgcgtctgtacttagaattaccaattaatatatttagtggttataactccccctctctctaggctgtgaacaccagtttttttctatgtcctatacttaacattcttacagttcatgacgtataattggttttaaataaacctgtgttcaatgaatgatgttctcaagaatcaggagtatataaggtgttttggagtaagaattctgcagggaggcagatcttctagcgcattgaggggtttttcttgtctggatccaaagtttggtagcagagacccatggaagatttggaacatcaaactggaagtgtgcaaagtggtgttctgagaagatgaattggtaacagttctctagaaaatattagatagagaagaaacagaaaatagggaaacagcttaagagctaggcattgatgtggcccaaatgtgagatgctgaactctaagattaaaaacatgtaggcaggctgggtgcagtagcttaggcctgtaatctcagcactttgggaggtggaggtgggctgatcacttgaggccaggaattcaagaccagcgtggccaacatggcgaaaccagtctctactaaaaaatacaaaaattggccgggtgtggtggctcacgcctgtaatctcagcactttgggaggccaaggcgggcaaatcatgaggtcaggagttcaagaccagcctggtcaacacagtgaaaccccgtctctactaaaaatacaaaaattagctgggcatggtggcatgtgcctgtagtcccagctacttgggaggctgaggcaggagaatcgcttgaacccgggaggtggaggttgcagtgagccgagatcccaccactgcactccagcttgggcaacagagtgagacttcgtctcaaaaaaaaaaaaaaaaaaaaaaattatccggacgtggtggcatgcacctgtagtcccagctactcaggagactgaggcaggagaatcgcttgaacccgggaagaagaggctgcagtgagccgagatcatgactctgcactccagtctgggtgatagagcaagactctgtcttaaaaaaaaaaacaaacaaaaaaccaaccaaacaaacaaaaaaccccacacacacataggcagattgggaaagctttacctgtgaagaacttgtggttgtttcattattctatcttgtctactttgtttgaataggaatagttagtcatccgaggagtcattactgactgttctgagaagtgtatggttttcaataatatgtttcctgataatgttaaatgttttagtttctaagaagtgtctttatccatgctaattggtattgaattcctttttttgtctgtttcccctaagtcaaaacaagagaagatggcgtgtagagataagagcatgcaagaccgcttgagactgggccactttactactgtccgacacggagcctcatttactgaacagtggacagatggttatgcttttcagaatcttatcaagtaagtgaattgttatgattaaatggagaattgaaaagttcgtttgcattttttaggttttctgtaattgtagtcattaataatcctactattggtagtcatcttttcagttagttttttagtcaccacatgtggaaagaaatgtatcgaatgaggtgaagtcctgaaaaaaaacgacacaagtaaaatcaggagtacaaaatgagttccagaaaataaataaagtatgagttcaggccaggcgcggtggctcacgcctgtaatcccagcactttgggaggccgaggcgggtggatcatgaggtcaggagttcaagaccagcctggccaacatggtgagaccctgtctctactagaaatacaaaaattagccaggcgtggtggcaggcgcctgtaatcccagctacttgggaggctgaggcagagaactgattgaacctgggaggtggaggttgcagtgagccgagatcgtaccactgcactccagcctgggcgacagagcaagactccatctcaaaaaaaaaaaaaaaaaagaatgagttctgcattaaaacttaaaagaatcagaattgctgaagctaaggaagaaaaacctagggtttgactttctatctttctaattatataatgaattttcattaagagtctattgagcatttcttctggatccacagaaaaatgaaatgtgaaaggacctgagaaagaatttcctgagataagtttaggtataaagcagaataaaaccactgaagaactttataggacatgttcctgggattatttaaggagacagtgtccagtcatcagagagtcacttcctggaaggcagtggtgaccagccccactgtgtgtgcctgtgtgcagcttggaatcttgaacattcattgtctttgtcataacttttgatttgaaacattcaggtatttattccaatgagggaattaacatttaaaatcctcaaattccaactgtgtgactagctaccgttagcttagatctttaaatgtatatagatatcttcagattgcagtaccttttggtgaatcttctttttttttttaatctctaggtcatgatgagttggaagggtctatagactgcctttctttcctgtgtttttttgctgaaatagcttgttgagtatgaattggaaagcatgtgactacttttgagtaataatgaaacaaataagaaacttatgcctgaaagaaaatacaaatattgatgctatttataatatttgttaaaactaacctctgagttagacgttagtagtccttgttttatgtgtgaaacattaacctccaacttagattaagcgtgtttttgcttcatgattattcctcatgtgtgtatattttggtgtgtgaagaggctttcaagtcaaagaataccttggaaggaaagcacagacttttcttaggccggcaccagacattcagagcagcattcactctgtgctcttaagcataggtggctggtgatagcagaggtatcagggcagtgtaaacagcagttacatggaggtatgatacctgtttataacatcctggccaagacatgcaagttgtcctggaagtgacataccatccagtttccagatttgttaaaatggaatcagaagaagataaaacttaagatccacatagtggccaaagccacctaatgcttacactgacttctagtagtggtagtcactctgagcagccctgtcaatggctactatttagatagcagtctttttagactttgattcaggaaagatggtgagtttgtatagagatgtaattagttttaagaagtgcttttggccgggcacagtggctcttgcctgtaatcccagcactttgggaggccgaagcgggtggatcagttgagcccaggagtttgagaccagcctgggcaacatgatgaaaccctgtctctacaaaatatacaaaaattagctgggtgtggtggcacacacctgtggtcccagctacttgggaggctgaggtgggaggatgacttgagcccaggaggcagaggtgagtcatgcagtgagccgagaattgtaccactgtcctccagcctgggcgacagagccagaccctgtctcataacaaaacaaaacaaaaagaagtggttaaacttactgcttatagtagcaatattttatctcttactctaaaagcagcttgatgcccacgagggtctggaaatctgtatggtagagtacaaaatgatgactttgctatagagccaccagatcagaggaagtgagactatgtaaatgaaatccctaagtaggactcttcactgtaggtggatagcactgttttaccattttaagtcatataaatggccagaaatctgtgtcttctcttgggaagatgtttctggctgatgtctattaattataggtattttagttcctgaaattttgctttaataaattaatttccttcagtatagaaattgaaattctctagttgtaaaaggctatatctaatagcctcagaggtcacaattctgcacatgagaaactccaagacatgtgaagtaatttggtgggtgaagtagctgaacactaacaacactactaggttttatgggaagagacaaacctaaaggcatttaaaaaatgaatcagataatcaaatatagcctcaataggacccttagcaccatttttttttgttgttgttgttatttttgttcactggttctttttttgagtgatctttaatttcctaaaacagaagattcattgtctaataggaaaattatatcagatttgtaatattttttggccagtttagtaatttttgctttccacagtatgtttgaatcttttgaaaaagtagcttattttatagttctgagaaagtaatgttaaatactaaatgttaatgttattcagtatatcactttttgtttaaagaagtctcaaacagtccatggcaaggcaataaaaattctttactaagattttgtttatgttgaagtaaacaaaattaaagtaatgggatttggccagatgtggtggctcccacctgtaatcccagcactttgggaggctgagatgggcagatcacttgaggccaggagtttgagaccagcctggccaaaatgatgaaaccctgtctttactaaaaatacaaaaattagttgggcatggtgacacacgcctgtaatcccagctactcggcaggctgaggcaggagaattgcttgaacatgggaggcagaggttgcagtgagccaagattgtgccactgcactccaggctgggtgacagagcgagaccctgtctcaaaaaaaaaaaaaaaaaaaagtaatgggatttgacctgtgtacaaaattgtgatcatttaagatgcatataactagaggaagaaattaaagtttacagcattgtaatgctagtccaggtatttattctgaagtgtaacaagttccagtatccatttcatttattttattttgagacggagcctcactctattgcccaggctgcagtgcagtggtgcaatctcggctcactgcaacctctgcctcccgagttcaagtgattctcctgcctcagcctcctcagtagctgggattacaggtgcccaccactatgcctgatgaatttttgtatttttagtagagacggggttttgccatgttggccaggctggtcttgaactcctgacctcaagtgatccacccaccttgtcctcccaaccagtatccgttttaaagcaatttacgtcaaaccatctgattctcagtcatatgattcactcattttgttgattttataaacattagatcttctttaggtatcgtataccatttcacagctcccagtttatacagaatatattcaatcctgggaatctttaaaaatctcatctgggctggttgtggtgtggctcatgcctgtaatcccagcagtttgggaggtcgaggtgggtgcatatcctgaggtcaggagttcgagaccagcctggccaacatggtgaaaccccttctctactaaaaatacaaaaattagccgggcatggtggcgtgcacctatagtcccagctacccaggaggctgagacagaattgcttgaacctgggagatggaagttgcagtgagctgagatcacgccactgcactccagcctgggtgacagagtgagacttcgtctccaaaaaaaaaaaacaacccatctgggatattgacatgttgtttgaagttttgaagtttcagacctctcagagatgaaatagataacagattatttaaaataattttgtttaaataatgactggaaatacgtgctttttttttttttttttttgagatggagtgttgctctgttgcccaggctggagtgcagtggcgtgatctcggctcactgcaacccctgccccctgggttcaagcaattctcctgcctcaacctcctgagtagctgggactacaggcacacaccaccactcctggctaatttttgtatttttagtagagacgaggtttcaccatattggccaggctggtctcaaactaagtgatccgcccaccttggcctcccgaagtgctgggattacaggtgtgagccaccgcgcccggccacattttttaaaatacctttactactagttacttcttgtatggttgaagtgtaaaatgtagttttgctgctgaaggtacccgcatttcagttcctgggatgctgtaacaaataccataaactgggtagtttaaagtaacagaaatgtattctctcacacttcaggagtctgaaagtctgaaatcaaggtggggcaggaccatacttcctcaaacctttagggaacatctttctttgcctcttcagcagtgtggcagccccaggtgttgggcttgcggcagcataactccattctctgtctcctcttcacatggtgctctccctgtgcgtctctgtgtcttctcttctcataaggataccggtcatattggattaaggtcctatcatgtccagtatgacctcatcttcactagtaatatctttattcaccctatttccaaataaggtcatatcctgaggtactaacgactttaacacatcttttgggggacacaacccataatggtgcagaagattgattgtcttgtttctcttttgcaggcagtggcttggtaaatagagttatttagatttgaatgagatggatttattgggtcctcaatacttctgtaaaatatagaagaaatagcctcttgctatgggtgatgaagggcgagcgctctctaaaattgatgctatacaagaaatatttaaggatcaactctgtgaaaggcactgttaatgcatgctgggggatatacggattgctaagacacgattcctgttctgtgagaagttacagtttgacataatccagcctttgtactcccaaaataaatctaaatgaagtaccactgatagactctctttattcttttcttcttcaatagctaaacagtttcaggaacatcaagaattgatatgggaatccttaaaatacgtaacattgatctttggtgcatcagctttcatgttcaaactttcgttctcagaatgtgcagtttaggatttccctaaaggtgttttggaatctgtgtcccttgtgttatggtttatatatattatggctgtggggagcatttcttggtgaatctgaagagattaaacatatgaattgtccttgaaaataatagattattttcatgtttgatgaaggtgattgctaaaatctcaattttgcaaaacactgttaatcttcaaagacaaaatgttgtggcactccactaagctactctagtttatagtttaaactgtatattgtatgtttatctgtagggagttcagagtgtcttacattcatggcccctgaaaagggtagaaatgagctaaagatgtttactagttttttaattgggaaattcatgttcagttaaggtaaatgttttctccagaataaagattgtgattttttacttaaggattctgtgtctcaacccagatttctttcaagccatgaattatatatatagttgtcccttgtggggaattggttccaggaccttcctcagataccaaaatccatggatgctcaagtccctgatataaaatctgtagtatttgcacatagcctatgcatatcctcccatatactttaaatcacctctggattacctataatacctaataaatgtaaatgctatgtaaataattgtcatactatattgtttatggaataataaggaaaaaagtttgtacatattcagtatagatgcagccatcttttttttttcgtgtattttcaatctgcagttggttgaatccatggatatggagagccatccttatatgtgttctgtgagtagggatgaggaggtctagctaataatcaaaaagaattttcaggcaaacagaaaactcttgaattatcattttcattttgctgttcgattgatgtctaatcagtgacctggctcatcttgaagccaagggcatagtattatcaagtgactggctgtttctttgtaatactctgattaggttaattttgcatacagcattgcccttctagatatgttcgaataaactgtattgtgggtatctaccttagagtaatcttggttttctgcttgtcgttcttccacgaaagatactgtactgaatctggaaaagatctgacagcaatgttcagggaagagggtagagcaacttccatttgagtgtaggttttaaaaaattagattttgccgggcacggtggctcatgcctgtaatcccagcactttgggaggctgaggcgggtggatcacttgaagtcaagagtttgagaccagcctagccaacatgatgaaaccctgtctctactaaaacaatacaaaaattaactgggcatggtggcgcacacctgtaatcccagctattagggaggctgaggcacgagaatcacttgaacttgggagacagagcttgcagtgagctgagagctgagatcgtgccactgcatcccagcctgggcaacagagtgaggctctgtctcaaaaaaaaaaaaaaaaaagatttattattccacaaaaatgaaggttggttccacaaaagagaatgtgtggaaaagcacagtagaggaagaaggagaagggagctatcatttgattgtcaattatagtgggtgacttaaagactaacctgttagatggttaatctccaattttgtatgtttttatataccaagtctgtaaaccttaatatctgttaggtggtaggatacatgagagaaagtgttttttttttttacaatggagtttttattggtccctaatttgtaaactagttaatcacagaaaaatgtgacatcttattaggaaatactctaatggtaatggtgttagattaactgcagttgtaaaatatgttttatactaattcattttgtatactattccctaaggagttcttactagttggaagacttcgttgtgctttctccaaatgtatttttcttttaaaaacttaatctaggtgtcactgtatcagtgggcggggttgacgtgtagagtagtaatggctcccttagactagaataaaggataggtctaaaaagaaaatcttgtttactttctttagcatcctacaaacttggtatctttttacgtaaaactgagaagctttcatccaaagaaaaataaaatagaacttggaactttttacaacttttaaaatacgatttacttttaatgggttcagatcagagaattgtttccttagctgttaaaaaggaatcagaaaattgttccttctgagtcagaaaataaggtcacaatagaaatttgatatgttccttcctgtccactctgaaaatagtaataactagtgtcttaaagcacagactcattcccagaaaacatctatcaccaattatttggcccttccaatctgaagttaaaatcaaatctctacttgacttaaaggggcttattttttctgaaattggatacacaagtgacaaattgtgtgtgttccatagctgtggtaaaacttttgactttctttctttgtacaacgtcttttatatctctaggcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgtatgttctttattgacgtgaacgctgagacaccacaccctgcccccaaatacaaatgttgattgtcaccggcaatagttttaaattcttgaggtcactcaggtttaaaccttcttttcagttacattaatggatttgctcaactcatataaatgccatataaaattaattgattttcttaaacctgctctttctttagggcattttgaatgagagggaaaagtaatgtcacttgacatcatgacttttggccactcctggttaacaaataagatgtcattgtactgaaatgatattattgcttacatgtggctgcagggtgtggtacactagtatcatcttatgggagttacctggctgttatttcagactgaagaatgctctttactggtcaaaagagcacttagttaatagtcacaaacttaggataagccccccagaaagctgttatgttagaaaaggacattgtcccaataagccacaacttgatctcatcagaattgtttcctgttctgggaatctaaggaaaacaccagtatcttaaactgcagtacagtcatctttttctctgtcactcaacaatatttacatagctaccatatataggaggagtagaaaattctaagcacaaatgcctgccttctccattcttctcttcctttctgtttaactgaaagtaagtttcaagtccaaagatagctgcagataaaagatatataacttatcaactaatatgtcatttgctttatgttttcatattagttcacaaaaacaacacataatccacttcaggtataataatacttgtattatattattgttaaaagtctgtggcatcctagaagtgcatcttctttcattctagtgagaaagatggcttaacaccaatcctcaccccatacatatctgatgttttgggaagtctcttccttgatgttcgtttagtaagtttatgttaaatgcttattttatgctaggccctcttctgggaatacagagctaaaggatacagccccagccttaggagcccacagtttacttaggtgagatgaacagacgaataaactaataattacattaagtatagcgataaaaatgtgcataatgaacttggaaaacatcttcattcatataactccaaattttgttgttgttgttttttttttttgagacgaagtctcactccgtcgcccaggccagagtgcagtggtgctatctcggctcactgaaacctgtcttctgggttcaagcgtttctcctgcctcagcctcctgagtagctgggactacaggcgtgcaccaccatgcccagctagtttttgtatttttagtagagatggagtttctccatgttggccaggctggtcttgaactcctgacctcaaatgatccaccctcctcggcctcccaaagtgctgggattacaggtgcgagctactgcacccagcccaaatgttacaaaactagagtcttgttttcccttgattttaaagactagtcaagtgcaataatgagaatgagaagaggggaagagtattgagtcttaaatataaagtattttcctttcagcaagtccaagtaggggctcaaatttgaaagattgtccaggctaattaatctgaccaatgttttctttcatgactcctgtgtgtattttgtgaagggactttccctctagtattatttgaaaattatttaatgctaatgcacaaaaccattggcttaggagtgataaagaaagcataggttgtttctttgccacagaagaataattagaatgcaatctaggctagtaatgtgtaagcaattgctatctggtgtcctgtgtaaaatccaatctggaagactttcagtccagtttttaattagagtatctgtgacttggctcttactttgaccagaagccagaagtaggcctctggggtcttggagtgagccatattatcctttcttggccccgaacctgtttcagacagagaattcttagccatcatttttaatttttctgtttttcgctggtgtggaatggagtaatagatacaggtatttctgcatctgtaaagagatagccctagtgggtgagtttcttcttctttctattttttcttgagttagacctcaaaggctctgttctggttgataggatagatatttcccctttcttctgctatttagaatatatctaaacagtgatatctaaaaatattaaatatctatatgcttctagaatgcgaagaaggtagagatggaagaaaaaataattctcacttgttcatctttttttcttttattttctttctttctgtctttctctctctctctctttcttttcttttcttttctttcttgagacagagccttgctctgttgcttgggctggagtgcagtgacatgattatagctcactatagcctcaaccttctgggctcaagcaatccttccatctcagcctcctgagtagctgggactacaggcatgtgccaccatgcccagcttctttcttctttttttcacagagacagagtgttgctttgttgcccaggctggtctcaaactcctggctccaagtccttcccgctcagcttcccagagtactgggattacagtgagccaccaagcctggccacttgttcattcttgagatgtaaggatgctgttggagtagttggaacatgaaacacatgactacccatcaagtcagccctttgagagttgatttaaatagcattttcaatattctttatatgttgtcatttaatagtcactctttcttagataggtattatcacttgctgcatttcaggaaactgagttaaagaggttaaatttgcttgcgcaaggtcacatggccagtagcttagtagtgctttgaaccctagtcctcagactccaaatcctagactctaatttgctgctatatctttctctttgttattacagtatcaaggtttaagtattaacaagaataatcaaatccattggcttattgttttgccctctaaaaaatttttagagaatttttggctgtctctgaatgagtttttatcttagtaatatatggcacaaaactcatttcaaaaataatataaaaatatggctcacttttttttcttttttatgttttgcaaattagacttctggctttgaagttcttccctcacatcacatctggtaaatcacagaagttttctcttgtcagaggactacaagataacccatctttcagtcattttaactgagactgaaactgaatatgtcttatagtatatttgagcatttctctttaaacaggcaaactatgatttctagtagtttactgaaacttttaccactgtttttcaggttaacgttagcagaataccatgaacaagaagaaatcttcaaactcagattaggtcatcttaaaaaggtaagtataatgagaaaatctccctggagaaatgtgatacctagtttaaatttggggttgaagctatttggtcatttgggtgaatgtaatagtagctgcacatagcagcagaaagcttcagtgactgctttcactgtcatgtcttgtagcctaatggtagaactcatatttttccattttctttcttcttcttttttttttttttgagttggagtctcactgtgtctcccaggctggagtgcagtggcacgatcttggctcactgcaacctccacctcccgggctcaagcgattctcgtgtctcagcctcctgactagctgggattacaggcacgtgccaccatacccagctaatttttgtatttttagtagagacgggggtctcaccattaggctggtctcgaactcctgacctcaagtaatcctcctgcctcggcctcccaaagtgctgggattacgggttacaggtgtgagccaccatgcctggcctatctttgcattttcaagtcaattccagcaacccaatgacagtgtttttccccctagtgatctatcagcagataattctgtacacatcataaggcttcccaagtggttatccttggagtaaaatttaaatatataacaagagcagatggttttgaaattgatgtgaagactcctgtcatatttcaaatcacatagcagctcttattccttgcctaaactagctaaaaagagaaagtgttatgtgaaccttattcaaatacaaaggcacataacatagaatttgttattgatgatgttcactgagatatcttagatgtggattactcagctcttaaaattcagaagcccatacattggtcgatgctctttataggtgataatggtcagtaaagatttactaaactgcttttggtatgtgtgcttttgttttttatttcacatattagttttcatgctgttttcccactgggttctcagagcttgttaaataagtagaacttgctggggatggtggctcacacctgtaatgccagcactttgggaggctgtggtgggtggatcacctgaggtcaggagttcaagaccagcctgcccagcatggtgaaaccccgactctactaaaaatacaaaaaattagctgggcgtggtggcatgtacctgtaatcccagctactcgggaggctgaggcaggagaatcacttggacctgggaggcggaggttgcagtgaaccgagatcgtgccattgcactccagcctgggtgacaacagcgaaactccatcttaaaaaataaaaataagtagaacttaagtcaccaagtgtaatccatacttaaagatgagaaccgaaccagatagataacctgatttttgtaaaaaatgtttccatgtctaaatgtatatgcacaaaacattcctgaaaacttatgtaagaaacttaatagtggttattacatctcaggagtgggcatggagaggagggaggaggagggtagggaacttttacttttcttactgaactcctctgtatggtttgaattttattattttctatgggctcatttttatgattaaaattcttaaagaaatctttcaatgcaaagcaccttcctttagcctttcataagataaatgtctgctattgtttttgaaataagatcccgaaaaggtaaagttccccctattttgtgctatttctttccttttcgctttaggaggaagcagagatccaggcagagctggagagactagaaagggttagaaatctacatatcagggaactaaaaaggatacataatgaagataattcacagtaagctacttcagggcatattgggttggagattgctaagcattttatgatatgaattgaatggtctagaataatgtgtttgcttaatgtaagttacataaatgattccatggtgtatttagctcttttgtagcatctaatacaattttgtgaacaaaattatgatttgccttggtttaaatatacaattgtattaaatttatatattaagtatatatgtgtatacatatagcatttttacatgaataaagattactaaaacaatatggctttgtaattgtaaatggttgagatatgttgcatattcagattttcctacagagccttaagaaagggaagatgggtcacagtgtggtgttgtggaaagagtattgggttgagatgacactcggtttctgaatgacctttaagggctattcaggtgttgagattttaagtaagactcttaagttcagtacattaattgtagatgaattgaaactgggaaaagtaggttgaaagtagaaaggggtttttataagtaatctgttttttccccatattttttggaccctgaaacattttttcataaagccatagcttgtatatttttgtttggcttatatgagctttggacctgtctttctgttaaagtggcagacaacagcaggtaccacttcctgagagctctctgtgtatcaggcttggtcctaagtgcccttagtgctctcatttaatccgcaggataacccagtcatctttaatacattaatcagaaaacaagcttagagaaattaaattaacttgcccagggacccataaataatgtgaccaaagagttcaacttggatctttttcatctaaaccaccatgcagtaatgtctctccagataggcatcctactttcttaaaatccatgtaaagtaatttcagaattaatagtgagattgtttaagatcaggaactaggtaaaaatatttttaaatttgtttttgccagaacttgtcatttctttatcatattattaagaaaatacccaaggtagagtctaatatggggaacacagttatatctgtcttaaagagagaataatgaatgcacatagaacatgtgactcactttaaaatcaaatctgtttttaaggaaatagcaagtgtcttggaattttactgtatgtagttttgaaatggtgggaacatgtggcccttgaatagtttggaggagccaaatagcacaatctaaaaatctctaatctaccctccctcattgtatagcagggcagaaaaaaggaggaggagcaagaaaggtctagtgtagctacactgagaccagcacccaagtcctgtggctctatagctggtgctgttcattgtaattacactgcctctttgaactgtgtaactttatactcagtatttgccatgttgatgttgattgtcaaactaccaacagcagctataattatatgtataatgtgttagatattctgggaattttgcaagcgtggaagactgtagtccatgatctcagggtgttacatgttccctgtttccacagatttaaagatcatccaacgctaaatgacagatatttgttgttacatcttttgggtagaggaggtttcagtgaagtttacaaggtaagtataaggaactggatacaaagactgggggttaaattatcggctcctaccaacttggagaacattaagaatactgataattgtaggttgatatccattggttgaaattcaaaaactttaaaaacctgtatctttgggaaaacagctttcaataaacctaagtgaccaagcagaatacagtattgccattttcaagtttgaaaaataaataattatagatttaaaaaacaagaaggaaatatactgggtcgtggaattatgatttttattctggttctgtacttcctgcctcatacatatttgttagaaaaaagtatgtgctatctttctttcttttacagaatagatgtgtcaaacctgtttccaataagaataggtttttttccattggaaaacctgctttttgttttagaagtgttctaatatcatttactagcactggcagtctgaaagagtgtcctggcttagagtgcttcagttgggctagcgaagtacaggctgctgagcttccaggttgatttttaccaaatgagggattcaatatgttttaaatatagctacagatccataacatgtgggtttgatttttctacgtgtttctggcacctgtctgtaaagtacagaattgtttattaagtagtctttgttgcatagctgtccctttcagaaatacagctttcactgttaggatttatgttatgctcatatgaatttatatgtgataaatcttttcagtaaaatagttttcattgcaaataaaaacggtaaaactatttctactgttttcttattttaattttttttaaattgtggttttatttatttatttattttagagatggggtcttgctctattgcccaggctggagtaaggtagcacaatcatagttcattgcagcctcaaactgctgggcacaagcaagcctcctgcctcaacctcttgagtagctgggactacaggcccagtgcactaatttttaaattttttctagagacggggtcttgctacattgcccaggcaggtctcaaacttatgggctcaagcaatcctcctgccttggcctcccagggtgctgagattacaggtgtgagacactgcacccagctgtgattttattaagtatatgtttcagtggcattaagtactacagtgttgtgcgactgacatcactacatcactgttcatctccagaactatattatgattagtgcactactctactggttttgatattctagtatctttttttttttttttttggagacattgtctcactctgacacccaggctagagtgcagcagtgcagtctcggctcactgcaacctcccactccagagctgaagtgtactcccatctcagcctcccaaagtgctgggattacaggtgtgtaccaccatacctggctaatttttgtatttttttttatagtgacagggtttcatcatgttgcccaggctggtcttgaactcttgggctcaagtgatcacaccttggcttcccaaagtgttggggttacaggcatgagccactgcacctggcttctagtatcttatttgtattttttaatctgtgtttataagtaggattggcccatagtcaccttttgtatgcaagcagctttgtcaaaatttgatgtcataattattctagctacttagatagagttgtgaagtctctttttttccatgctctggaacccttttcatcacttgggaattgttggctccttgaaagtttgttagagttgactcataaaaattcttgggcaggacagtctctgtggctcatgtctataatcccagcactctgggagccgaggcaggaggatcacttgagcacaggagtttgaaaccagcctgggcaacatagcaagaccatgcctctacaaagaaagaaaagaaaaatctcctgggagatgttgagttagtggaaaacatttggctgtgttttcaatttcttctacaactattgatatattcagattttctctcccttcttaagtcagttttggtaatttaatttttctaggaaatctatttcatttagatttttttttcttttttaatagagacagggtttcactgtgctgcctaagctggtctcaaactcctagcctgaagtgatcttcacccctcagtcttccaaagtgctaggattacagccaccatgcttggcctagattttttaaaaatattttccacatcttagttacttctctgttcttgtaaaatttttatttttgtgtttcttgattgataggctagagattagtcagtgttgttattaatttttttcctaagaatcaacttttttgttgatcaaaactatttggttagttttctatttcattaatgtctgctttcattccttctttctgctttcttcatttttatttatgttcattcttaagtcaatgcttagtttattttctttgtaattttttattgtaaaaagatagatataaaatttaccatcttaaccatttttaagtgtgtagttcagtaaagtacattcacactttttgtgaaatagatctcaaactttctttcatcttccaaaactgaaactctgtagccattaaccaactttcctttccccctcctccttgtccttggaaccattttacattctgttactctgaatttgactatgtttagatttcttacagaagtggactcatactacgtctttttataatcagcttattttacttagcataatgtcctcaaggttcatctgtgctatagcatgtgacaagattgccttcctttttaagatcacttaatattttattgtatgtaccacattttgtttatcctcctctgtcgatggacacttgggttgcttccatctctcgcctaccgtgtatagtgctgttgtttttgtttttgttttgtttgtttgtttgttttgagacagagtcttgctctgtcgcccaggctggagtgcagtggtgcaatctcggctcactgcaacctccatctccccagttcaagtgattctgctgcctcagcctcttccagtagctaggattacaggtgtgcaccaccaagcccagctattttttttgtatttttagtagagacgggatttcactgtgttggccaggctagtctcgaactcctgacctcaaatgatccgcccatctctgcctcccaaagtgctgggattataggcacaagccaccgcacccagcctatagtgctgttttgaatttgggtgtccagttatctctgtgagactctgctttcaattcttttggatgtatacctagaagtgtatgtaattttaaatcatcaaaattggttcttggtgcctcccagttacttttagtaatttgatcatcctattttttcctaatgtatttcttcaaacattttatttctttttctcttgagacagagtctcactctgtcgtccaggctgtagtgtaatggtgtgatcttggctcactgctgcaacctctgcctcccgggttcaagtgattctcctggctcagcctcccgagtagctgggattacaggcgcccgaccccacacccggataatttttgtattttttggtagagacggggttttactatgttggctaggctggtttcaaattcctgacctcgtgatctgcctgcctcggcctcccaaagtgctgggattacaggtgtgagccaccacgctgagccccacacattttatttctgaaatctaaatacttcttacagtgatgtgtgcatttaatgtagtttttcttttgctgttctccactctccacaatcctttcttaagtcagtggtaggtcacagtgtcttggatttagaatagaagtacagtgtagtagttagagaaaattatgcttgaaatagcattggtgctcttataaattgggtggtatttaatgtttttttcttttgtggtttttttttttttttttttttttttgatacggaatctcgctctgtcgcccaggctggagagtgcagtggtgctatctcggctcactgcaacctctgcctcccgggttcacgccattctcctgcctcagcttcccaagtagctgggactacaggtgtccgccaccacacccggctaattttttgtatattttttagtagagacagggtttcaccatgttaggatggtctcgatctcccgacctcatgatccacctccctcggcctcccaaagtgctgagattacaggtgtgagccatcgcgcccggcttatttaatgtttttaaaaattatttgaaatggttttctactgtgaagccataatggtattcatgattgtgaatggactgaagattctttaagaaaagaagttcaaaagtttccatttttggccgggcatggcctctactgcctctaacccaatattttgagaggccaaggtgggaagattacttgaggccaggagttcaaaaacagcctggcaaacacattgaagccctgtctagataaaaaaataaaaataaaaaatgttgcaatttttgtgaaataagatattatgtctgaagtgagtggtttttatactttaaacatactggttttaatttggtataaatgatggaagtttctctattttataagcagctctctctacatgcagtgcttatccagagaaacttaggtttagatagatctgtaaagtagtgatcaccctatttaggtactgttttctgcacttgttgccttcatttatttgtatatttgtggaaattagcagatgggtgataacagtgttgaaactgaagtagtaagcttttaatctaaactttacaaactaagaaaaactattctaaagaagctatgcaataaattcttttgtttggagggaaatcttcaattgaattgaaagattactttatcaaattatgatttacacccagcttcctcaaaaatccatgttacctttttcactgtgctatagcaagcactacatagctgatgcaggacttgctggcagtggtggccattggggaaagctggttcctgcctctggacagtgctggagaagtgacttggggtgactaacttcagccatttttgggattagaaactgcttttcggccaggcgcagtggctcacgcctgtaatcccagcactttgggaggccgaagcggggcggatcgcctgaggtcaggagaccagcctgaccaacatggtgaaaccccatctctactaaaaatacaaaaattagccgggcgtgatggtgcgtgcctgtaatcccagctactcaggaagctgaggcaggagaatcacttgaacccgagagacagaggttgcagtgagccaagattgcaccgttgcactccagcctgggcgacagagcgagactccgtctcaaaaacaacaacaacaaaaccacttttcatttacccagcatatagagatgggactaaaggcagggctgttttttgttcttgtttctctttttattttaataaacaatatgccaaattacagggtggttttgtaaacaatcataccaaagaagtatattgtgaggggttattttctccaggaggcaggcagtgtgtgtccctggaatttcaaaagtgacaggatgtttgaagcttgtaaagtcccagtgtcaactgaaggataagagacaacctaaggcagacgggtcccagacaggaatagatggtgtccagaaagagaatggttgggaaatgattctgaaggcaggggctatctttctgtttgtggtgttggcctggttttatgttctaaatcccttggtgccagtgtgtctggagacttctaaattatctaatcacaagtttcaagaaggtgcttgcaacactgatataagtatgtgatgtatttaataatgtattttggactttgattatgttatatgttaaattaaagcttcacatcagttacctgtaatttttcttaacatttacccagtatataatttattctctttataggcatttgatctaacagagcaaagatacgtagctgtgaaaattcaccagttaaataaaaactggagagatgagaaaaaggagaattaccacaagtaagtgatacttgagtgtctgactttttaaaattaaataatacctgtagtttgagcattatgctacaagctttacgtgcattgttgttggttttgttttatgtaatcttcataactgccctgagagaataaatacattctcagtgttacgacgaggaaactgatgcttacagaattggagtaacaggaagtggctgagctggtatttaaatccagactttcctgaatccaaagccctaggtactcttaaccttcccttcctttgtggctagaaatagctatagtaaataaagccttagaaatcatttttgctggccgggcacggtggctcacacctgtaatcccagcactttgggaggctgaggcaggcagatcacgaagtcaggagatcgagaccatcctggctaacacggtgaaaccccgtctctactaaaaatacaaaaaattagttgggcgtggtggcaggcatctgtagtcccagctactcgggaggctgaggtaggagaatggcgtgaactcgggaggcagagcttgcagtgagccgagatcacgtcactgcactccagcctgggtgatggtgcgagtgcgagactgcatctcaaaaaaaaaaaaaattgttgcttgtctatagaaactagaccctagggagctgctggtgggctgtttctgctacttcagtcatttccttctagaagagactgggggcacctggtgtgtcttggtggcacctgtttgacttgttcagcctctctgtgctatgttctcctcccggtcacagtttgcccatctcaaagttcttggtcttcagggtcccacttctgtgcttgcttctctatagaatagtactagtggcagccttcatctgtacttgggatgtggggtagagagggggggcttctttaaaatgaattgttacaatatgcacagctgtgaattgctttgttccactgatgtcaggttttgcctatatctccccaagcttctgaacgttggagttcatggctcatttgctttagaggctatgcagacttaatttgctattaggttccccactgggcttagttttgtttccttgttgttggtacaagtattgaatcagacaagtcctgcccttgaaaggaggggacaggcttttttgacaaagcaaacacctcctttctataaaggcagtcttggttttttttggtgttttgtttgtttgtttgtttgttttataaataataatttggaaggggaaaaacagtggtctttgaagtagccctttagttggcttctagcctggtccaaggcaactcttgctctatacctcttgttcatcagggacccagaagttcttcctgttccagacagatgggcagtggtgctcagcactggagaagggaaggttcctgctacattaagagcaacagggcttagcagagggagaagggatgacctgtggcaccctgcgtgtgtttcttaggtgacaggcagctgcagtccagatgctcctgaggagcagttacattattataagaacattccagtcacttgatatgtagggatgagtggcacaccgtagtgagtgccaggagcacttcagagaaggaaagcacatgttgttctgaccagttataagtgagcaatgccactactgtattgagaccctaagaatgcctaagggtgttggaccagtacatgcttctctttaaaaatgccctgtagggcatttttatacatatacagatgtatatgtataaaatatacgtatacatctgtatatgtataaaatatacgtatacatctgtatatgtataaaatatacgtatacatctgtatatgtataaaatatacgtatacatctgtatatgtataaaatatacgtatacatctgtatatgtataaaatatacgtatacatctgtatatgtataaaatatacgtatacatctatacatatacatatttttatacatatacgtctcctgtgctgagacgtatatgtattttgcctagtctcagtatccaggtttctggctgaccttgcagagagctctagtgttggataccacagcaactgcaggtgggcgttctgcccatctagccttttgaaacactgaggagtggaagccgggccttgtccctccttcaaacagttggcaagcactctgaggcctggtgggtatggattgggtgttttctcacatatgtctctaccagacagaatcagagagcacgtgaaggggatggtcctatttgtctaagttctttccattcaagttccaggctggcattggtgcctttctactctgtttcctcatcagaggagggatcatggtgcctgagctcatctgaggagggggcatttcctatttggcagacaccttggggagagggtgtgtgagttgttgtgaccttcattcttgcttgggcagctggggggagttcttttttttgttttgttttgttttccaatcaggaagcagcactgaggagacaattcttaagtacctccacctttcttttgaaagaattggctttctaagtgatataaaatcatactcatgcatttcaggctatagaaaatggcgaattgacaaaatgtcattaactgctttgaactaaaaggagacttacatcaagcacataacggacattgatgagtgctttaaaaattcagtattaaactaaaaagtagtacacttcagtgttgtgacattataaaatatgaaaatgctataaccctgctagtaaggtctgttaattgcgtttccattcatggggatgacttcccagtcccatctggaatcaagacatttattctggtaaaaaagaaggcagatttcaaaagaaaataaaaggtgtttgttttgttgtattttgaattttgttctgtcacttcattcctctcctcctcctaccataagcaaacaaaaagtaaactgattgttttatttatattataaaaacaaattttattaaaaatttttattttaaaaatttagtattacgactgctttaactccctcaaataacatattaaaaattctgccgtaggaaaaatttcacttaaaattatttgcagaagtaatttgtatcggagttagtatgcttttgtatgatactctattctaattttttaaagataaaagtaagcattttgaaaaatctaaatatatgttaacttataagagagtaaaagacattttggtggatgagtttcttccagtttctcattaaattctctgtatttgtagtgcatggatctcttggattataagttgaaagttgaacatggctcagtcattgccttgctgatgaagtaagagatgcggttttagagctgggcacaggttcagcgacactctgcaaattcccttaattggcgagaactttgaatgacattttgattcttaaatttttgctgccttttgtttcctgtgttttctgtacctcaacaagagaaattggtttctgctgtaaaatgcacaaaatcaagaagttaaaaccaaagggtagagcgctatacatttatagcatgctagagtgaaaaataacttagaacagtgatctgtttagtccctagatttttaaactttttgtttgttttttgtttttttgagacagagtctcactctgttgcccagactggagtgcagtggcgcgatctccactcactgcaagctccgcctcctgggttcacgccattctcctgcctcagcctcccgagtagctgggactacatgtgcctgccaccaagcctggctaacttttttgtatttttagtagagacggggtttcaccgtgttagccaggatggtctcgatctcctgacctcgtgatccatccgcctcagcctcccaaagtgctgggattacaggcatgagccaccgtgcccggcctttaaccttgaaaaaaaaaacaaaaaaaacaaacagcagcaccggctgggcacggtggctcacgcctgtaatcccagcactttgggaggcggaggtgggtggattgcctgaggtcaggagttcaagaccagcctgaccaacatggtgaaaccccgtctctactaaaaatacaaaaaaagttagccaggcatggtggcaggcacctacctgtaatcccagctgctcaggaagccgaggaaggagaattgcttgaacccaggaggcagaggttgtggtgagccaagatcgcgccactgtatgtactccagcctgggcgacagagcgagactccgtctcaaaaacaaaaacagcagcacgcttattttatcaaatgcaatattacaaggaatcttaatgtatttaaaaatgcaagtgtgctggcagaaaggggactgatgattctgtgactctgcagttgcagaagctccgtgtaggagattatttggacatagcgattaaccctcttaatcaggtgccacctccttcagggcacatgagatcatattaaattctttttgagatagggtctcactatgttgcccaggctggtctttaactcctgggctcaagcaatcttcccacttcagcccgccaaagtgctgggattacaggcatgagccaccacacccaacaagatggtattaaatctctttactgtttcttgaatgtatttttcagtcagttttgtaaaataaaaacgtacatactttttcctctcctgcttattgcccttaagcctttaaattctaaacaaattgtaatgcatcctatttaggagctagatttggtgatgtgctattgtatgattactaatagaaaatctgggcagggcgtagtggtccatacctgtgatcccagcactttgggaggccgaggccggtggatcatgaggtcaggagtttgagaccagcctggccaatatggtgaaacccggtctctactaaaaatacaaaattagctgggcatggtggcacgcacctgtaatcccacctacttgggaggctgaggcagaagaatcccttgaacccaggaggcggaagttgcagtgagccaagatggcaccactgcaccccagcctgggcgccagagcaagactgtcttaaaaaaagaaaagagaaagaaaatctgtatgtttctagcccttctgtaaaatatgaagaaaagtgctcttagcactctgtgtaaaactgtactgttaaatatatgtaatttaaaaaaaaaaaaaaccagcgtggagctactttggaattgagggttggggaggccaaagctacatttgctgagtgtctgcagcaagctcacttcaaaacatccagtccagtggtgccgaaaccgaagctcagagaggtggagccacagagccacagcaaggagccaggcctctgtgtccccagggtagtgtgtgttctaacacctgcctcagtgctggcaagtcgttttttggaaaaacgtaaagatgatgaaatgaagcgtcaggggaggcaaaatggccaaaagtggcagcttggaaactaagcccaaatagtttccattggggaaaaatatatgtaattacttttagattcctatttctccctttccccacttcccctaatttttccctcagcttttctttagttagtgcttttctttggtatactggagtttaccggtttctgaaaacatcactgttttttagttttattttaccgtactacggaaagtgtgtcttttccaactagccttataacaaaatgtcctaagccaaatagtgctgaattacttaaaatatcagttactgtctttgtaaataagaactacattctttcttctttttttttttttccgagacagagtttcgctcttgttgcccaggctggagtgcaatggcgcaatctcagctcaccacagcgtccgcctcctgggttcaagtgattcccctgcctcagcctcttgagtagctgggattacaggcatgcgccaccaccccggctaattttgtatttttttttttagtagagacagggtttctccacgttggtcaggctggtcttgaactcccgacctcaggtgatctgcccacctcagcctcccaaagtgctgggattataggcacgagccactgcgcccggccagaactacattcttaaaatagtattggtaattacattgtgtaagcatattctgttcttctaaaattcagaatatgaatatgtcagactatacagtacacttttgttccttatgaaatgatttaaactagaaaagtaccttaaaaatgctaatcatattagtcatatgttgcttaacaatggggctacattttgagaaatgtatcgttaggtgattttgttgttgtgcaaacatcacagagtgtacttaatgtaagcttagatggtatagcctacttacatacctaggctgtatggtatagcccattgctcctaggctacacacctgtatagcatgttactgtactgaatactgtaggccagtggtttccagcctttttggcaccagcgaccggttttgtggaagacagtttttccatggaccggggacagggggagatggtttcaggatgattcaagcgcattacatttgttgtgtactttatttctattagtgttacattgtagtatatactgaattaattacacagcttaccataatgtagaatcagtgggagccctgagcttgctttcctgcagttgaacggtcccatctggtggtcatgggagacagtgacagatcatcaggcattaggttctcataaggagcacacaacctagatccctggtgtgcacagttcacagtagggtttgcactcctatgagaatctgtgccactgctgatctgacaggacgtggagctcaggcggtcatgcgagctatggggagcagctgtaaacacagatgaagctttgctcactcacccactgctcacctcctgctgtgtggcccagttcctaacaaggcacggacctgtactgggttggggacccctgctataggcagttgtgttactaattgtgtatctaagcatatctaagcatagaaaaggtgcagtaaatatacagtataaaaatggtacacccgtaccattaatagaatttgcaaaactggaagttgttctgggtgagtcagagtctaggatactgttgtacactactgtagactttataaacactgtacacagaggctacactacatttattaaaaattttttcttcaagtataaattaaccttcacttactgtaacatttttgctgtagaaactgcctttttttaacctttttgactctcataataacacttagcttaaaaaaatcacattgtacggttgtatgaaaatattttctttccttgtatccttattctataagcttttttctattacaatttttttttatttttaaacattttttgttaagaactaaggcacacaactcattagcctaggcttgcacagggtcaggaccatcaatatcactttcttccatctccatcttgtcccactggaagctcttcagggccaataacatgcatgaagctttcacccccatgataacaatgccttttcctgggataccctccgaaggacccgcctgaggctgttttgtagttaattttttttttttaataagtagaagtggtacactctaaatttttttttttttttttttgagatggagtctcactctgtcgcccaggctggagtgcagtggtgttatctcagcttacttcaacctctgcctcctgggttcaagcgtctctcctgccccagcctcccaaatagctgggattacaggtgcacaccaccgctccctgctgctttttgtatatttagtagagacgcagtttctccatggtggccaggctggcctcaaactcctgacctcaagtgatccgcctgcctcagcctcccaaagtgctgggattacagccgttagccaccgcccctgctctctaaaatttaaataattaaaaagtacagtgcaggccaggtgccgtggctcatgcctgtaatcccagcactttgggaggccatggcaggcggatcacttgaagtcaggagttcaagatcaacctggccaacatggcaaaaccccctctctactaaaaatacaaaaattagctgggcgtgctgggatgtgcctgtaatcccagctagttgggaggctgaggcaggagaatcgcttgaacctggaaggcaaagaccacagtgagctgtgatcgcgccactgcactccagccttggcaacagagcgagactccatctcaaaaacaaaaaaagtgcagtacataagccctcacttagtagcagtgataggttcttggaaactacaactttaagggaaacaaggtgtaacaaaaccaattttaccataggctaattgacataaacaagagttaagttcctgtggcatattcctggtcacaaaaacattacccagcttctaaataaagactaaaacacttctaatactaaacgttgaaatgtatatgagctttatatacatttaagaaagtttaatagaaacaaggtaacatttacccactcattccccactcagggttgagggtggccagagcctatatcagcagctcaggggcaaggtgggagccaccctagacaggatgccatcccattgcagggcgggtacacacacacacacacacacacacacacacacacacacacaccccatgtgggtatgccggtgaacccaacacatgtgcctttgggatgtgggaggaaagcagaataacctgagaaaacccacacagataggggaagaacaaacagactccacatggacagtggtgccgaccaggaattgattttttttttgagacggagtctaactttatcacccaggctagagtgccatggcgcagtctcgcctcactgcaacctccacctcccaggttcaagtgattctcctgcttcagcctcttgagtagtggggattacaggtggccaccaccacggccagctaatttttgtatttttagtagagacggggtttcaccatgttgggtcaggctggtctcgaactcctgacctcaggtgatccagcgacctcaggtgatccacccgccttggcctcccaaagtcctgggattacaggcatgagctgccgtgcctggccccctttttttttttttttttttttaaatcagcgttataacaaaatgatgttatttaagggcctgctgtatagtaaatacataaaccaataatgtattcatttattatcattatcaagtgttatatactgtagataattgttaggtgctagactttaatatggctggcagcacagtaggtttgtttacaccagcatcaccacaagcgcgagtaatgcattgtgtggtgacatcatgactgctgggttaccaggtgataggaatttttcacctctgttgtactttttttttttttttcttcctcagttcatgggaagctctgttatactcttatgggaccccgtcatatgtgtggcttagcatcattgaccgaagggttgttctgcagtggatgactgtatcaaattcgccattctaagaaaactggggttccataatttcacatttcatattttattagaataaagtaaagctaatagcacttaaattgtttttgtaagaaggatttaaaaacaaaaaatacaaagtactgctaattgatttatgtaacagataatgctttaacctaaggggtttacatgctaaaaatgacccctttgatgttacccgagcatatatacatttacagatatgatgtatcagctttagaggaggggggaaaataaccgtccttgttattttaaaatctatgatacttgagtatacgtggaaaagaggtgtgattatcatagaatgaacttgaaagggatgaaaagggttgacatccattcacttaacaaatatttgagcacctgttattttattttattttatttttggagatagagtctcgctctgtcaccaggctggagtgcagtggcgcgacctcagctcactgcatcctccaactcctgggttcaagtgactcctacctcagcctcccgagtagctgggaccacaggtgcgcaccactacgcccagctaagttttatatttttagtagagacggggtttcaccatgttggccaggatggtctccatctcttgacctcgtgatccacctgcctcggcctcccaaagtgctgggattacaggcgtgagccactacgcccagccagagcacctattattttctcaatggcttggtagattccagtggagaaaataggatgagcaaagagaaaagtcagatgagggaccagatggacctgaatggaattaacatgtggagacaatagagaaatgattgaatatttaggaggatctttgaagagttctaaaaggcaggccaatataccttcttgttaattttcccttttgtttacaggcatgcatgtagggaataccggattcataaagagctggatcatcccagaatagttaagctgtatgattacttttcactggatactgactcgtaagtgctgtgctgttttaccttaacagttatattattttcttgcaatgctgattgttcatggaatagagctgaactctgggtccaggacataccctctgagggaaccaagtaatttgtgacaaatgatcaaacataaattcagatttggatcagcaagaaacctctaggccaaaggacatgtgcacttgtgtgccagtaaatgtttaacagccagcttggtatgaagagagacagggctaatttatagtgtttgccagtttccgtggtgtagatattcctcctgtgtctaattttgatgtaccacctgtttatttttgtttttttttaaacatcttaattataattcacatactgtatgattcacacatgtaaaatatacagtttagtggtttgtagcatattcatagatacatgcaaccaccagaggcaattttagaattttttcaccatctcaaaccccatcataccttttactactattcatctattccaccattccatccctctgccctagccctaatctgtctgttttatctttatagatttcctattctggaccctcatatgcatggaatcatatagtatgtggacttttattactggcttctttcacttaccatggtgttgtcaaatttcatccttgtagcctgtgtcagtacttcattcctttttatggcaaaataatattccattgtgtggatataccacattttgcttataacggtttgataaccagctcacaaaattcttgaaaatttaagtcagctcttggaaactggcatgagttggtgccagcatgccactgacgtgcactagtgagtgtagactgttcaagagagtttctgctcaccccagagactcttatgaacattgacagacctttttaaaaagtactggccgtgtgattttatcctagactgagataagaaatgtggcactaatgaagacaaggctcagtgctacatgttgaaatacaggctcataggcttataggatgttagaataggaagggatctcagagtccagccttttcattttataggtggattttgaggaccagagaagttaaataacttgtctgagatagttattaattgtgggcattgctatattttgttacttggtataggtaacctcccgtgcctctgggtttatccagcagtttagctggatatatctcagcatttggaaatgtttctctgtagaagtctgaactgaatcagaatataccctaggtctagacttcaggttccctcagcctcccagggtaattctaggagttttggtctgttctagccaacagtctcagatatggctgtgcagacagctgccttacatttagaaataaccccaaagaggactataattccctttggaaacatgacctgggccattctctcagggatttcttctcatttgggtagccctggcactgagcttagccatgtgtgtttcacgtggagtggaatttttttaaaaagatctagttagaaggcaggattgggaaacaaggggcggggcatgacattactgttttgccttgagcaaatttcttgaatactaggtagacccccctctctgaactattaagttcaagaactatttcaaagttaaatatcaggctcaaattatctgctgttttgaattgtatacacacttttaactaatgtgagaaattgagttggttctatactattcttgagttgattactttgttcttcctattgtatgtatgatgaattttcaccaaaaataagtcagaccatgatttttagaacatcttctgagaattgtttgggtattaaaagtgaggctttattttcttttctttcttttgttttggttgttttccttttttttttcctgagatggagtctcactctgttgcccaggctggagttcagtggtgcgatcttggctcactgcaacctccacctcccaggttcaagcgattctcctacctcagcctcccatgtagctaggattacagatgcacgccaccatgcctggctaatttttgtatttttagtagagacagggtttcaccgtgctgggcaggctggtcttgaactcttgaccttgtgatccgcccgcctgggcctcccaaagtcctgggattacaggcttgagccaccgcgcctggctgaaagtgaggctttattttcaacttgcatttgggtgaaagaatcattccattgagcatgagtctatatttcagatttcagaatctcagatcagaggaatctataaatttcagacatttctttttttaattttattttatttgagatggagtcttgctctgttgcccaggcagtagtgcagtggcatgatcttggctcactgcaacctccacctcatgggttcaagcaattctcctgcctcagcctcccaagtagctgggattacaggcatgcgccaccatacctggccaattttttgtatttttagtagagacagagtttcactatgttggccaggctggtctcaaactcctggcctcaagtgatccacccatctctgcctcccaaattgctgggattacagcagacatttgttttcaaatagggtgttagcatgccctgccatgtttcttaagatacataagatattgttcagtttgtggtgtccacaggaccatgtgtgtccatgttcaattgcagtgctttatgaaggcctcaaattgctcagtggcccatagcgctagacctgagtctgtttgctctcagttctgttcctcgccctttcgctgctctgtatctttggggggttagcccgtgtaggctgtgtttatcaggcccatgtgtccattggtgttctgttggtttcagccaatgggaaggcagaaatgggagggggtctccacctcctctccctccccgcaattctagtttcccctgatgaccctgggttctggtttcaccatctcctcccttctggcctgcttgcctgagggtgctaatggcttcctgctgtagatgatctctagggtgcctcactgaccagtttgtcttctcagctcttccatcatctgtatgatcagttccctgaattaaagtctctctgttttaaatgttcaggtggtttttttttccaggctaaactgactgatacacccacattgtcacaacttagaaaacttcaaaacgtattcatccctcaggaatattcaaacagttcaggacaccttacttcagagtataatgccttggaagatagacacgtgacctgtgatgccaccaatggcatatggttttatgtatgggtctgtatgacatattgacataagggaaggaaagagaacccacatacttttgttagaaccatagatactatactttacaagctcttttacaccttgtgtttaagagaaattgtagtgcagtattgtgccaagctgtcagaagacgtagtatgcagtcagtttttgggacgtgggcaaactctagattcttactcattgccagcactcagggttatataaaatgtttgcagtgcgaattgtgtacctagccaaaattgcgccactgcactccagcctaggcagcagagtgagacggagtctcaaaaaaaaaaagagagaattgtgtacttgatcacattctggttgtttagacgtggatgtgtggcatgggtgtgtaaaggagccccttccaagaagatacctagcttaaatacattatagttcttatcagtattcttatagtctagactcaagaagaggtctgccatgggtgaacttgagcacaacagattccaacattgagggtgtggaaactcttcaagagaataagcagtttcttaccagaaacccctcagctaatactgaataaacaattgaagagtattttaaggaacaaagaagaaaggagtgagaagctgatgacctgaagttttcacatgggactaatttaggtagtgttaatctgcttgctcttattccatggttaaatattggtttatttgtctttaggttttgtacagtattagaatactgtgagggaaatgatctggacttctacctgaaacagcacaaattaatgtcggagaaagaggcccggtccattatcatgcagattgtgaatgctttaaagtacttaaatgaaataaaacctcccatcatacactatgacctcaaaccaggtatgtctaacttttaggagacagtattagtgggttttctttggtcttataagtgacttttaatttgataaagttagagaatttcacagcagccaagaaaggctaataacatctgacttttgattgcctgggtaggtgtgggaaaaaagagtcctggccaagcagcactgggtttaggagggcgtgttggattaaatactctggagaaacaatacctttatctttggagccagggcagttcatgatgtaagtctcattaagaaagaactgttgcagcaagttcagttttgtttttttcccatgactcctactacataacagtccctctgcttcaggtctctttgataagagcccccaaattaataacttatttttacttatatgcctcccatttcaataaatttcaagcagaatttttcatctttttgtatggttattatctagctttgatgttcatcagcaaagagtacagggcagctagagtccttacctctattttttattgttatcttcagctgtgttttagaaatctgcatagttctatagacaactctaacagcttagcttgggcattaggaagatggtccacatttaccttctggtgttgcaaaattgtaaactttgctttactcttctggtaggtgcatattgcgtctcattgactattctctaatgttctaatacaattcagatgactaaaacattaattatgatgaagaaattttttaaaagatggctattttgtgaatgaattttccataactgaattcaacactttcctgcaatgggagctgtaggcggtgctgtggtgctagctttggtttccttacatggtttctttgattcctcccccacaccccaagtgctgttctaaacagggtagtttagagatcctcactgaaagttcagatgaaagtttcccatcagttttgaccaagtgaacaagggtattttactttggccagttatttttatttccagagctcatcatagtggtggttttggcacattaagcaggtgattcttggaaaatagaagtttcagcagatgctgaggactctccctgagtatccagagtccagattgcttgattcccaggatttggatgtttgcttttgcaagagtttgagttcagttgtccccttcttatctgctattactttgggtttttctcttaaatcagtaagtctctgcttattcatgaaggtttttattttttaggtaatattcttttagtaaatggtacagcgtgtggagagataaaaattacagattttggtctttcgaagatcatggatgatgatagctacaattcagtggatggcatggagctaacatcacaaggtgctggtacttattggtaggtatccaggagctctgccaggttggctatagagatgtggctctgctatgctgaagtgttgataatgaattaattgctgtatgctatctgctaggcaaaaatgccataaaccaaagcagactttctccccaaatcattactgtcttttcaacagtttgactcttggtatttatattaatttgtcttaatttttctttcctttcttgaaaatccttaagaaagagagcttatatgtgtccaggtatttgaaatgtatgttttttgtacagagttggccttgcaagtcagtagagaacaaggttgctcatgtgtatataaagaatggccccaaaatctttccgtccaaatacaggtctctcttcatgggttaatgggataagggatttgtctcaagagttgcctgaggatgttggactgtagggagttatgaagatcaggatgaaacataactatagcgcatatgaaatctatacaggaaaaagtgactacaatttaccagaagtttatccatgtctgttagccatgatctaaaagtttttgaggcacatttcttcacatctcttgtcacctgtcttcccctagccacccgcacccaagctacctctgcctgccagttttatgcttctatttctgcctactattacctttggccattagaaccataaaagatacctgaaactcaggcctttaactctatggttgtaaaagtgtgttaataaagcttcctcttccattttgaggtggtcacacaagccacatattggtgtatataaagaatggcccccagttttttttagtccaaatacaagtctctcttcctggcttaatgggatgagggatttgcttcaagagttgcaagagaaggctctatagcaccaacggaggggcaacacatgttatttgtaccctagggaaggtggtcaaatcactttatctttggaactgaaaggtcctaggccttagcagagagtactgactgtctgggaatcagaggtagaggaggaagcagaggggcatggcgttcacaacacagcatcagccctgtgctcatcgtgaagcctgccaataacaccatggacacaatgccccggtttctgttgctccttactgcttgtggaaatggtacctgttgtaaaaagtcagtccctaaattaaaactttgaaattacagatttaaaatagaagctgcatttacaatgtttattcactgtggtggttattgtgggctagtgttcctgtcactaagtgatacaaaaatatctgctgctggaaattctagaaacaggtctatacctctgctatataaattcactggaatttggatttgagctttgtgtttgatctttttttttttaaggcacagtttttttgcatttaaaatagttactgctgtagttgcttacctacaaaaattcagtgattagaatttaagtaaaaattatgtgatgctagggattttgcttcaaagtagtctgttgggagaaatggtggagattggccacatgttgataattcttgaagctggatggtgcttacttagggggtcattttactgttctttctgctttagattatagttgagatttttaataatttaagacagggcttctgagaagattaagtgttacaggtttctatgaaggtttgaagagtctccaaattggtagaaatactgtcataatcactatcttcagtatgtcagataaaaataatcctgaagggtataacaaattataagtaactatttgcagtatttactggttacagaattcttctacattgaatactttatttatttatttatttatttatttatttatttatttatttatttatttgagacggagtttcgctcttgttgcctgggctggagtgcaatggtgtgatctcaactcactgcagcctccgcctcccgagttcaagtgattctcctgcctcagcctctcaagtagctgggtttacatgcacccgccaccacgcccagctaatttttttgtatttttagtagagatggggtttcaccatgttggccaggctagtcttgaactcctgatatcaggtgatccacccgcctcggcctcccaaagtgctgggaatataggcgtgagccaccacgcctggctgaatacttattttaaagaagtgacccatagactatgccttgagaataattgtttttttgtatggggattttgattgtgatggaatatgcaactatatacatatatatatatatatttttagcacagtttagtatcatagagctgtcttttactctcctctcaaaatccttgatagtaagttagaatgcttattattttcagtattatttggatgaagaattaatttcattcacttacaggtggagaaactgagacctagaaagggatttgccagacatgtacaatcaagtgacaggtctttttatattctaaaaatcttgctagccaggtgtggtggctcatgcctgtaatcccagcactttgggaggccaaggcgggcggatcatgaggtcaagagatcgagaccatcctggccaacatggtgaaaccccgtgtatactaaaaataaaaaaattagctgggcgtggtggtgcacgcctgaaatcccagctattcggaggttgcagtgagctgaggtcacactactacactccagcctggcaatggagcgagactctgtctcaaaaaaaaaaaaatcttgctaacttatttttctgcatttggatgagttcaacaactcctattctttcctgccactgccataaaaaagtcacaaatatatttaaatggtcattttagaattaaggttatacttatccaagatcatatttaagttatgtatattaaaaaatcaagaactggccaggtgcagtggctcatgcctgtaatcccagcactttgggaggctgaggcgggcggatcacgaggtcaggaaatcgagaccatcctggctaacacggtgaaaccctatctctactaaaaatacaaaaaattagcccagcgtggtggcacacgcctgtaatcccagctacttgggtggctgaggcaggagaatcgcttgaacctgggaggcagaggttgcagtgagccgagatcgtgagtgaagtgggactagtgagaatatttaccactcttaggaaattgagaactattttgatgccctatagggacattactgcctccctaagttagagtgtcttttcttactttgagatgggggtctcactctcttgctggagtgcagtggcatgatcttggctcactgcagtcaacctcccccaggctccggtgatcctcccgcctcagcttcccaagcagctggagctacaggggtgtgctaccaggcgcagctaatttttgtatttttagtagagatagggtttcgccatgttgcccaggctggtctcaaattcttgagttcaagcgatctgctggccttgtcctcccaaagtgctgggattaccacaccccgcctagagtgtcttttcattgactttccatataagtctaagttgactgttaaaattcatatattttggccaggtgtggtgggtcacacctataatcccagtactttaggaggtcgagctgggaggatcacttgagtccaggagtttgagaccagcctgggcaacacagtgagaccccactgctacaaattttttttaaaaactacccaggcatggtggtgcctgcctttaatcccagctacttgggaggctgaggtggggaaaccacccgagctcgggaggttgaggccgtaatgagccatgatcacgccactgtactcagcctgggtgacagagcaagaccctgtctccaaaaaaaaaaaaaaaaaaaacgatatttctattttcaacaagatattttattttgtctttttgtacatgtcttaaacttatatgatcattattctaataatttatatttcttttttgtcccaggtatttaccaccagagtgttttgtggttgggaaagaaccaccaaagatctcaaataaagttgatgtgtggtcggtgggtgtgatcttctatcagtgtctttatggaaggaaggtaagttagaaggttgatggagaagcttgatctctttcttgggtggcacacacacacacagtgccttggtatggattagtctattggagttaattattgggttatacaaaatagaatcctgaaaggagtggtttaaagaaaatacagacttaataatacaagccttattcgtaagcagaaatcctcaaccctagggcacctaatgagttctgcggggctgttaaaaacatgcacttttgctgttctcaattagatctggaacatgtatttattctgatagtgtgtatagggatttacaaaaatcgtttatttattaaagtatacaatcttcccaagaacctgggggccccaagaaccaaaactcaaaatatccccagaatctttatcgccagccatcccattagttgaacctattattaatgaaagcgtgctttatatttctatactggggagatggtgtcaggatgtattcattgttacctctgatcaaggtgacatatttcaacaagtggtaaactacacctaatgaattgtcacatttgtttttccttgtgaacatgccttataaatgtatatattaggatccatttgtgtatttatgttcctattgctgtttttgtgtgtttgtttgtttcagtgtttcccagtaggctgtgggtataagccagatgggagttctgtgtgtcctttgaattcttaatattttgattacattccccagaccaggctcttaattcagattataccttcctctttagcttctccttggtcttttttttttttttttttctatctcacctctctaaaacagggaaactattcagaggtagtaggcttaattattatttacattccctgacaatgttgaattgctgccgataacagcagtagaaattatctagaaataactgtttgagagagatctcagtagaaccagtatagagagacttgagttgaacttgtttttaagagtttattagaaaatggcagctcggtgaccaggcgtggtggctcacacctgtaatcccagcactttgggaggccgaggcaggtggatcacaagatcaggagatcgagaccatcctgactaacatggtgaaaccccgtctgtactaaaattaccaaaaaaaaaaaaaaattagccgggcgtggtggcgggtgcctgtagtcccagctactcgggaggctgaggcaggagaatggcatgaacccgggaggcagagctttcactgagctgagatcatgccactgtactccagtctgggcgacagagcgagactccatctcaaaaaaaaagacaaaggaaatggcagctcggcatagttgaagccattaagtaaccccaactctttctttttcccactctgtccttacccctcttggttttgacttcctttccttctctttttctgttttttgagttggcctgaggcacaggtgtgtatttcttagggccgcatgtatccctcagagcaggtgaggttgctgggtcctgctctagatctcccttttctctggtgtgagcaaagcttagcagagcattaggatataggagatgctgcttctggtccccactctgctttgacctggtagttgaactgtgagcaagttacatatgctctgagctctcaaccccttttatctataaagtgagagaactagaggggattgtctccagagttccttgcagcaattcaaattagaagatgtcttatccttttccttccctggggtattgaattgttttctctataattttcatcagaggcctacattatttgtttgtttttatgtgacagccttttggccataaccagtctcagcaagacatcctacaagagaatacgattcttaaagctactgaagtgcagttcccgccaaagccagtagtaacacctgaagcaaaggtaagttttgtttgacccattggccaacagaaacggctgctttgctttctgtattacttttttgggtaatagtggatggattcttcagtgtgaaattcagcagttaataaaaatattaggataggcatgaattaatgttcctaagaacacttgacagaagaacattgcttacaccctgaccaccccatccccagttccagtagaaggaatgttgataggtgggtgttttaatctggaaaggctccctagagtcagaaagggagggagagcagactccagttgagagagaacaggtgtgtggatgtcacgaaagatacccagcttcatctgtattcagggattatgattaatttggggagctaatgcccatgtaggagaaattatataagagtactaaggcatttgtattagtctgttctcatgctgctaataaagatatacccaagactgggtaatttataaaggaaagaggtttaattgactcagctcagcatggctggggagaccttaggaaacttaggtaaccacccccatgattcagttacctcccaccaggaccctaccatgacacgggattatgggaactacaattcaagatgagatttgagtggggacacagccaaaccatatcaacattatagggttaaacgtcaggtgaatggtaagcagtaaattctgttgcagttggtgagggcataaaaaactcgtgaggcaaaggaaacatggaatgggaagtggtgaaaaggaagctataaataatcactcatccttgccacatctgtaaaccaagattctagtagccagcctactttttccttgctattttatttatctctatttattaaccagttctacttaggtgagtggtagccagccccattgggtgctgtggtcatttagcatttttaaagtcaaagtgagcagttataagtcttttgttgttgttggtttgagacagagtctcactctgtcaccgtgtctggagtgcagtggcattatcacggctcaccacagcctcgacctccccaggctcaggtgatcctcccacctctgcctcccaagaagctgggactacaggtgtgcaccactgctcctggctatttttttgtattttttgtagacaaggggtttcgccgtgttgcccaggctgatctcgaactcctaggctcaagccatccgcctgcctcagcctccaaagtgctagaattataggtatgagccactgtgcccagccagttacaagtctaatctctttcttcggtgtttgatctctgccgttccctcacagtgtacctatgtgacataggttaggaaagaacctcttttccaagtggtttagctgccatgtcacagggtaagaattaacatctttagcagttgtttataattcctgactgatggctccctgtccccattgttcaacagtttaagtactgcataaccaagaaatcaaatctgcaagggagaagtcccatgacacatccctaaggcaaatgctgatttcctgacttgtcctaggagagctggagagaggctcagctttgaagcctggttaacctaattttggtgtcagctctacactcagtagtagctgtgtaactttaggcaagttaaaccttttaagctgcttttccttatccataaaaacagagacaaaaacatcttccttaaaaggtgttagtagctaggtgcagcgctgtgcacctgtaatgtgctatgatcatacctatgaatagccactgcactccagcctcagcaacacagtgagaccctgtctcaaaaaaagaaaaagagaagggtggttgtgaggtttaagaggactggtagcacctaacccttggcagattctctagctagctgctctcactacccatgccacagctgccacccagagtcgatactgagggacttgaatacattgtctggtagatgtttaattctcctaatctgtcaggtttttcaagactatttctttatataacttttgtcaaattttcatgtttattcaataaataggtgaacaaatgtctccaaaactttagagtctgttagatgaacttgttgtgaagaatacagaagtatctccaaatgtttctgtgcattatctcctgtgtccctgtttctcctaatcctaccctcttctcttcctgtcctcccacaacaaatatttactgaatgcctgtgaaacactaagacactattccgggtagtggagatggaatcgaatatgtagcagtgaactctgcagaacagttccctacccttaaggagtttatattccacttatgagaaaaacaataaaacaaaaagtggatacatttcagatggtgacacatgttatgaagaaataaatcagagtagggggatgaggaggtggaaacctctttttttgatggcatggttagggaaggcctcaaagatgaagtgacagtttgagcagtatcttgaatggtatgaaggtgggagccatgatttgcaggagccgttagatctgcaggggaaagtattttagcagagagaagctcagatgtgagaatgagctttttgcaggtccacagagcaaatgggaaggtggtaagagaggcaggagggtgagggtaagtgtgagggaaggcagttgcaggttttaatcagggcaactatgtgagttgattgctgttttaagagctgacactggcagctacagagaaaattcaaggtaaatgaagtttacttggctgagtgccatggatcacacctgtaatcctatgggaagatgaggtggcaggattgcttgaggccacaagtttgacaccatcttgggaaacatagtgagacccatttctacaaaatattttaaaagtagctagatgtggtggggcacgcctttggtcctagctacttgggaggctgaggtagaggatcacttgagcccaggagtttgagagtacaatgagctatgatcatgcccgtgcactccagcctgggtgacagaacgagatcttgtctctaaaaaaagttttaaaaaacagtttgaccagtatttaagccaagataacctgtttaactccaattccttgtctttcacctagaaaggctcatttttaaaggccaaggatcattatgttcatttctatgaattgtttttatcttccaaatgctttaaccaagccagtacctgtaagtctttaattttgaaaaaccagattggcattgtattattaatttgtttatcaaacatgggggaaaaccaaaaaatcagtagcttgattcatgttgtagattttgtttcaaatcaactttgctttttagagcatttttaggctcatagcaaaactgaaagtatagagttcccttataccgcctgctgtacccatgcacagcctccgcatcgatatcccctgccagagcagtccattcgagagagccaatgaacctatctgtaccgacacatcacatccttgtcaccctcatgtaaaatactgagtttctgtaataatgatgttttagatttttttaaattaatttatttaaaatagttatattgaaactgattaaacagaactagctaaaaaataggaagaaagcaagcaggaaaagacagataatctatataagggcctttatgctaagacttacagaaactaaaactacatagcctccatattggtagtcaactggaattccgtgtgcaaccccactcactgcatttttgggtctacagtattattgcagatgcaagtccttttcacgtttccctttacgacatagggaaataattttataacctgtgacacatcatagtgttagtcgttgtgtgtctcctgacacttcatatggtgacagaattttcgcttcctcaggaagttcacatgaggccatggtttgtagatggaggaccgtgaagttagatcgttcccatccaaaccagcgaagacaaagagagattttttttttttctgttggtcttagtgctttgggggcaggagtatttagaggtcatgcttcctttttcctcccttcagtaatggctcagccctttctgtctgagaagggatcggtggcagcagagaggtacttctgttggtgcttctccttcccttgtgttctttgggtctgcctggtgatttctgaggaaggccttaagccccttctctttagttgatatttgctctgggccctggcagccgatagagagccttagggttccctccaggggtgccaagactatctgcctctgtcttcaagaaactctcctttgcaggcgtttattcgacgatgcttggcctaccgaaaggaggaccgcattgatgtccagcagctggcctgtgatccctacttgttgcctcacatccgaaagtcagtctctacaagtagccctgctggagctgctattgcatcaacctctggggcgtccaataacagttcttctaattgagactgactccaaggccacaaactgttcaacacacacaaagtggacaaatggcgttcagcagcgggtttggaacatagcgaatccgaatggatctgatgaaacctgtaccaggtgcttttattttcttgcttttttcccatccatagagcatgacagcatcgattctcattgaggagaaaccttgggcagctccggccaggccttgtaggaaaaggccccgcccgaggttccagcgtcaacggccactgtgtgtggctgctctgagtgaggaaaaaattaaaaagaaaaactggttccatgtactgtgaacttgaaaacttgcagactcaggggggtccctgatgcagtgcttcagatgaagaatgtggacttgaaaatacagactgggctagtccagtgtctatatttaaacttgttcttttcttttaataaagtttaggtaacatctcctgaaaagcttgtagcacaaaggctcagctggggatggtgtttgacttcggaggaaaaaagttgctattgcccgttaaaggcactagagttagtgttttatccctaaataatttcaatttttaaaaacatgcagcttccctctccccttttttatttttgaaagaatacatttggtcataaagtgaaacccgtattagcaagtacgtggcaatgttcattccaatcagatgcagctttctcctccgtctggtctcctgtttgcaattgcttccctcatctcagtagggaaaaaattgagtgggagtactgagatgtgtgggtttttgccattggacaaagaatgaggttagaagactgcagcttggagtctctctaggttttcaactatttcttcacaatttgaacacttgacggttgtcccttttaatttatttgaagtgctatttttttaaataaaggttcatctgtccatgcagtcctcttggattctctgaatgtagtaactatgaagctatgccaaaggtaggcagaaaatgggcttgggagccagacactccagggatcagtagttcctacccatagtctttgtgtgcttgctaaatggtgtacatttcttgttaaccacgttattaaaacttgatcagcacataa

SEQ ID NO: 37828 - DNA, 3630 bp, Homo sapiens
gtggaggtgtctctgcccagcgtggagacggatgtccaggccccaggatccatgctggatggtgcgcggcttgagggggacctgtccctggcccacgaggatgtagctgggaaagacagtaagtttcaaggaccaaaactgagcacgtctggttttgaatggtcgtcaaagaaagtttccatgtcttcctctgaaatcgaaggaaatgttacattccatgagaagacttccacatttcccattgtggaatctgttgttcatgaaggtgatcttcatgatccatctcgcgatggtaacttggggcttgctgttggagaagttggaatggattcgaagtttaagaaactgcattttaaagtgcccaaagtttcattttcttctaccaaaactcctaaagatagtttagtcccaggtgcaaagtctagcataggtctttccacgattcctttatcatcttcagaatgctcaagttttgaattacaacaggtttcggcttgttcagagccatccatgcagatgcctaaggtgggttttgctgggtttccatcatcccggcttgatctcactggtcctcactttgaatcttctattctctctccctgtgaggatgttacacttacaaaataccaggtgactgttcccagagctgccttggcccctgagcttgctctggaaattccttctgggtctcaggctgatattcctcttcccaagacagagtgctccactgacctgcagcctccagagggagttccaacatctcaagctgagagtcactctggcccactgaattccatgattcctgtttctcttggtcaggtatcttttcctaaattctataaaccaaagtttgtgttttcagtcccccaaatggcagttcctgagggagacctacatgcagcagtgggtgccccagtcatgtctcctcttagccctggagaaagagtgcagtgccccttgccaagcacccagctgccatccccaggcacctgtgtgtctcagggcccagaagagcttgtggcctccttgcagacatcagtagtggcccctggagaagccccttctgaagatgctgaccacgaagggaaagggagtcccttgaaaatgcctaagattaagcttccatcatttaggtggtccccgaagaaggaaacagggccaaaggtggacccagaatgcagcgtggaggactcaaaactcagcctggttttagacaaggatgaagtggccccgcagtctgccatccacatggatctgcctcctgagagggatggagagaaggggaggagcacaaagcctggctttgccatgccaaaacttgcacttcccaaaatgaaggcttctaagagtggggtcagcctgccacagagagacgtggatccttccctttctagtgccacagcagggggtagctttcaagacacagaaaaggccagcagtgacggtggtaggggaggacttggtgcaacagcaagtgccacaggaagtgagggtgtgaacctccaccggccacaggtccacattcccagtttgggctttgccaaacctgatctcagatcctccaaggccaaggtggaggtgagccagcctgaagctgacctgcctcttcccaaacatgatctgtctaccgaaggtgacagcagaggatgtgggctcggggatgtcccagtgagccagccttgtggggaggggatagcccccacacctgaagatcccctccagccatcctgtagaaaaccagatgctgaagtcctcacagtggaaagcccagaggaggaagccatgaccaagtactcgcaggaaagctggtttaaaatgcccaagttccgcatgcccagccttaggcgctctttcagggacagaggcggggctggaaagctggaagtggctcagacacaggcaccggcagcaacagggggtgaagcagcagctaaagtcaaagagttccttgtttctgggtcaaacgtggaggcagctatgtccctacagctcccagaggcagatgcagaagtgacagcttctgagagcaaatcatccacagatattctaaggtgtgatcttgacagcacaggcttgaagctgcacctctccactgctgggatgactggggatgagctttccacttctgaggtcaggatccatccatccaaaggacctctcccttttcagatgcctggcatgaggcttccagaaacccaggttcttccaggagaaatagatgagactcctctttccaagccaggacatgaccttgccagcatggaggataaaacagagaaatggtcttcccagcctgaaggtccacttaaattgaaagcttcaagtactgatatgccatcccagatttctgtggttaatgtggatcaactgtgggaagattctgtcctaactgtcaaattccccaaattaatggtaccaaggttctccttccctgcccccagctcagaggatgatgtgttcatccccactgtgagggaagtgcagtgtccagaggccaatattgatacagccctttgtaaggaaagtccggggctctggggagccagcatcctgaaggcaggtgctggggtccctggggagcagcctgtggaccttaacctgcctttggaagctcccccaatttcaaaggtcagagtgcatattcagggtgctcaggttgaaagtcaagaggtcactatacacagcatagtgacaccagagtttgtagatctctcagtacccaggactttttccactcagattgtgcgggaatcagagatccccacgtcagagattcaaacaccttcgtacggattttccttattaaaagtgaaaatcccagagccccacacgcaggctagagtgtacacaacaatgactcaacactctaggactcaggagggcacagaagaggctcccatacaagccaccccaggagtagactccatttctggagatctccagcctgacactggagaaccatttgagatgatctcttccagcgtcaatgtactgggacagcaaacactcacatttgaagttccttctggccaccagcttgcagacagctgttcagatgaggagccagcagaaattcttgagtttccccctgatgatagccaagaggcaaccacaccactggcagatgaaggcagggctccaaaagacaaaccagaaagtaaaaaatctggtctgctctggttttggcttccaaacattgggttttcctcttctgttgatgagacaggtgttgattccaaaaatgacgtccagagatctgctcccattcaaacacagcctgaggcacgaccagaggcagaactgcctaaaaaacaggagaaggcaggctggttccgatttcccaaattagggttctcctcatctcctaccaagaaaagcaaaagcaccgaagatggggcagagctggaagaacaaaaacttcaagaagaaacaatcacgttttttgatgcccgagaaagtttctcccctgaagagaaggaagagggtgaactgatcgggcctgtgggcactgggctggactccagagtgatggtgacatccgcggcaagaacagagttaatcctgcccgagcaggacagaaaagctgacgatgaaagcaaagggtcaggcctgggaccaaatgaaggctga

SEQ ID NO: 37829 - DNA, 8597 bp, Homo sapiens
atgacgccgcggaggcggccccgtccccgcgctcccgcccctcccgccagggcagcccgggaggccagacgttgacgctgcagggagagggtggtgggcgcagccgctagggggcgcggcggggcggagcgcacctttccgcgggccgcggggatggcggcgcagggcgtagggcctgggccggggtcggcggcgcccccggggctggaggcggcccggcagaagctggcgctgcggcggaagaaggtgctgagcaccgaggagatggagctgtacgagctggcgcaggcggcgggcggcgctatcgaccccgacgtgttcaagtgagcggggcgggtgggggccgcatgctagccagacaccccccgacctctgctttccgggtacgcccggcccgctggtcgggaggagcccccgcccccgtccttgtcgggtcttcagggaggtggccgcgccgggcggagagggctcaccggccccgcgtctgtccccgccaggatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgaggtcagagctgggcccgctgtccctgccccagtggcgggggtggcgggcggggagggggcaggcgcggcacagcggcggcgtggccctgagtggccaggcctgtctgtcggtctaggcccagcacctgcagggcccatccgtgggctctgctcctgggcttcgctgccagccttaggaggcacgtccaggtcaggtggacgcagagtgcgtaccccagggtggtccaggctgggtagggctcctccgcttagctcccctccacctcttcactcaggccttcatcctacaacgtcgggaatcaagacagtttggggctgggcgccctggctcacgcctataatctttgggaccccagggcgggaggatcgtttgaggccatgagttttagaccactctgggtgacagggtgagatcctgtctctaaatgtttttcaaaagacagtctcgatctctgtcctgtggtatacagcatccagggaagtgcccagggaccagggcaggcagaggtcttcctgcctttaccccacctgggcccagttcctgcgcaggggcttggccagtcctggtcagctttccctctgatgactgcaggaagagagtcagacgcggaactcccagggtgcagaggcctgcggggtctgaagggcctcctccctctccagtgtggtgactgggctgaggagattctgggactgagagtgtcatggtggagcctctgtccctgctcatcctctccgcatgttgcttctgctcccgatggctctctctgaaatgcagcacaacctcctaggccaatggaagaaggcccagagctggctccctgcctggaagcacgaggagacccgcacaggcatcctgagaaggcgtggagagcaggctgccttcatggggggagtgccagggcctgggcacccacacccgctgacccaagagggcccgggcacctgcgtgctggcctcttcactgaccttcgctctgtctgctctctttgtgtctctctctgacctccagaggcctcctttctctctgccaggaacagtagcccccctgcaaggccctccttttcctccagcccgcagcctgcggcctctccggttctgctccacagcccggctgccacacactcgcctctctctccaggccccccgggttccctccgcctctcttgctgcctgttctctccttttgcaggttgcgtttattggcttatctctgggggttggtgctctcccttgtttccatggaaactgcctggccccaggaggcccaagcagctttgagctccaagggcaggaccatgcaggccatcgctgccctgccgcttagccacagggcacgatttctgactcggtttattagagacatagtgtggcagtctctagaccccacagtcgggctggcatctggggacaggaccaacacccccacaccccagaggcgaactgtggtgagtgtaaagagcccctctccaagggaagacagccggccagagtgcggtgtgctgtgctggagagcacagccccaggcgtgacaaacacctcggcctcttagaagttgtcccttatctggacaggaagtctggaggctgaaacagagactcccaccttcccagagtctcctgggcagtgccacacagatgccatatgctggccccgtggccacactccagcactcagcccccttgcccacctcactcctgagttagcacactttccaggtgtcagcaggtgtgatcaggggctcagagccagggtcctgtgagagcccaggggtctttggttgcacctcctgcgtgcacttcctgacagcgcccacctcactgccacccagagctcggacccaagggagggtggagaggggctgagggacaggcctggagtaggggtgtatgcactgcaggctgagatgagcaattgaggggcaagtgtccagcaggagggagaaactgggaacagagtccttgtcactccaggggatgttgctgctcactcagcactcactcagggctctgggagccaggcctagctctcagggcagagggtgtggcagggaagtgagatgatcacactcagagcccagtgagaggcagtgaggaaaaccaccagcgagaccagtgtggtggctcacacctgtaatcccagcactttgggaagtcaaggcaggtggatcccttgagctcaggagttcaagaccagcctgggcaacatagcaagaccccatctctacaaaaaatacaaaaactagccaggcagggctgggcgcggtggctcacgcctgtaatcccagcactttgggaggccgaggcgggcggatctcgaggtcaggagattgagaccatcccggctaacacggtgaaaccccgtctctactaaaaatacaaaaaaaattagctgggcgtggtggcaggtgcctgtagtcccagctactcgggaggctgaggcagaagaatggcgtgaacttgggaggtggagcttacagtgagccgagatcacaccactgcactccagcctgggggacagagcgagactccgtctcaaaaaaaaaaaaaaactagccaggtgggcatggtggtggcgcccatctgtagtcccagctacttgggaggctgaggtgggaggatcgcctgagcctgagggggatgttgccgtgagccaagagcttgtgactggactccagcctgggcaacagagcaagaccctgtctcaaaaaaaaaaaaaaaagaaaaaccgctagcaatggagatgggaggaggcttcagagcccagagagcagcaagggttacacaggggggtaacaagggttacagcaggaggggggtcggcagagccccacacgtgtgagctggggcagtgggagggcgtgggtgaggcagagcgctgtccaggtgctggtaggccgggggcgggaggaggcaggtgggggggcacggtcaagatgtatgtgagggttgtggcactggaaatgcaggcatagaggggccaggaggattagggggtgctgtgtgagcgaatgggggctccgagagaatttacccaaggacaggagtggcctggagtgctgggaccctcagggtcatttgttccttgagggctctgtcctggaagcatagcccaggtcctgtaggctgggtggcagaaagccaggacatgagggcaccgaggccctgtggagatagagtggaacctgaggaggaggtggaggggaatggggcagatgtggggccacaccaggagtgtgctgctgagtgagaagcagaggccacagatggaatgctgagagctctctgaggcccacatgttacagcatctgaccacacagagctccggctgccctggtaatggcagaatctggggtggaggacataaggggggttgttggagtgatccggctggggggcatggaggccataggtttcccacaggactcgggtgtggagttctccaggctgtgggccaggccctctcaagcttgcctctgagctgcagcaggcaccctgggtcctctggatgcctgtcccccagccatccagacagcctgtggggacaaccaccaccagattcactcatacccacagggaaggggaaatagaaaaccccagaagcacagaggggcaatgcttgtcttggtgagagtctggagtcattgagggaaaaataaattcagtcaagcgttctatttaagtttagagaaactatacgttttaaaagttgtccagagcatgcatgtaagatgacgtttggagtgtggaagccatctcacctgagctgtgctgcctgatacaggaaccttgagccacacatggctggcatggtcattgcactgcgtgtggtatgcacagcagatgccaaatgaccggtacaaaagggaatgcaaaaaacccaccacaccttgggagtccacagctactggatctcttgagctcagcagttcaggactagccagggcaacacagggagacccaatctctacaaaacacaaaaattagcagggcatggtggcacacatctgtagttccagctacttgggaggctgaggttggaggattgcttgagcctgggaggttgaggttgcagtgagctgtgactgcaccactgcactccagcctgggtgagagagtgagaccctgtctcaaaaataaacaaaaaaccccaaagtgaatgaggctgggcattggttcacacctgtaatcccagcactttgggaggctgaggcaggatcatcacttgaagctcggagtttgagaccagcctgggcaaaatagcaagaccccacccatttctacaaagaaacaagaaaaagaacagaggtgaatgcaacatcttatgaataacttatgtactgattacgtattgaaataatacgttggatattttagattaaagtatttgagctaattctgcattttcttttactttttatttatttatttatttttgagacagtcttgttctgtcacccaggctggagtgcagtggcacactcatagctcactgcagcttcaacctcgtgggctcagacaatcctcccacctcctcttgagtagctgggactacaggtgcacactaccacacgtggctaattttttaattttttgtagagatggaggtctcactgtgttgtcccagctggtctctagcttctggcctcaaaggatcctcccgccttggcctcccaaagtagtggaattacaggcatgagccactgacccctgctgagccaggctgttttcaacattcaatggtcattgactatctttggcgtttaggagggccctccagggaccaggcgtaggggcatcagtcaccccgccctcacaccccaacctgcagccacacttggttcaatcccactgtctagcccgtctgactcagtagcccctcccgagggagcagggctaagcaaagctggtttccccactgcaaggcactgcaggccattctattctgggccttctcatccttcataaagtgaggaggcctgaacagggctccccactaaccctgagagcgcacaattcctgaagatttccaggattttcttagtatcagttatggcttaaagttatgttggtttcacatttccagggtttgtcaaccctgtcagatttaaagataagcattattagccaggtgtggccccatgcttgtagtcccagctacatcggaggctgaggcaggaagatccctccaggccgtgagtttggggcagcaatgaactgtgattgcatcactgtgctctagaccaagtgacagagcaagactcagtctctaaacccccctcccccaccactcaaaaaaaaaaaaaagcattatttgctcttttctgcttccctctcatccttgtttccagaagggactgggtcattgctgaggggaggagaggaagctcagatggcagcaagctgaagggaagccgactctgagtcaggcccaagtctgcggcctgccatgctgcgtgctgtggggagctgagagcgcatgggcacctaagcacccagattaggctgcggctacagaagatctgactctgtctggcctggcctgcggagggactgtggcctcagaggaggatgctggcccagtgtgggagctgctgcagggtggcggggcccgtctgctcatggaagacagaatccttgccccttgaccagtcagtggggactagaattatggcagtttgtaccacaagagatgcgtggtggctattgtctgctttgtgcctttttcacgagtcactgctgggctgaggtggccaatcatcacccaccacgtgttcctgactgcgctcctccttggctcagggcaaccctgactccatctttgttgagtcaagtgtgacaagctgacagagttccaagcatgacaccgctgtaaccctcaccaccaccaggcaagaatgagcaaagatctcattctctgaggaagaactccccggaaactcaaaaggagggccgtcctatccctgcagggtatggggagaattttctggtattagcatagaaagggagctggaggtacctctggaagagcgggggtccacggcatctcagacacaggagtctctgcttgttcagggtgacagatggtgaaacagaaatgacctaatggatctctagacacccggttgcatcttttctccaggaatccagtttcccattgcagggtatttgactacacttgataagaggccagggaaggaccaggattgaggctgggtgttctgttggctgaacccttgtctggagtcaccctaaaagtgatggcaggggagttcctgcaagggactgccccaaacctttccaggatgagagccagttgggattccaaaggaagaaacacttaatgccagggtggtcagtccaaagcatttgttagggagcttacatacagagggggctgcagtgtaccctcacgagggacagccaggaaagaggttgtgcctaggcacaccgcactgagggggtggggtgtggagtttctatgagggtgcaaggaatttggctggggtgggaccagtttccacgtgcttagcaacatgtcagatctttcagtgttccaggcaacaacctaaacgtgtatcagtgtctggtaacatgcaagccccagccagggtttgagcctgcagggggaacatgtagctgattaggtcagagtagtcaaggcacttcctcagtcaggacaaaggaaacactggggggatgaaatgggggacccaacactgagtcaggcaggggacacatgccctgtttagagcccacaggccagaccctgccaggccagagcaggggagagccctggccaaggcactccacatgggggtctgtgaccccacgggcaagcctgctacccgggcacgtttgtaccttggagggtcctctcagtcttgccgatgctgtcaacaccctgagcccagggaaatccatcccattaaaataaaggtctggcccaagtgtggttgcagatttttcttggctatcttaaagagtaaagtaagcaaattacaaatcaaagaaactctgaaccagtggtcttcatccaagagagcctctggtggtcagaaggaaagtctcaagcattcagactgtggcaggaaccctgtcatggaatctggcagctaaacccgaaagcaagaggcttgaccactgcagaacactcgggtaggtaggaaacaatgaaagagcttccaaaatcaaaatcagaaacccaattccaggacttggtgactgcagtacttcctgcctgtcaccatctagggcagctcagatgtgcagtccagcatgaacacaccttgaggatgaggcagcgcatccctgctgctgccgccgctgatggcaccatcagggcagactaggtttgctgaccaggctaggtgtggaccagcacacctacctttccctaaatgggcccgtggcatgtgtcctttcaaaatgttcccttggcagtgtgctccttgcatggctttgctcctaggacacatccaaaagggtcccctgcacactgcgaagggcttctggggcgtgacctgtctttagtggttctgagtctcaggacttggggctgatgcagggcctctagctgaagggactttgatggaaatgtgcagacacaaatgttgcccaaggaccacgagtacagcaggtgctgcagttacggggcacgcccattcctaatcattgtgctttgtgtctcctcagggagaaacaaaggcagcgctgccctcgggggagcattggccctggcggaacgcagcagccgcgaaggatccagccagaggatgccacgccagcccagcgctaccaggctgcccaaggggggcgggcctgggaagagccctacacggggcagcacctaggatggggcagagacttgttgcatctttgtccccagcaaaggctacatgttacctccttcaattgataataaacctttctgagatgcagagggtccaggtc

SEQ ID NO: 37830 - DNA, 15864 bp, Homo sapiens
atccatcaggtccgagctgtgttgactaccactgcttttcccttcgtctcagttatgtcttggaagaaggctttgcggatccccggagaccttcgggtagcaactgtcaccttgatgctggcgatgctgagctccctactggctgagggcagagactctcccggtaagtgcagggcagctgctctccagagccgccactctgggaacaggctctccttgggctggggtatgggggatggtgatctctatgatcttggacacaatctttcatcaacatttcctctctcttgggaaagaaagctatgttgcattcccatttatcttttagtgatgagatgaggacaatccaatccccatcctacaggcttaagcctggaagaggaggagagaggagagaaagaggagataaagtgtacatttactaccagcgataggacaaagtgagcatggggttatttttgaagatatgaatttctccaaagacacagcaggatttgtcatttaggcgtgccccaagactgcctggacttaggattatgagatcctgcattggaaaatgtgaggcagcaatggtgtctgtagtctctgtatttgaggaaaatttgtctctattcctgaccgagtggagcatttgtggaggcaaaatcttggtgctgagggaagctgactggctgaccacagagagggagtcttcgggtttcactgatttatgggcaaatggtgacttgagtgggattcagagacccgagttaatggtggactgaatttagtaggaaggaggatgtaaagaagggaaataacacatattgtgaaaccactcacttcagacagaacaatactttatataacttctctctcactccttctaacatcctgtgtgtagatatcatgattttcttttacacaattatacttgtgatatggatattctgttacataacctgcccaaactggtgactgccacagtttaattggaatctagtttatcaaattcaaaagcttgtgctctttccatgaataaatgtctctatctaggactcagaggtgtaggtcctttccaacatagaagggagtgaacctcaacgggacttgggagggtaaatctaggcatgggaaggaaggtattttacccagggaccaagagaatacgcgtgtcagaacgaggccaggcttaattcctggacctatctcgtcattccgttgaactctcagatttatgtggataactttatctctgaggtatccaggagcttcatgaaaaatgggatttcatgcgagaacgccctgatccctctaagtgcagaggtgcatgtaaaatcagcccgactgcctcttcgctgggttcacaggctcaggcagggacagggctttcctccctttcctggatgtaggaaggcagattccagaagcccgcaaagaaggcgggcagagctgggcagagccgccgggaggatcccaggtctggagcgccaggcacgggcgggcgggaactggaggtcgcgcgggcggttccacagctccaggccgggtcagggcggcggctgcgggggcggccgggctggggcctgactgaccggccggtgattccccgcagaggatttcgtgttccagtttaagggcatgtgctacttcaccaacgggacggagcgcgtgcgtcttgtgaccagatacatctataaccgagaggagtacgcgcgcttcgacagcgacgtgggggtgtaccgcgcggtgacgccgcaggggcggcctgatgccgagtactggaacagccagaaggaagtcctggaggggacccgggcggagttggacacggtgtgcagacacaactacgaggtggcgttccgcgggatcttgcagaggagaggtgagcgtcgtcgcccctccgtgaggcccacccttggccgagaccccgagtttctgtgccgggaggggcgatgggggcgaggtctctgaaatctgagcccagttcattccaccccaggggaaaggaggcggcggcggggtggtgggggcaggtgcatcggaggggcggggacctagggcagagcagggggacaagcagagttggccaggctgcctagtgtcccccccagcctccccgtccgtcggcctcgtcctccgctctgcacgtttctcgcctcgtgccttatgtgtttgcctcctcgtaccttaccttcgctaagcagttctctctgcccccagtgcccaccctcttcccctgcccgccggcctcgctagcactgccccacccagcaaggcccacgtgcgcagcttgcgccgcaggaagcttcaggcttggcctggtggagttagggctgccccacagctgcgcgcagggcatccagcaattacagttgcgaaataagatattttgactttttggcttcaaatcattattcatcgtaattctgttttcttaaatggctaccactaatggcggagatctttgaggcgagagactgtttaattattgcatgcctggtacctgacacattgactggtatgtggtgtgagctcaatgatcttctgttaaattcatgaataaatgtactcagctgccaatccagttaggttcaagaaaaaaacagaggcttacaaatgaactttatcaattattttctaacattttgcttaatgctttcaagtaaactcttactgacttggatcttaatagaatttgtgaatacaaagtctgaggaaaatgtgtttgctaaaaataaaaacaatgcttgaatgatgttgtaaggcagagttttaatttcttagaaaagctgaacaaatagcactatgcaaagatcagaagtttgggaataaataggttgaagctattaaattattggataaaaatagtttcaggttgcttttggcctaggttatcccctcccccccatcactatccacttcaggaataaacattctgaaagtcaattttacccattcaggaagcacttatttctagacagttgccttatcaaataccatctatgttatgtcatttaatctcacagctacctgtgcattagagattagcatcaccactttatatatcctaatattggtacatgataaacactttaagtaatcagcccacaattactcaccaagatcttaagcctcccaaagtacacaacattcttatgttcctcactacacatatgtagagtctaagggatgtaaggccttgttaaagccagttttgaccagaagcagcaatgagtctattcctgtttgttctgtgtgttaatgcggcattgaaaattcatgattaatcaatccctagtctgaccccggtgttatctatgcaggttcacaaaacttttagtttgctttacactcccttgccttcttttgactcacatcctaatgccagcaagtacttatatttttgctatttcagttttatttccataaaatttattttatcatcttttctcataaatttgtgccctctatttttactcccagtctgttgaagatgaacaaatcttataaggccacatagctgactctgatttcagttggcctccaggaaggagaacctaaagaaaagttcaagtccaagcagaaaccatgattccttccggatgatggctcaagagtgccatttaattggggtgccacctgctgacctcagcaaatcccagttatatgtatatgttcacattacaggctcattagcccaggccgacctctgcacggatctcagaatattttctgtggagaacatacacgataatgtctgatttcagaacaagaaagtaattgtcaatagcaaggaaatggagtagggtagacagctagtaattaaactcacttgtgcgttaaaaagaaattaaggaaaaaaagaaaatgagagaacatattactaaataaagaaagcacacattaaatatttgctatagtttcacactaagagaataaaggaaatgtgataaagtggcctaaaaggaaaggatgagatgtgtaaaagaggcggggaaagatgtgtcattttttttactatgagcagcaatctgagaagataaaggaattgagttgtggacaaacatgatgtttgatcaagggttatttgttttgaaggcctgcctacttttttttcaaatattacaaacttttgaaataacattctacttttttttcaaatattacaaacttttgaaataacattctttttgttttttgctgtctgttactagattgcacattctataaatgcagggaccatagtatgttatttatctttgaattctcagtgattgtcaaatttatatttgttgaatgaaccttaatccaagacttcgactccaggtatctttccactctggtccaaggagggatccttcctcatggtagacgtggtgtgtgttctcacatctcactcctatgtcttttcctgtctgttactgccctcagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggactttccagatcctggtgatgctggaaatgactccccagcgtggagatgtctacacctgccacgtggagcaccccagcctccagagccccatcaccgtggagtggcgtaaggggatattgagtttctgttactatgggcccacaagacaaagagctccttctgacccattccttcccatctcttatccctgatgtcactactgagctgggaatcacaggagactagagcacctcttgctccatggcaagtgcatcagaagaatcctggtctcatcacctttccagatgctagggaaattactctacatactgttgctctgaatcccagtcctgatagctctgagggactgattcttagggctggtgactgggatcttagggtctaaggttatggatgagttcttgaagagcagagatttgcttccccactctctcacctattcactgtatccaaggacctattggctggtctttcccctccttaggggtggtctgaatggagaactaggttcctttgatgccttcaccttctgcacctcagactggacttcaactcctcagcagggatgctatggggtgtggggacaaacacagacactcagttctgctctttaggggctcagtctgaatctgcccagagcaagatgctgagtggcgttggaggcttcgtgctggggctgatcttccttgggctgggccttatcatccgtcaaaggagtcagaaaggtgaggaaccccaggggaaaaggggaagatgggctgtgacccagaccctctgttcagagtggtcctgtctgtagattagctctttcctcctgaccctgagaagaagtgcgaggagacaggacaagatgggaggaggcattggaatctgattttactggttgaaaggtagcgctgtcacagagctgactgatagagcttattccagggcatccttaccattcatcattgtctcactggctcctttccaaaagcttcctccattaagagggtcagagcctcagcttcctttctttctagtgacaatttcctttgttttaggggattttaaattagggtgctgaaggcctggaagaacatgggtgggaagagaatgtaactctaagtcatgtgtgtcattttcctttggggtgagagagtggctgtttgtgtaatgagacctttctctgcataacttccttttgtaagacctcaagggcctccaccagcaggtaatatttcagccatgatccagtgtggggaggcacaggtataagagggaagagcatgagctgagtgtacctgaccacagtggtccatgttcatggcctatttgctgctatgaggatcaagacttaggggagaagtttgccagtttctaggaatctccagacattgttccccagaaccaagccttaactttggtggcatcttcttgtgaaatgtggagccagaaccacagcttaaatgttagacactaggatgatgcccactttgtgccacatgatggtggctactgcctgtaagcattttccagtgactgaaagaggctgctagtggtcgggaagagatatcatccaatttcctaaaaagactgaacccttcatattccccagaagaataacagctgttccccacctcccacacatctgcatcaagctgaagttctgtgtcctcatgagctgatttcacctttgcacagatcttgggggaggtgatgacaatacaccctggacctcaactttctctgtctgaagctgcagggggcccctgaagggtgggggagatggcaggcccaccaggataccctgtgctgatcaatgctcttctctcttctccagggcttctgcactgactcctgagactattttaactaggattggttatcactcttctgtgatgcctgcttatgcctgcccagaattcccagctgcctgtgtcagcttgtccccctgagatcaaagtcctacagtggctgtcacgcagccaccaggtcatctcctttcatccccaccccaaggcgctggctgtgactctgcttcctgcactgacccagagcctctgcctgtgcatggccagctgcgtctactcaggtcccaaggggtttctgtttctattctttcctcagactgctcaagagaagcacatgaaaaacattacctgactttagagcttttttacataattaaacatgatcctgagttatctgtattctgaactttcttaattgagaagaggcaggaaatcactgcagaatgaaggaacatcccttgaggtgacccagcaaacctgtggccagaaggaggattgtaccttgaaaagacactgaaagcattttggggtgtgaagtaagggtgggcagaggaggtagaaaataattcaattgtcgcatcattcatggttctttaatactgatgctcagtgcattggccttagaatatcccagcctctcttctggtttggtgagtgctgtgtaaataagcatggtagaattgtttggagacatatatagtgatccttggtcactggtgtttcaaacattctggaaagtcacatcgatcaagaatattttttatttttaagaaagcataaccagcaataaaaatactatttttgagtctaaatgatagaagcccaaatatattttgttcatggtacaaaggaagcctagagtcaagttgatttcacaagttactagttccagatattcaacgagatcttcacctctctttctgttatgtctctatctgggcatctgtctcactttctctgtgtctctttgtccttgtatagttctttctgcgtgtctctctgcatctttgtctctgtgcccttgttgtctttcactacattgttgcctttctttctatttttctaatccattgtcactatttatctgcattttttctatcttcatgtttctttttgcatctatttttctgtatttgtcttccttatcacttcatatcttacctcatctctctctgtgtgtgtgtgtgtgtttgtgtgtgtgtctgtttgtctgtctctgttatatatgtttctagacttgtctaccagagttttgacaactttaggaaacattctgattggccaagcctgggtaacatgcacacctctcaaacacattgtcctgtgcacgggatgctgacagccagcattgtgtccatcgctcttattaggaaggaggactggattttccagatccttgtggtcctggaaatgacttccagtgtgcagatgtctacaccagtcatgtggagcacttcagcctccagagcctgtcctcacagtggaggggtgtaaggggcagtttgtttcttgtggagcccacaggacaaatggcagagctccctctggttctagggtccctcactgggggtacctgttcacagtcattccactccttgtctgagctccctttgtcattgacgttgtaacctgttgattcctgatgacactcttttcccggttatgagggaggtcactacacactgtggcccctttgatgtgggcccagccctgaagctggtctacatctcagtctctgagtttcatcatgaagacagagtctgggagcttctgcgaggttatggaaggccatgaccctgaaagcagacatcccatcttcctttctccctcacccacacactgggcgtgaggagtctttggcaggctcttccttcttatggatgaggtcagagtggagaactaggtctccttgggacgttcatctcctgtactccaggctgtcatgcaggtcctcagacagggacactggcgcacaaagaggcaccaacacttgagattctgctccccagggttatggtctgaattttccccaagcagaatgctgaatggagtcaaaagttttgtgctgattttgtcctcttcctcagggtgggcattgtcattgaccatagggatcaaaagggagtgccacttttggggaaatggggaaagcatgtgctgggttgtccagggtgtcctcagtctctatgtgtagctgtggggaaaagaaagagagatcagactgttactgtgtctatgtagaaagaagtagacataagagactccattttgttctgtagtaagaaaaattcttctgccttgagatgctgttaatctgtatccctatccccaaccctgtgcttgcagaaacatatgctgtgtcaactcaaggtttaacaaagcaggatgtgctttgttaaacaaatgcttgaaggcagcatgcttgttaaaagtcatcaccactccctaatctcaagtacccagggacacaaaacactgcggaagtccacagggacctctgcctaggaaagccggatattgtccaaggtttctccccatgtgatagtctgaaatatggcctcgtgggaagggaaagacctgactgtcccccagcctgacacccgtaaagggtctgtgctgaggaggattagtaaaagaggaaggcctttttgcagttgagataagaggaaggcatctgtctcctgctcgtccctgggcaatggaatgtctcggtttaaaacccgattgtatattctatctactgagataggagaaaactgccttagggctggaaatgagacatgctggtggcaatactgctctttaatgcattgagatgtttatgtatgtgcacaaaaaagcacagcgcctttttctttacctcatttatgatgcagagacatttgttcacatgttttcctgctgactctctccccactattaccctattgtcctgccacatctccctctccgagagggtagagataatgatcaataaatactgagggaactcagagactggggccggcgtgagtcctcagtatgctgagcgccggtcccctgggcccacttttctttctctatactttgtctctgtgtctctttcttttctcagtttctcatcccacccgacaagaaacacccacaggtgtggaggggcaggccaccccttcatgtggcttcttgcttttgaccctgcaaagggaagaggcagggctggggattgaaccagactcaaagtttagggagacatcgagatctgatttttctagttgaagcataagccctataattcttacagttcaacatcgtcacactgagcacatgctggagattctttattaatgagagggtcaaaatcttcttctctttcttccattgacagtttcatagaaacaactatttttttgcacccaaatttcactggataatatgatctttaatggataatttcattagaattacaagtacatcctgtataaattgttgcgggaagtcagggaccccaaacggagggaccggctgaagccatggcagaagaacgtggattgtgaagatttcatggacatttattagttctccaaattaatacttttataatttcttatgccagtctttactgcaatctctaaacataagttgtgaagatttcatggacacttatcactttcccaatcaatacccttgtgatttcctatgcctgtctttactttaatctcttaatcctgtcagctgaggaggatgtatgtcgcctcaggaccatgtgataattgcaataactgcacaaattgtagagcatgtgtgtttaaacaatatgaaatctgggcaccttgaaaaaagaacaagataacagcaacgttcagggaataagagagataaccttaaactctgactgccagtgagccaggtggaacagagtcatatttctcttctttcaaaagcaaatgggagaaatatcattgaattctttttctcagcatggaacatccctgagaaagagaatgcgcagctaggggtaggcctctgaactggacccccgaggtgtagccgtctcttatggtcgaggctgcagagatgaaataaactccagtctcccgtagtgctcccaggcttattaggaagaggaaattcccgcctaataaattttgatcagaccggttgatctcaaaaccctgtctcctgataagatgttatcaatgacaatggtgcctgaaacttcattagcaattttaatttcgcctcagtcccgtggtcctgtgatctcgccctgcctccacttgccttgtgatattctattaccctgttaagtacttgatgtctgtcacctacacctattcgcacactccctccccttttgaaaatccctaataaaaacttgctggtttttgtggcttgtggggcatcacggatcctaccaatgtgtgatgtctcccccagatgcccagctttaaaatttctctcttttgtactctgtctctttatttctcaagccgaccgactcttaggaaaaataaaaaagaacctacttgattatcagggcaggttccccgataataaataagtttgctaacacaaagaactgagtcttaatcatcatataagttggaggaaagtgtgtaggtgttctagagaaaaacctaccagtcctgagcatttgtccttaccttagataataacagtatatcttttggagacagtggtgcttgccagtattccaaagctcctgtatatttccgtcttttctgctgttaagttggggtcatttgactgacagtagccaatggaacttgcaagtaggtgcatggtggtgtatgagatgctggaaactccataacctgagtcacttgaataactgtgaaattaagtctccttattgagttaagccactgagatctactttttactgtgggttaagatcttgttgcaacataaccttgcccttcctgattatcatgaaatgtttaacttaaggaacagagttcttaagttaatagggtgaatcaattgagttaatggaagttaagaggtgattttaaaaaacagaaaactttatttgaacaagaaaaagttaaaaatgttacacttcgaaaaaattttaaactcgttaatcatttttaattgacaaataactgcatttacagggtactacatgactttttgatacatgtgattaaaccaggctaattaacatatccatcacttcactttttttgtggtatgaatatttaaaatctctcttagcaatttccttttttttttttttttttgggacagagtcttgctctgtcacttagactggagtgcattggtgctgtctccactcactgcaacctccgcctctgggattcaagcaattctcctgcctcagcctcccaaatagctgggactacaggcatgcactaccatgcccagataatttttgtatttttagtagagacaggggtttcccgagacagggtttcaccatgttggccaggctgatcttgaactcctgacctcaggtgatccacccaccttggcctcccaaagtgctggaattacaggcgtgaaccaccatgcccagtgcaattttcaaataggcaatacagttggctctctgtatctgtgggttccacatcctctgattcattcaactgtggattgaaaatacatagaaaaaaatgaaaaataacaatataacaataaaaaaattccaattccaaaacaatacagtataataactatttacatagcatttacattgcattgggtattataagtaatctagagatggcttaaagtatatgggaggataagcttaggttatatgcaaaaactaagccatttttaataagggacttgagcattctcagattttggtatacagagaggatcctggaaccaatctctcatggatgctgagaaatgacagtgcattattattaaccgtagtcaccatgctgtacagtcgatctccagtacttattcctcctgtctaactgaaactttgtacttttttttttttgagacagggcctagttctggctggaatgcagtggtatgatcacagctcactgcagccttgacttcctgggctcagtccatcctcccacctcaatctctggagtagctgggactactggcatgccccaccatgcctggctaatttctgtatttttgtaaagacagagtttcagcatgctgtccagttggtcttgaacgaggctcaaccaatccacctgcctcagcctcccaaagtggtgggattacaggcatgagccaccacaacctgcccttctttgtaccttttgaccaacattttctcattcctccttgtcgccctccctactacccccatttccccacctgctgtgattttgacttttttagattccacatgtaagtgaggtcatgtggtatttgtctttctgtgcctggcttatttcccttaacataatgtcccccaggttctttaacataatgatgtaaaagatttccttcttttataagactgaatagtattccattgtgtatatagaccagtttctttatccactcatctgctgatggacacttaggttgattccatctcttgcccattgtgagtagtgctgcgatgaacatgggagtgcagatatctctttgatatactgattgcattttctttgcagatgtacccaggagtggaattgccagatcatgtggtagttctatttttaatttttaaagagatgatgaatttaaaaaaaacatttatctgggccggccacagtggttcacgcctgtaatcccagcacgtgggaggccgaggtgggtggatcatgaggtcaagagtttgagaccagcctggccaacatagtgaagccccatctctactagaaatacaaaaattagctgggtgtggtggcacacacctgtagtcccagctactcaggtggctgaggtgggagaatcacctgggaggcagaggttgcagtgagctgagaccacaccattgcactgcagcctgggtgacagagtgagactctgtctcaaacaacaacaacaacaacaacaaacatacatttatttgtttgttttcttccacatgaatatatatgtattctcaggaactagaacactgtttctgttgtggatgctgttctgttctacctgcctccctttgggactgaaggatttattctctcattgctgggaatgttgctggctgactgcccttagctgtcagccatcccctggaattgccttaggtgatgaaacctgcctcatcggattttactccacttcccaggaagaatccacctataatgactggtcagtgtgggggtataaatgtcctaaaccctttccctaatttgggccaactctgaaaggctcttacagcttcagaactccctgggggttaggctgaagactttttgtgactgaataataatacagtttctaaaaccctgctttaattcatgagccatctttcataattcttttggttacaaatgtaatttaaatgtagtgatctttgtgacttcttccttaactatgggcaatgtctctttcctccgtcttagaagatgaaagttattgacattgttacccttcctttcccctccactttatgcttccacttgacaaaatgaggtacatgcacccttttttcaatatcgtcaaagctgaccattttgacattctgctgtaacactaagcatccttgggctttgctcgtagcttaattctaaaagttgaaaaaattgttcatcattttctaaatatcactcatgtatcagacattctttgcttgccaaggaactgctatagtaggatcccttttcagtgaggtcctgcattaaattcagtttcctggattctttaccttcccatttcctgattaacagtttcactttactaagtaatatccttagtcaatttctaataaaactgtgtggtaggtaaaatttatgtcctttcatatccaacagtatttttattctttctctgtgcctgattgtgattttgaaaaggtctacattttttttttttttttgagatggagtctccctctgtccccaggctggagtgcagtggcatgatctcggctcactgcaaactccgcctcccgggttcagcctttctcctgcctcagtctcccgagtagctgggactacaggcacccgccaccgtgcccagctaattttttttgtatttttagtagagacggggtttcaccatggtctcgatctcctgagctcatgatccgcaagcctcggcctcccaaagtgctgggattacaggcgtgagccaccgtgccaggccgaaaaggtctacatttattaataaaaataattttccattagaacttcaaggcctttcttattatcttaatagaagcatctaggagtccgactttctgtctgttgtcagtttcattttggtttcccttactggaatattttatgatgtttctttaacccttgaggctctgaaattttgaaaatgatatatttcaagatgagtattaattttgatgaatacctggcaatatctttctatttaaagaattgggtccttcatatttggaaatttttcccttattatttgttttgataattttctcccttcatcttctctgttggtctctctagctctgtaacctgaggttggacttccttggtctattctctgttttagcttttctaccacatattacatttcattgtctttttttttttttttttgctttgagacggaatcgcgctctgacacccaggctggagtgcagtggctcgatctcggctcactgcaagctccacctcccgcgttcacgccattctcctgcctcagcctcccgagcagctgggactacaggcgcccgccaccatgcccggctaattttttgtacttttagtagagacagggtttcaccgtgttagccaggatggtcttgatctcctgacctaatgatctgcccgccttggcctcccaaagtgctgggattacaggcttgggccaccacgcctggccatgtctttttaaatgtcagtgagattttcttgattacatttttcaacctttctattaaattttccaattttttgtaccattctattattacttttacagattaagaattcttttttggccgggtgtggtggctcaggcctgtaatcccaacactttgggaggccgagcagggagaccacgaggtcaggaggcagagaccatcctggctaacatggtgaaaccccgtctctactaaaaatacaaaaaattagccagacgtgatggcgggcgcctataggcccagctacttgggaggctgaggcaggagaatggcatgaacccagggagcttgcagtgagccaagatcgcaccactgcactacagcctgggcaacaaagcgagactctgtctcaaaaaaaaaaaaaagaattctttattattattattattattattattattattattattattattatactttaagctctagggtacatgtgcacaacgtgcaggtttgttacat

SEQ ID NO: 37831 - DNA, 35417 bp, Homo sapiens
gcctttctggggcctgggggatcctcttgcactggtgggtggagagaagcgcctgcagccaaccagggtcaggctgtgctcacagtttcctctggcggcatgtaaaggctccacaaaggagttgggagttcaaatgaggctgctgcggacggcctgaggatggaccccaagccctggacctgccgagcgtggcactgaggcagcggctgacgctactgtgagggaaagaaggttgtgagcagccccgcaggacccctggccagccctggccccagcctctgccggagccctctgtggaggcagagccagtggagcccagtgaggcagggctgcttggcagccaccggcctgcaactcaggaacccctccagaggccatggacaggctgccccgctgacggccagggtgaagcatgtgaggagccgccccggagccaagcaggagggaagaggtaaggggccagctctgcggccatgagaggcaggggcgagaggcagccgctggccccgtggctagggcttccagaaccctgaccctccagctgggggtgtgtgctgctggatctcagagggtcactccctgctatcgcttggagccaaacgaggcatgtccggggcagaacctgtggacatttggtggtgtttgggggcacatgatcatgggctggcatctcgaggacttcatgagtaagcctcactctcctcttttggacaaagagcctttggggtgccggccggcagctcccggcacggcagagcagctgggagtgtgcgtgtgtgtaggtgtgtgcttagagggcagcgtactgaagagctgcagaaggcaggggtggcccaaggacttgggtagtcactttgaagctttggattcctatgcccccaggccgggacaatgtgaggcaaaggcaagcgctgtgctgaggcgctgggagcccctgctcggagagttacaggagctgggctgcctctgctcacaccctccagctggcgaggagagcagaggcacccagcacgggaacggacgcatcacccaggggctgctgcactggatggtaccccgggtctccaactgagtggatgtggccaagatacagggaggatgcggcttccctggtacccccgcaaggggacagcaggggctccacataccaagtcgcctgaaagcactcagtattagataacatttccaaacaaattcttcactgatccttcccttctccttctatgatatgtgtgtcatgggtcagctcttgcctctgctgtaggattatgagagctcccagaggccagttcagttacttggaaaagcatctcctttcaccccactctctggggaaaattgagaatgccacttccaaagccggccaaatgctccccacatgtatttttccaaatggaggcagagtagggcagtcctcatgagctggcttcaaatcccagctcttctacctactagccaatggctctggcagaacacttagcctttctaaacctcagttttcttatctgtgaaatgggataatactgcccaggtggtaacaatggccagagagtaacagctaacacttatattgcacttactctatgccagactcaacttgtagaatcctcatgaccaccctatagcacaggcattattattcatccctgttttataggtgaggaaactgaggtaaagtaatgtgcccatggctacatggctagtaagtgccaggaccaggacttgaacccagtggtgtggctccggagccactcaaccacaccctactgctttctaggagaaagctaggcgcccatgcctaggaaggccttggcttagtgcctggtgcacagcaaaccctgagcaaaccttggtcactgatgattacaaaccacaacaatcaggactggcacagagggaagggaagagcagagacacgaattctttttttttttttttgagatggagtctcgctctgtcacccaggctggagtgcagtggcatgatctcggctcactgcaaactccgcctgctgggttcacgccattctcctgcctcagcctcccgagtagctggggctacaggtgcccaccaccacgcccagctaattttgtgtgtgtgtattttcagtagagacgggtttcaccacgttagccaggatggtctcgatctcctgacctcgtgatccgcccacctcggcctcccgaagtgctgggattgcaggcgtgagccactgcacccggccagagacccaaattctttccctgttctggacatatcctgctagggttttcagaaaatcccacgagacagagataatactgtggctactatcactgcccacactggagggctttccaggagcctgaggagaggggggctttatgtctggggtttgggtttggggccacctgcagcatgcctgcatcctagaagtccatactaagaaaaagtgcagacatattaacaaaaggatctaataccaaccttacaggaggaagggcatcctgcttcccacatgggcactgcctgtctgcctattgatctccccagcagaaccatagtggataagaaaatgcagctaccttagtgctgtgggaagctcacaaaatcaggaggatccatagtcaggtttgccccggagttgcagaggaagaggcaaggaatggccatcaccaagtctggcactatggtggccatgtctggtggatcttacaccagacaacactgatacatcttagcccaggagaggagcttctgtgctgtggccccctgaggttccagtgggctccctgcacgcttggaagcattttgaaaaggtgacatcaagtatttgcttctctagcacaaggcctctggggctactgaagccacaggtttccctgctccagcctggaaccatggtggctcactgtcttctctgggcagcttaggatgagcagaggctctgactgacttcatgagcttggcaaaaaaaatgggactacttactactaatgaggcagtctgggtggaacagacaaaaatgtgtaacgcacatggtccagcaggggactacatgttattgctgaagctcacgggcagagcaaataagctgttcctccatctggccctccatcccccagtgatttaggaagtacccactgggctaaataaggcatatacattatgtcatttcatcctcaccacaaccctagaaggtaggttctagttttagcatcccattttacagatgggaaaactaagtctcgagaggttaacttgcccaaagtcacacagttatgtgattatgtgggactggaacccagctctgtctggctccaaagcccctgacttcctctcacttcagtgccttgtttagacacctcaacttctcttatcctgactgtcactgggtccctgcccagtgtcgtcagtagccacatctgctttggttgctgtcctatcgaatgctgcaccaacccctctgaaaaccatggacttactcaactttagcgcatcccttgctcttcatggaagcctacttctgaggcaaaataggcatgactgttactcttagagatgagcctcagcacagttatgagggtacctgttatgtggtaatatggtcagtgacaagaggaactgagcttcgaaaccaggttggctgacttgttccacgtgcctgggtgctctgcgatactgtctcaccacatcagcaccaggaaactctgtccccagctcagtgggggcagagcctcagggaaacactggtccatgtgactaagatactattgatgcgctttctacatccgtacttggaggctcctttaggactgaagaatcagagctcaggtcctcatcacccacactgggccacacacgagcaatttctgagaaaacatcagggagatggcaatgggtagctacaatagaacaaacataacagacagcagccctgccaaagcaggtacattcagcaactggcctctctgaatcacagcccatttaatctggaatggtctcaactgacagcaggcagatgggggaggggctctgcttcatagagcccacagcccagcaggactgggcagacagtaaataatcacacaaacacacaactgtgtgaaagctgtaaagaggtggcacaaggagctaagagggtcctcaaggtgggtggtgctgtccccgtcttacagaagtggaaactgggggtcagggtgcagcacctctcccacggtctctccatgcatgggccaaaaagcaaagattgaaacccagacctgtgctggttccaccccagcctgctgccatcctggacaaccacactgtggaaatctcaagaaagaatcaattcattgaatagcatttcttttttgtgaatttatataaaacaccccaaatagaagagttattcagccacaggcagcttggagtttgtggtgatacactggtcacgtcagaagcctcattctgggggtagtttctatgacaaaactgtgttctttcacatggactgtgagccatatgactgagttcataacagtgttgggggttacaacgttacgatggcctgtcacatgtacacatcaatcacaagccacattttggtcccaggaatgttaaaatgttgggtgtggcaggagaatcccttgaacccgggaggcggaggttgcagtgagctgagatcgcgccactgcactccagtctggtgatagagcaagactccatctcaaaaataaaaaataaaatgttgggtgtggggagccaggcctctcacaactgaactattgtgtcagtccattctctgctgaaatcagcctgtctggggccagcagccccagagcctcagcaaccccctgctgcctagttgtccagacaggcagtaccaagaccaccaaggaaaagcccagaatggactctgttcttatcttcaagagatgcctgaggacctgcccagctccaagaatccttaaagtcctgcctgaggtggtcccactccaacctccatgagggaaaggctgtgtctgtctcagttactgccgaatctctaatacccactcagggccaggtagaaaagatatctgtggaatgaatgaatcaatgaagcaagcctcaggcccaggctctcaagcaaacaagcttctctaccccagggtgccacaccattcctctctctgttgtccagccaagggcttttctgaggctaggtcaggtgccccacagccccccaagtttccctatctgggcatggatctctttgcattacaaatgcctagtctctgtctcacctactaccgtggaccccttgagggtaaggacctcacccaccttgttcctgttctacctccagccgctggcacagtggctggaagaggagaacttattgggaaatacattatacaaatgaagttcttgaattcctatttagtaacctaggtgccatcctggatactcagtagtcagaggaggaatctgccctggccctgctttttaaagaagctgtagtcaggagggagataaccagatgactgcaatctgagtcttgggtgttgagttggaagcagccacagctgcacttgtgagctgaaggagggagggaagacctcactgaatggatggcttcatggtgaggtcaacttaggaagacaggcaggcatcagccaggacagtgggggaaggtactcgaggcaggaagcacagcacatgcaaaggcagggaggcatgacaacacaaggtctgtttttaagcaggacgctgacatgatcagatgtgggtgtcagacagacagccctggagctgcatgcagtgtagactgcaggggagagagcacccaaaggcagggaggccaattaggattgtgtgggtaagaaacctggccctgggttagacaaatctgttactgggcccagctccaccacttggtagcactgtgcccctggacaagtggcttcatcccttacctttgtttgctcatctgtgaaatgaggatagtcatagcccctgcctcaaagagctaccgggatcagtgaggcagacacaaacattggttgtcccagtgtttgaggaacaagtccatccaaacagccaaggtggccctggtgccaacttctcagcctggtccagaaaagcagccccaggcaaggcctggacttcccaagaaagtcaccctggggcagtgctgtccacccagcccttgacttctccctcttgtctagggctttcccagttgtagggctccagagcacactaggcactgccggaaatgcagcagccaactcagaagctggactctgaaatggcttctgcagactcttccccgcctctgctctgttggccaaggctcctggcacagaggcctcagtgcacagactttgggggaatctcaaaatggttcccaaataacgcactgtgaaaaagtaacagcagtgtccttgtcccccggaaaaggcaaccagctcccccactccctaaccacatccccctctaccctatgatctcatggtgtgaccacaacccgcctcctccatgaactcttcctggagccagcaattcaccaatggcaggagcacaagagcccaaagcatcaggcagattcgaacccccagtgctactcctccaggcaaatctgtcttaccctgcttctctgactcatggctcccatcacccatgacaggtagtagcaatgcacaatggctagctgcatgggaaggctaaatgggtgggtgatggagggctggatggatggataaatggttcattcaatggtcttatgagagctgaactagaagggtttgggaattgactccagactccccaggtgccttctggtggggaatcattcatagcatcctcagccaggaggggagggcagctggagatctggatatgccctccctggcctccgggctgatggtgaatcatccaggacaaacaatgcacagtcctttcaccaggttctccaaggtgagggtgtcactgctcatcccagatgcccattttggggtcttaccacttgcgtgatcaagcagctctttccaacatccaacaaaacacacccttgtgctgacctgaaagctatttctacttattcagtcaacagtgagtaacatgcaagctgcatctcagccattaaacaaacaagcaccttttattcatactggttgaagagacaatcttgatgcaaggcagggtttggacctagcagttgacagctaaatcccagttgtgatatttacttccaagtgatcttgaacaagcgacctaacctttctagacttgggtttcctctactgccaaatgcagatataatacctttctcttaggtaatgggatcatatagtttgttgctcagtcaggacaatattgagagtgaaaagggggtgctattaataactacataagaccgcaaccagcatggcgaaaccctgtctctactaaaaatacaaaaattagccaggtgtggtgacaggcacctgtaatcctagctgctcaggaggttgaggcaggagaactgcttgaaagcgggaggcagaggttgcagtgagctgagatggtgccattgcactccagcctgggtgacaagagcgaaactccatctcaaaataataataataataataataattacgtaagacaacagacctcaactggggccaaccaggatgtatggtcccctactcatagagctattaagagccaatgagatagagtacagctgggcacccaaattcacaacaaacgacagccattattagcaatactactggtcacctgatcagctgggccttttccttcatctggatccctcccacatcttggattaccaactggtttggatacttccctaccagcacaccatacatttcaacagcttagtaggaacacctgctagctaatgttgatgttttcatctgtcttctgtcctgatgatagtttcacaaacttgattcatgctcaggtccaccagactcactcaagcacagctcaggcttctagcttcccagaaccccgacgtcaggggccagctggcagttccagattccctgactgccttggcagaggcccgcttctcaggcctcctgcagtgctgggatgcctcttatggcgtggacccattattggccttcatctgtgatcacagaccaatgggcagtgctgaccagaggacgggtggtgagggggtggttctgtaagtcctccaggcaggactacaacctggactgatgatgaatcaactcctgagatccggatttaatttggaggcttccctgggatctgcaggcctaatgacggcaagagcactcctgtcgtcgtcctgcctagagggtcagagaacaacctcttttgggtttccagtcactttggcactttggtttctctttattcacagtatggtatctttgggggttattttgggatctgttagtggctctactacttattaatttgtgatttgggcaaatgactcacgatcctcaaatctcaatagtttcctcaactgcaaatagggataaatgtcagctttgctgttagccttaaaagtatctttgtgggcatcagaaaattgctacaatataaatataaaaaacataaagactatgaatgtgagttgtgtcccctagagtagcacagtgctcaagtggggccaccatgcatggcggccctcaaataacaggccgccttccgagggctgttgggaagattaagtgagataatgtatataaagtgcttgagccatagtgacaatttattgttgttattcttttaattgctggaacttttctcatttctaacctttggggtgaactcaaaagaggatcccaggccggcagcttctgctgcagggcagaacacacagctccatctgatgaaaatgacagctcttcccacaaagtggccccttgcttgggctgtggcaccacagtggtgagagggatgcggacacatgatgtgtggccccaccacatcaggccaagcggggacattcagaggcagcccaccggagactgggtgggacccaagccctggagaggctgcctcccagtgtacaaaggctgtcacgtggcacagtcacaccagcctcacttgtggggagggaaaacccatgcgtgatggaaactcctcacaatacaatgtggaaaagcaattttaagaatcgtttttattttaattctgaagccaaggaaaacagttggatttgcttttctttgttggacacaggaaaaaagtgaggagcatcactttgattggagttgagttcttcttcagtcctaagatggctggaatgccggggtgggggtggggggtgttacttctcttgagatacaatgagttgaataaatatcaagagagcaaaagtaaacaaacttattactgcccattaagagccgccaaactggcaaaaaactgctggggggaggggaggaattggggttggagtcttggactccaaggaaaataaatgactctgaggctcaaagagaagcccaaggagcatggcccttggtatcaggttgacccaagtcctaggctcagtcacctttggctgttatctgccgtgtgttcctgggcaaatcactgagcctgtttgggttgcaatgtctccgttgataaaacaggggtgaataacaacccaccggattacctgggacaatgtatgtcaggcgcccagcacagtgccctgttccttcccttccttcctgtaacccaatcagttctgagtcacccccactaagcctaggccccacagaggtgtaacagtaggactcagaatcaatgtagttacaagaggtcccactgctcgcaacatgacctcaaagtcagctacccctacacctttttgagcttcagtttcctcagcctagaaatgggcataacactagtaagtcactctgagtgttggaatgattagatgagagaatgttgatgtgaagggtctggaagccctaaagccctgtgcaagcattagtcaaggagatggtgtgagtgcttggcacactgcctggcccacacccagcatcctcactgttgttggttttgtttcagctttgttgttcttgctatcgtattgctaacacattattccaatctcccgcttctgatgcacttccatgctgctcacctagtgtgcaaggtgggttggatcatcccatttcacagaaaagactcagcctttgaggtctcaagtgcaatggcaagaactctgtcggggagctgtgagagcccatgtttgggagaggatagaactcaaccataaatagtgcaaatcaaatctggaggtccaggaaggcttggaaaccaaccttgtcttgcagccaggttgcctcctgggcctctggcagtttcttggccacagtggagccctgcgcccacatgggcacagagaggtgtctgtcacccactgcctcaggtgagcagcctgaagaaggcgttggcccagcaggcctgccctagcccagggtcgggggcggctcctccccattgttctggggtgggtgtgaccactagcacaggggcagccaaagcaccgttggaaacgaggcaaacacttccaaactcagctgggtttccactgacgtcactgcagccccacctcctagcagagcccaaaccagaagctcccacacacctttctctgcctagcctcagagaggcctgagcaggccataggaatcatgcttgggctttgtcatttaagtggaaaacagctcagcaaggccccagggagcacagggtctcttttgtaactgctcactggctggtccaaggtggagcccagacccagggtcctcactggagaagcccccaaaggggttcagggaggacaaaatctttaggtcctgtgtcatacttgttattttagcacagattaatgtgaaatcagaaagtagtgatgctaatacccttttactagtaaaaaccagattaaatacatgcctgtgtcatcgttaagagttagcaggttccaatccagcagaccagggttgagccctggttctgccaccttctagctttctgattttgggcaagtcactcagcctcactgagtctcagtttcctcacctgtaaaatgtaaacagcaacagtatctaccttaaaaggagattatgagaacacgggaaactggaaaacacttgcaaaatgtttagtccagggtcaggtatatagcggaccttggtcaatggatgttattaataaatacacacataggccctcctctgcgcagctctgacctcctcaggcagtcacttgtccatgggatccctgccccaatctatccctctttccagcactcccagctgctcagcagctgttggcaggtgtgtcttgtcattccatcaacaaatatttattgagctcctatgtatttcaggccacgtggtaggcactgcacatggagcagtgaccaacacaaacacctccctaccatcatgcagcttgcattcaagggaacggggaggagacagcgtgtatcttatggtgataaggacactggagggggaatgtggtgaggtcacaatcttaaatcagcagggagggtctaactgagaaggtggtatttcagcaaagattgaaagaggtaagggaacaaacaacgaagaagggggcagggaccagcaagtataaaggccctgagtcctaactgtgcttagaacacttgacagacaaccaaaaggtcaaccaggtggttggaggagatgatcgtaggggagaggggtcagagatgagaccagggaggaagtgggggccagatcatagagtgccttggagacccactagcttttcctccaagatggtgagccactggggggttttgaatagaagagtgaccccgtttgactttttaaaaaggaccactctggctgtgaagttgaggacagaaggtaggatgggcaaggctggggcagggaggctagttaggaaattactccaatagtccaggtaaatgatgcaggtgggttgcaacagggtggtggcagggaggtggggagacacaggactctaagaatatttctggcatcgtaatttggcggtgaattagatgtggggtatgaaagaaagaaaggcgtctaggatgacttcaagactttcggcctgagcaaccagagtggacatttatgaacacaggaaaaactgggatgaacaggttgggttggagatacggggaaaaacgagttcatttctggatgagttgagatacctagcagatagtcaagtggaaatgtcaaaaaagcagctgtatgtatgagtctagagtcctggggagagttccagaaataaatgcggatgtaatcagtacttgagggtgatcaccaacgtgacctctggatgagatgactaaggtaaagaaaattctgaggactgagttttgggtcccctcaacagtagagaaaggacaggaatatgaggatgaaccagcacaggctctgaggaggaacagccggcaagacaggaggcagggtggcgctctggaaaggaaggtcaagaagggagcccaactgtatcccacagtgtgagagggaaaatattaatgaggatcaagaaccagcccttccatctggcaaacagacaggggatcctgtctagggcaacctagaatgaaggggagcgggcaaagcctgatgagggtgggctcaagagagaccaggaagagaggaactttctggaaatggtgagtgcaggcatctctttggaggctttgctaaaaaggggagcagagaaatgcaacaagagctgcagaggggatgtgaggtcaagagagggttttaagttgagagaaaaaaccgtatgattataggaaaaccatcctgatgttggggagacggtgaggactgctggagcaaggccctcgagtgggcaagagaagggatctagcacgtgtcctcccctccctcttggcccatttaactcctactcattcctcaagggtcagtgtaaagggcactttctcagggaagcattcctgaccctctaggtcaattccctgtaatactcctttacagcatgtgacagttgtgctttctggcatttgggaatggcataatgatgtgaaagccccatgagggcagggactggctccatcctgttggtagctgtatccctagccactagcatgctgtccagcaaatcacaggtgttcaatcaacatctggtgaaaggatgaatggtccaagaatagaagtgaagcaaatctggagacacattctgtgttctgctcccttctaacttaatcacgttgcagtggtcaggactgtgctgtcactggctactgcaaatatttggattcagaagagctcagttgtttgttcctgttttggctctgtagcttagctaacacagtgaccagagccacgtaactggacacatccttccactgatattgtccactaaaccctgaatgtattccataacatgtctaacgattcatttgtttatcaaatatttgcccaaagtgcaatatcctgggaatacagggttgaatcagacagacgacatgccctcatggagttagaatccaacagagaagatcaaacagaactgctattcagcacagcggtgatgggtattacaaggggaaagttcagggggtgtgaaagtatagaatagggagactcaacagtctgaggaaccaaaggtagcagaagagagagaccagaaaaccctccctctgcctcccctccccagcctgaagctgcctggatacgattctcaggctctaggccaggagttcagcaagggggctgcgggcattggagctggctctgggagtagcagggccatggcctcctgccttcagatgccctgagaccctccctcttcccttctacctctgctggggcttgcctgtctcctcttgcttccagaatggctgcctgttctctgactccaagagaatataacccagcatcctgaagcagagtttttggaaagctctgcctgcctggcgagaaggctgggatcactgatggcacagggcactgacagtggtgggaccatcactgattctcccctctgtttactttcaggctttcatagattctattcacaaagaataaccaccattttgcaaggaccatgaggccactgtgcgtgacatgctggtggctcggactgctggctgccatgggagctgttgcaggccaggaggacggttttgagggcactgaggagggctcgccaagagagttcatttacctaaacaggtacaagcgggcgggcgagtcccaggacaagtgcacctacaccttcattgtgccccagcagcgggtcacgggtgccatctgcgtcaactccaaggagcctgaggtgcttctggagaaccgagtgcataagcaggagctagagctgctcaacaatgagctgctcaagcagaagcggcagatcgagacgctgcagcagctggtggaggtggacggcggcattgtgagcgaggtgaagctgctgcgcaaggagagccgcaacatgaactcgcgggtcacgcagctctacatgcagctcctgcacgagatcatccgcaagcgggacaacgcgttggagctctcccagctggagaacaggatcctgaaccagacagccgacatgctgcagctggccagcaagtacaaggacctggagcacaagtaccagcacctggccacactggcccacaaccaatcagagatcatcgcgcagcttgaggagcactgccagagggtgccctcggccaggcccgtcccccagccaccccccgctgccccgccccgggtctaccaaccacccacctacaaccgcatcatcaaccagatctctaccaacgagatccagagtgaccagaacctgaaggtgctgccaccccctctgcccactatgcccactctcaccagcctcccatcttccaccgacaagccgtcgggtaagtgcttctgggatcgtgttacatgtgggtctcagagccaggcaccaggcttcccttggctgtgtccacaaatggggaaaagccatggccagttgaagccaggccaaagacatgcacaatcccccagcaatcccttgggctgagctgctggagccagcagggtgacgggtggcaggggaaccacattccttagatggatcctcaaagatattaccaaaaaatggagtttcagaagagggcaaacactctctggtttctgacaggaaagaacccagagcctgtagttttctaggctctgcatgagatcccgtgtgttggcagatagaagagaatgtctctcctgcagctcatgcactgtgcctggcacagggttggccttctgtaaatgttcaccaaataaacaatgggccaaaagaaaagaaagtattacccatgttaagaatatgataaacacattgtaggggctgggcatgggaaggagtccttcctaaagcccacacacttcctagagtctgctgctgtctagaattttcaatgatgcttccatatgctcttacatacacgtttcatcttaaaatacagcaattctccgaataccgttatgggggaggaatgggattgctggcaggttttaaagcttaaccaagatactggcaccggacatttccatgtatgttacataattaactcctggagctccttgcggacaggatgaataacttgctaataggcttaggatgttcaggctagatttgcattcaggtcttttcactttaaatctctggctgacttctctatgctctaggactctaggaatcatcatttctggaagaagcaggccagaggctcccctgtcagaatgtcagcacacatccagtcccctgaagctcagccccttgttcatccagaacacctgagccttcccagtgggctgccatatgagaactatattcatctctgcataaatgaaccatgtatctactccaagtcagtgctttcggtaccatttcattgtataggcagggagagatttttactgaaaatatcctgctttacacttatttcacacttttaaaaataaccaccagtactgggaatagcagcttcttgctaattccaaagaggggctgaacctgagtgcaggagggtggccagtgcagaggacaagggcagcattgttttcagatggggtgggtgaggtgagctaaatgcaaagtgagcatccactgcagcacctcaaaggaaagacctggcctgggtgcaggattgagagcaggcgctttggagtaggctggcttggatttaaatccggtttccaccactgattagctctgggacattaggcaagtcactttgtccccctgaggctcggtttcctcatctgttaattgaggatagattaaaatagtgcctgtcactttaggaaacgaaatactgcaaaaaacatgtttagcacaatgctgggtccacggtaaactacaagcctcctttgatctaggtcttttcatcttaaaacaaggagactgaaataaacagtcccttttttagctctggcgttccatctgtacacgtgtctgctttaaatcagaagctctgaaagagagggcagggtgtgttaatttgtcttgatagaataccgagagggtaaaacgtgcccttgggcaccaaacaaaggctcagttgaatgttgttataaccctgactggagacaggctggactcaatggttactcaacagatctcctctggcctaagtgtctctggtttctaactcaaaacatttcaggacattcctgggcttgaactaagctggcagatacatagtataggaataagacctgggtttgcatccatgctctaccccttggttagctgttcgctcatgagatagttatttaactcttctgagcctcaattttctcctctgtaaaatggggacaagggtcataacctcacagtgttatgctgtggatacaatacaatcaagcatgaaacattatgtcatgtagtaaagccaacatttgctgagcccctactacatgctagtcgcagcactagacttggggaagtaggtgacaattgtggtccctgacctccagaaactcagtctggggtagacggcaggtgcatgaatgcatctgggatccgtccaatgcccatgatttctagtccctaacatcagcacatcagatctgacaatggatttctctgggagggagtatccgtcgaggccaaaatttctaaaatcaggaatgcagtgaaaactgggctgtctgatcactgtggtgataccctggtgtgctaagtgccctgggggacagtaaggtggcatgactaattctgcctagagggaagggagagattagatagacgtggcacttctttgttgcatcttgaaggatttgtaagattttaccaggcagacctgggagttgggaacccaagtgactagtgggtccctgatggagatgagtctgtgcaagggcccaggggcacagttctattcctggcacctcaaatggttcaatctcctgcttctttgtgttcacaacccagtgtgggctgtgtgtatccaagtgtcctgcactcgcccgtcttttgtctcccacttaagaaagcacgccgtcatgggagggaatggcagtgatttcatcacagagataactggaatgcattagaatttatccttctttgttacgcaaggatccccaaatgttggtacttgctcattaccagtagatttcttgtgacccatctcaccactgagctcccacacaaggcgctgccagctgggattgagtgcctagctgtggaagatgaatgggtagacagagcccaggaagagagcagctgggggagggtcctgccctctcctggtgttgaggactaaactgggaggaaaaaacagatggtctctctgcacggaacagtcagggcatccaatgagcagagaacattcttatcaggtctgttcagagagcttggggcaggttcttatcctggaagacaaaacactcttctgtgctcttacccaacagatcctttgttcttagggacatcacttagccagaaatacctttgcaattaaacacctttgcatccgagccttggcagcttccaaacctttcactcagcagcctcagagccatgtgctcttttcttcgtctgcccacagcatgcccttccccaggggactaagggagccatggctgcttatctgaagctgtaccacaagcctgttcccagccttactgagacagtaacagggtggtcccaggccaggatggcctactgagagcctgagtgaggaggcacaggcagctcctggcttccctggctcctcacctgggctttgtcctgtgtctctcaggtctggccagacccaaaggcattttgattaggatgattctgtgatgaggcctgggccaaatggccctatctgtggtcctctgccccacctatcctgctgctgctattagaagaggaaggctccaggggtcattctctaagaggcaaaggatagagcaggcacctgggttctgggaggcctggtactgtttctcaggccacccaaggcagagccacacatttgccagccctcctgcacagtgcccatcccagagactgatcagggaggaaaggacagcgccaacagcagctgccacagacgggctttgtcagaaactaatctttaaagaccaaaaggagtgagcacttttagctgttttctctcctgagaaagagaatacaaccagttcactttatttctcaatgagtgaagaagaaggggccataaaaccatgaaatactggaactattaggggcctctcagatcccctagcatggccttcctgtaacagagcctgttggtggcagagcagagatcgaccctgggacttgtaccttgcaggatattgaggttcatagaggtcaagtaacttagccaagggtacacagctagtaagtggcttggccaaggctcaaaccaaagtatgttttaactactctggatattgcacacttccacgggaaggctggaggggaactggtgtaaaaatcaccccgtgaatgtctgatttggccccagctgccacagggacctgaccttctatctctacttcctgaccttctagctctacttcctggtaccacgttccaaacagttccttaaaatgagctctgggaacaaaggtggtagatttgttattagaacatggttccaatgacacaaaacactgtcgctaccaacccaccaacatcatgctccccctccctaggcctagcaggaaccagccaagctccccagtagaaagtacaacgtgcacctgactcccagcaaatggacccaactgaagtctaatttttaatttttatcaaatctggacatatcctctggggttccttctactcagcatttcaatgtatagctaagtctttcaacatatagctaagtgtgaagttctgatttctttaaatgttagccctgactgtataaatgtcagtagacatgaccttcccttgggaccacatgaggaggtccccacattgcttcactgacaagagtgctagcaggaagccaccccatctcacaacagatgggctattgggctatggccaggatggcatggacaacttgaacaagagtgttttcctagatggattttccacctgtattttattccaccctataaggtaggaaatacgtacacgattgtggttccccagcacaatggtatgttttaaaacagagaaatatatgatgttgtagctcccattctttctggaggtcaagcaagcaaccaggtgaaaaggtgtcaacccatgtgtggctgggtcagcttcagtaggctgggcatccaggcccaagcactgcagagaggtggagaagcacagggtgtgtgtggtgatggtggcgagtgagggtgactctgcccatcctgagtcagccttcaaggtcacagaggctgagggaaaagcccacacaggtctcctgcctccagagcgtgtgctgtttccactgtacaatactttcttttattctaaaaggttttgttaaacaaaataagatttcaaattcagtacaaactacataatccagtgatttctcaaagagcactctttgctagcttcttcctaaacaaaatctactctaggaagatggcccacctggatgatggttccaggagggccagctcccttattgctttgctttctcttcctcctcttctggtaccttggggaactgatcacaaagagccttttgagggtgatggaaagctacccctccattcctcaggcagttttccaaagatgacacttggctaaatgctcagggtatttacagtcataggagataaactatcaacttgttactgttaaaaaaatcttgagatctgggatcttgatgcctgaaaatcccaagattggtacttggcaaactgaaagaaatctagaaaaccctagagatcaggcatctgtggccagctaactggtcatacaaatggattgttgtggtgaacttgtatagtattaatcctgagatgctgtccccctccacccccacccccacaaaaaaaataaataaagtagtattaagttagcctcatacaaatgctggcaccatgctcctggacttctcagcctccataactgtgagccaaataaacttcctttctttataaattacccagtctatgctattctgttatagcagcagaaaatggactatgttcagtcttgtaaaagtaatgaagtatatacttccagtggtttatacccacatcagtgaaggatgcaggcagcagagacctcttgatgggaacactggagatgatctttcctactatccccgcatcaccactgcctcaacttcggctctccctggcatgaatctggtcaaagattatgctgaaaataagcctgatggtcctcatcttatatctcaagatgagcctgtggaactacagggcctggagtatttatgtgatcctttgtttaaaaaaaaataagttacttttccctgatatttttgaatacagtaagtcaaaactactatacacacagagaaaaatcttgctaagacaatttgtttacgttataaatgcaacagctcctaaatgttgaaattaagtatcttagatggtatgtctagagtagggtccaaatgaacaaaaaatccactcatctggcaccatcccagacataatgtgcagagagaccactacaaactgtccaggctttcccacaaagcaggtttcctttgccagggtttggtctggatgtggattatcatctgttgtggggtctctctttccagatggatttattattattggttctcagctggaaagcacagaatgaaggtagcaaaggggatgcagctcaggatggtgaaggatggagggtgaaggatggagggtcaaggatagaggattgaaggatggagggaggcacacagagcattgagggactcatggagtgagcctgcaagggttcctgcctgaaaggagcccacagtcttatggggacacagatccccaacaatcctaatgtggtgtgataactgcagcacagaaggtggacctgagttctaatcccagatcctccactttccagtcatgtgatcctcttgagccctggctttctcacaggtgcaggggcttatgaggatgaaatgaaacggtgtgcaaagcacatggcaggtgaaaggctctagatacatgatcatcaccattcttaccttattccagtagagataaatatacaaagcattttgggaacactgaaaaggataaagtagctttcctggggttggggaaagcttcctgaaggaggtgatgaggaaggtaagggccttgtggtgctctcagaaccaccaccagtgatagtcaagaaatcatgaagacaagtcttggtgccagacaaatgtcctgctttcagaaaaagaatgcataccagaaatcacatacaactggcttgtggtgaagccccagtaaaattatagaaaagagtacacaaagggttcgtgagcatttggaagattaaaaggtcaccaatgaaagccgacataggttcttaaagaagaaaccaatgaagctgatcccttccttggaaagggttaatacactcgccaactatgggactgctacctgtccatatctgtggattgtagtcatgggtctgataagttcttccatgatgtgcctgcaggacagcaccacagtctctgacagagccatggccactctcattagtgtgcctgtggaaccctggggcactgcccacctctacatcagagacctccctcacccaggaagccttgggtacaactggccactgcccccagggagccaaggtgagctgctcacctctgtacacagtgagaccactaaagccccttctaaactcttttttaaaatgtctttaaagcccctgtttctcctcctgcccaacagcgctggtggaaacctaagagcgacgcaatgctttggacagtggcctctggaaagtagtgctgcaatgtctgtttctcccgaggtcaaatgagcagaaacaggacctttataagccctttctgggccctaagagctcttacttgagaggcctcaggctgtatcacatgcattgaaatgacctacctcacacatttaatagaatttttactggaacaattttgaaaggatttaatacttttgcttttaaaattatttggctaagagtaactcaattaatttatggttggatctcatttctcagtaaacatcaagcatattcaggaattcttgggaagtgaaaaaaatctaacctacaagttgttttcaaaagtagtaacattttcatgaagacaaaatttaacaattaatgaacttgacaagatgtcacactttgtagtaatttaattacatacaataaattttgattttgcagttttcttttcatattttagagccagtaagtctttttaggcctcaaacattttcatcaactcctgaaacactcattggccccaggcaccatgcccatcgtttgagggctaaagcggcctgaaagcaggcacaagcatttggaccttttccctggaatgatcagaaatgacatgtgtgatatcaactctgaggttctgcaggaactgaaatgcctttgggaccatacaagctattcctgtgtttaggttattgttttgtactctggttcgctgaaaagcagtgattgacatagaatatatatacatccataaccagaatcttattttgccaagcctctggataaatgagattcgaagacccccaataactgcttctcactgtagccacccctcacaccccatcccccgaccctgtgtgtctgttctcctgccctcatggggtgcccagtgagtcctgatgctggcctgggtgggactctcacctaagcaggccacgtgccgtggcactcagatgcattaatttgggtaggaaattgcagatccaatttcaacagttagtcatttctcctgttagaaaaatgtttcagggagtggtaagaagactttttggagacagaccatcagtgagagtaactgaaaacagcatacagttctcatgaaaagcagactgcatcttagtgatatcacagaagcctctccctagtgcctgcgtatggactaaaatattcacaggagcaacttcccagaaccaagagccccccagaacatttcccacaggccacagggtcctctgagtggcctaaggtggtcaaattctgacacctggggctggactcaggggataaaaaggactgtcaggctgctggccagccatggggtccagtcccgctgtgggcaggaaggactctgctcctccccccacacctcaggcacgtcagagagaagaggcatccctcttgcccacggaggcctcactgcttagctcccagcctcaaggtcagatattcacggagccatgttttcctagtaagaggggcactgcactgagagctgatgcagtttgtgagcccatttctccactagggcctggacgggtaaatcaggctgatgctggtctgccccagacccacagagagagaactggaaataggaagttatgcttgcctggcctaggtgccggttctaactcagcttgaccagaaaggccctgtgttgggagtagcaagcactgtatcagccatcaatcaagtgggtcctggtttcctgggaggccatggtccttgtgtgcctaatccctgtcaagaaccccagagaggaggaaggaagcacccaaagctgatcacctccaacacttaccagggtatggcagtggggtccgggctgagacctgtgtacttggtactcccctacttgctgatgtccctcctctggaggcctcctgaccccagaccctgtgtgcctacccatccttgttgcttcttcagggaaccacacagactcggctcagccacggggctgcatttctcttcacgtggaacatttggccacagctcccccaagaatgtaaatgtggtctttatagagatgaggtcgcagcactcgctccactctgagcccaggtgctgccgagttagtgttggcctgatgctctgggcagagctgccctctcagaaggggcgccaagttaaacaccgctaggtactctgcactggtccaaagggagcgctttgcccactgcacgttgaaaactcagtttcattgacaaaaaagatttccattcttcatgtcaatatatctttgtggccttctccactgaaattctgacttaaaaatacatggaaaacatctactggtaaatatcttacatttagtcttgtattgaaaagcaaatatagtaacgtgtgtggaggaggaattagttgggggggtgaacaacttcaaaaatgtcagctttcatctatcaaaggaaacagaaagggataatcttcacagagcacctgccccagctggctcccatgctggccgctcttgggttcatgacatcctcagaatagctatggtctcttcccatttcacagaagaagaaattgaggctcaatgaggacactgcccaaagtcacactgtgcataggtgaggccatcgagattggagccaagggctcctgactccaagtgtggagtctccctccagccctcgcttcctcagccaggtcttcctccatcgaggccagacccttgcctggccccctacgagggcattatttatatggaacagctatagatttttcacagtattatttatatgttacagttgtggatttctcatcaaagtaggatgttttgtctctgctattttaaaggagccacataattttactgctgacaatttttcaatgttaactctttttctgactaattttcatccatcagtgatgtttctgacctttgccactggtgcctttaatgtgtgaaaaggaaatgtgtttgaatgcaggagatttcacagaggtctactaagggttctaagggaaattgtgtttgaatttgtgtttttgatggaagctaatggggcctgattgtcatgtgaaattccgtgtacagacacatatgcacattttttgtaacagcagaaaatactaaacatttctacacaatttgatacctactcgattattctagaaagccttaaaagaattaccccgtttgccttttttaaaaaaagaaaaacttcttctacatcataacagacactacaatcgttgaaaaatgggcaaagaacaccaaaaggtaaatacggaagaaaaaaatcattaaagatttttaaaagttttacacctcgacaaagaactgtaaatttttatgttttatttttttcgctggctgactggcaaagattaacattagttctaaggacacagagctaagtcagcatggatccctcattcttgagttcgttctggttgggggaaaagaagtagtgtgtgagctctgcacaccccctgggtgcatacacctgctgtgtcctttacccaccaggtaaccttgaggggctcctctaatgaccacagggtctgctttcctacctcacaggagtgtcaggagggtcacctgtggaaatacgtggctaggaccataggaaatgctcagtacacactggctattattattactacttcagtcactactcttagagcaaggagtttataacctgggactttgggaatccattaccttctgaaactgtatacagaattgtgtgagtctgtgcatttttctgaataaaggatctagaaccatccccaaattcttaaagggactagtagccccaaaacatttaaaaacacttgcctttaaaaagagcccttggtggaaatgccaaaggtaaaactgagatcattcatggcgcccacaaaggcagccccagctggagccacgaggccaactgccactctcccagcagcctccacagcctctccctacgtggcgcctccttcaaaggcagcctttacctctgacaattctgcagcagtcctggcagctgtgcagtaagaggctgggctgctcgctctcagtgggcgttattttgcaggcttctgccggatcttccgtcaccagcattcacatcgaacggcctctcctgtgctgctgacttggtaaggagctgggaggcctcccacgcccaccggcgctctgctccagctgttggggacagactcccattctctgcctccatccctggggcttcagctaaacacaaccaaaacctttttctccttcacaaatgctctttctggaggtctagcctccccttccctgggaaggatactgagggagtggtgggggaaaggcaggaagtggcactggcaaaggaagcagctgcttgtgccccatctgctaccctggggtggggagcattgggtcctgccccatcccttagagaagaggcctggcaaaaaggtaaatgggtgagaagatccttcctccccagaagatgaagggagaagcccctgagttaagtgtcagcacccaaaccaatctttcttatcggggcaatactgggcagtgggaagcaaggaatgagcaagacagcccctgccttcccgtcaggttctaggtggatgaatgctcaaacacaaggcttcttcctcaggaacagcccacctgagatgtctaacagagaccagaaacctaaatctttctggtttataactattacgtgtgaactagttgagcccaaacaccagccaggaaggaatctgagaagtgtgacctgtaccagaaaagctgagtatacctgtcactgatgggcacctcccttcaactcacacagaaagagaaaggacaggagtctacaggaattcaagtggggaggaggtagtgaggtcagctcctcccttgcagggcgtcagagcggccccaccctgccctgagcttccgctgcccagcaccgcatctgcagaggctgggactcaatacacagttgttgaataaacatacaaattgatagaaaacatacaatggtactttcttagcacttttgtccttaaccagtctcattgtggggatttttatttatttatttttttgagacggagtcttgtcttgctctgccactcaggctggagtgcagtggggccatctcagctcactgcaacctccacctcctggattcaagggattctcctgcctcaccctcccgggtagctgggatcacaggtgcgtgccaccacacacggctaattttttgtatttttagtagagacagggtttcaccatgttagccaggatggtctcgatctcctgactttgtgatctgcctgcctcagcctcccaaagtgctgggattacaggcgtgagccaccgtgcccggccctatgaggaatattttgaagagactgaagcaaaatgtgattttctttctttcagccattttcatctgaatggctaggccttgaccttctaaagcttcctcagatcaatgagaaaggccccagcctgtccagacccttggtgactcaagtttgtaccttcttgctgatgtgaccaacaatggaacataagaaactgcctggggagggcagagttgatgggcaggggtggggagggctaaaagaccagtggtataacacccattccttctgactgggctgcccaagctcagtgcagtcacaaagaatcacagaaccctctggtctcagtttcagaagagagccatggattgggctgtatcctggacatcatcctttaagtttatgagcctgcaaggaggacctcagaatgcgtgagtgccaagcatctggccctcactgagcttcctttggaaaacacacagattcagctgaaagggaacctggccccctaaaaacacacttgaagagcagtgaatgaattgcagaaatatcccaaagtctctggctacatggccaaattctgggcatggcctaggcccctgtgactgtggaagttcatttagtaaaagctgcagcagtcatcacgaagcactgtcactggaagggcagacgtggagtcagaattgaagggtgccaactgtacttggcccccagaaacagtaatccagtggaactgagtttccttgcagaagcaaagccatcagagcctgcaggcactgactgatgttgccacgtttagtaggtccacatctctttttcctaatataatgaacacgaaaaagatcactccagcaacttcccccaaatgatctcagtaatcctgacaacactatatgagggaaatctgatcttccttctacaatcagaagaaactgggggctgggagaatgaagaagtctgccaaaagtcaaactgtgaggcgggtgagaggagaaagtgagcttggagtatgggcatcctgacccctggtccgaggctcttgtctttataattacttattaaactcgcaaaacaaaaattggttacctcagaccgtgggcctgtggctcccagctggagcctcaacagaggttgtgcctgcttggggtgcagctgggggtgcggcctggtgacaggcaggtctgtgatgtatatgcatgtctgtgtccccaggcccatggagagactgcctgcaggccctggaggatggccacgacaccagctccatctacctggtgaagccggagaacaccaaccgcctcatgcaggtgtggtgcgaccagagacacgaccccgggggctggaccgtcatccagagacgcctggatggctctgttaacttcttcaggaactgggagacgtacaaggtgagactcggcaggggatgtctgtgctgcccacaaggtgactggcccaccccaagagaggcctgagcaaccaatagaagagcccactcagaggtacatgctgaccaagcccaggcctgtgcggccccaacaacacatatacctgaggcgagaaggatgcagacagggccattttgcaaacccaccaggggtagtgaggaccagcgcctcctctgcctgctgctagaaactgctgcaggacaagagtcagtagaccagaccaccacagccccacaggacagggtgagagtttagaaacgctggtatgggggcccaggggtgaggagcatttcactcccaagtggggtttccatggggaaagacccgctctcaaagcccagaaggcgcaagtcccaagaggctcccagttcctgggagaatcccccaaaaagtcctggtagggagttgtggcaatgctcaagtcctaattccaggctcatcctctgggctccctggttcccagggagttgaaatgctcatctgtgtagcagggaaagttgccaggactcagtcatacatcgttcttccccctctaaacagaggtagtactaaggaaggcaagagtggctctgtttgctgagtgcccaacccgtgccagcaccatgctaagggctttcgtgcattattttgtttaatctcgtatcaacctcctgagggaggttctgttatggacccagcttacagatgaaagtgtggagtaatttgctcagggttgcaaagccaggaattggcccagtagtgactgcagctgaggcctctgacactgaagctcacaaactacctgaagccatgatgccttgcacacatggctctgccatgccccttcttgagtctcctgtcctggttgtcccccaccccacctcctgaacagcctgtgtctctgcttttttctcctcttccacctacattaggagcgggagactcctcctttcttagaggcaatacagtgcaatgattaagactgggttcttggttcaaatcctggttcaccctcaggcattctgagaccctgagcctctctgggcctcagttcatccatactagggaggataatgatagcacttagttcttcgagttgacatgaggattagtaaaacaacctatgtaaagttcttaaaacagtgccagcacatcacaagcgctcaatactaaataattattgtattaatgaatcaccgattcccaagactttagtggccgtaactcagctgctgaccccaaaaccacatgcaaaaaaaaacaataaccacaaaaccactgggttttagacctagaggggagcgccggtggatgggacacatgcgtcacagctcacacccgtctggtgcgttacagcttacacgtgaccctcacacacagctcatctccagagaaggaggtgaagctcagtgaaggtcagagatttgtctgaggaatgcctgctgcgtgcctacttagtgccaggccctccacctgccacagcacacgtgttcctgcagcaagcctgtggggaaggtaatatagcctccctgatgtaagaacaaggaatctggggttcacatgatgcctggcacagggtaggcactctacatatttttgaataatgtgtgagtcatggagagattaagaggtggagtaggggtctgaaccaggtctgcttcatgctctgcttgtttcccaggcccctctatccagggctgagtgtctgacagccaagcctgctggctgcaggtgctgcaggctccacattaacactctcctgggttttccccagcaagggtttgggaacattgacggcgaatactggctgggcctggagaacatttactggctgacgaaccaaggcaactacaaactcctggtgaccatggaggactggtccggccgcaaagtctttgcagaatacgccagtttccgcctggaacctgagagcgagtattataagctgcggctggggcgctaccatggcaatgcgggtgactcctttacatggcacaacggcaagcagttcaccaccctggacagagatcatgatgtctacacaggtaggaaaagtggagtcaaacccaggtgcagggtagggaaaagaggtcaaccagagccagagcccctgactccagggcttggaaacgggaagatcccagggtgagaagcagctgggccaagctgcctgaccctgttaccaccccctgagggtcccttctcctgcccacaggtccccttcacaaagctgggtcacagtggcatttacaaattaagaaaaaaaaaatgggatggggcgagacataaagaggtatacaaatcacacgtaccagggccagctggggccaatgcagaaagacatgtgttgggctgtggcctcaccacttctgtcccaggcacctggtatagagctaaccaactgcgtaggctctgggccacacacctgggctccagtgctggccccacctcctaccagccatgtgtccttgggcatactgctaaatctccgtgggtctcagtttctgcatctggaagtaaggacaagaactacattgcagagtagggagaagggtagagagaatgtacctaaagtgctttgtctaggatttggcacatagcgagggctccatacaaactggctttcttcatggtcactgttactgcatgtaatgctagtgcagtgctgagaggaagctattaagaggaaagcagataggagagagaaagtgatttgtctaagatcacatgcttcaaatctaggtctttactaagaagtctttattaaacaaaaaacaagagaaaaaaacagaaaatcagaagaaacagagatatggtctggccctgagtccagatatcagcctcccacacagttaatgcctccccagggccaacacccagtttcttgagatgaaggcctctcagtctgccatgctcctccctgaggctggcaccacctgacggccgatgctgcctccaggctcaggctgtctgctctcaagggcaaacccagtcccctcctgcctccatttcctatgtggtcttggtcagaaggctactccctcccacttgagaagcgagctctcaagactgtcctacaaatggcctgtacttcaggcaggccctggaacctacatactaaggtggaggggatcctcatgccaggtccccatagcagccacattctgaagggtaattctcccaacatcaggggacaggagggacatgacctgcccatccctgtatcacacagacacctctgtccgcccactgacactgaactggcctggcccgaaggggccctggaagaggaacaggccctcattctgaagcagtaggggctgccgaggcttctagaagagcagggcagaaggataaccttcagagctggtcagaccctgggacacaggggctgctacagcctttctggagggccacctccttagggagcggaaagtgtattctatgatccaaactcagatctagccagcagcaaaatcagtagctggcaaggtccttgtccctggaggtgtgtgggacctccgctggcaaagaggaggctggttatggcgtgcccaaggatctccctgctataccagtccaacactgccacttggtccctgtggcctggaatcatggcccagagggacccccagaaaaactctgggaaaacctggctccacctcccctcttgctttctgcctcagactgagtgcgacctcctcacctcatcccacggcctcggccacctgctctgttgggccctccaacccacaattctgactggagcagcccctcccctgagtacggggtccccttgccaggcccagtcaggaaagtggggaccccccttcactaagagcaatgctggcagatagtggccccctgtcctcctgccacagagtgcactgcccctgcatgcccgcgcacaccttcccacagtttttactgttgttctgaactgcttgtccttggcagcaaaattcagcatgatgtgataatgccaagagttttatggaaatatctttcctttgtgaagtaatacaaaaaattgtttggatggaatacaagctggggaggactggaggagcatttcttcttaaacactttctttgtcattctttaaagactcctgatccaacagtttcaactcaaaaattcctaagaaaaagcttttctccctccccgcccacctcaggccatctccatttcctatcagaacacaaggtgtggagttcccttggggcctcctttgcacccagccctgggctaggtgtcaagtacgcatcctcattcaatcctcagagccgccctgtgcggcaggcgtcatttttattctcattttacagatgaggatacagtggctgggagaggtcaagtcacttgtctgagatcacacagctagttagttacaaagctgagcctcaaaggcgggcctgaagcatggcctctcaccacccatggagacgggtccacctttcaagcgttcttgctccagatgcctcccagagagggctttgccgaaagccctgagcactatggacgcaagtagaatggcctcctcccagacaccctctcactgccttctctcttgcaggaaactgtgcccactaccagaagggaggctggtggtataacgcctgtgcccactccaacctcaacggggtctggtaccgcgggggccattaccggagccgctaccaggacggagtctactgggctgagttccgaggaggctcttactcactcaagaaagtggtgatgatgatccgaccgaaccccaacaccttccactaagccagctccccctcctgacctctcgtggccattgccaggagcccaccctggtcacgctggccacagcacaaagaacaactcctcaccagttcatcctgaggctgggaggaccgggatgctggattctgttttccgaagtcactgcagcggatgatggaactgaatcgatacggtgttttctgtccctcctactttccttcacaccagacagcccctcatgtctccaggacaggacaggactacagacaactctttctttaaataaattaagtctctacaataaaaacacaactgcaaagtaccttcataatatacatgtgtatgagcctcccttgtgcacgtatgtgtataccacatatatatgcatttagatatacatcacatgtgatatatctagatccatatataggtttgccttagatacctaaatacacatatattcagttctcagatgttgaagctgtcaccagcagctttgctcttaggagaaaagcatttcattagtgttgtattacttgagtctaagggtagatcacagactgtgtggtctcaactgaaaggatcacccttggcatctgtgtgcctggattcttccagaatgtctacaatgctaatctctcacatagaggttcccagcttcttaagaaccccttttggcacctaatcaaatttcaaaatccctccccccacattttcatacttttccccattctcaggacttttcaccatccatcacccacttatcccttcatttgacaccattcattaagtgccttctgtgtgtcagtccctggccactcactgcagttcaaggccccctttccgctctgctgtactcctcgcctacctactccttgccttttctgtcgcacagccccttctttccaggcgagattcctcagcttctgagtaggaaacactccgggctccaggtttctggttgggaagggaaggccaggccaaaagctccaccggccgtatagataatgtactcgcagttttgtatcttccattcatactttaacctacaggtcatttgagtcttcacacaaataataacctatctggccaggagaattatctcagaacagaagtcatcagatcatcagagcccccagatggctacagaccagagattccacgctctcaggctgactagagtccgcatctcatctccaaactacacttccctggagaacaagtgccacaaaaatgaaaacaggccacttctcaggagttgaataatcaggggtcaccggaccccttggttgatgcactgcagcatggtggctttctgagtcctgttggccaccaagtgtcagcctcagcactcccgggactattgccaagaaggggcaagggatgagtcaagaaggtgagacccttcccggtgggcacgtgggccaggctgtgtgagatgttggatgtttggtactgtccatgtctgggtgtgtgcctattacctcagcatttctcacaaagtgtaccatgtagcatgttttgtgtatataaaagggagggtttttttaaaaatatattcccagattatccttgtaatgacacgaatctgcaataaaagccatcagtgct

SEQ ID NO: 37832 - DNA, 35417 bp, Homo sapiens; identical to SEQ ID NO: 37831

SEQ ID NO: 37833 - DNA, 241401 bp, Homo sapiens
ggtccgcggcggagcgagcgagcggccggcaggttgggaggagcggccgaaggtgagtgacgcggcggggccgtgccgcgccccgtgccgcggcgaggttgtcccggagcgcgaggcccctacccctgcctcgggctggccccgcgcggagccgacttggcgcgcgccggggttgcgcggcggccgtggcggtggcggagggcagcccccgcgggctcccgctcgtgcgggtgaacccggcggcctcggggcggtcctgggggggggtccgagaggtggcgtcggccccgcggccgtcggagtttggcgcgctctgcagcggcggcgctcggccggtctggaggagggagaggcgcgccgggcacggagcagcgagaaagttcgggccgggccggccggcgggagggtgcgggcgcctggctaccccggcccggcgctctgtccctcggatgcctctgggcccttccctagcccggggcggaacgggggaccctctctgaagcggctctccgtggagttggatgttgcccttcgcgggagggagtggcggtcaagacccctttatcctcggccccagaggggcaggtggcctcgggtcgccctccgccaactccgaggtggcttcggccggggctggagggcggggaggcgggggaggggcgtgggcgctgcggcctctggggcggcccaacccggcgcgggcagcgtgggtttccgaggtcccgcggttccaggtcgagggaaggtgtaggggccctgaagcgggctggtccccgaatgttgcgttttctgtgccgctttgggcaacacgcagtggcgctcgcggcagccacggctccttgaccgttcatctccttcacccgggtcccgtggaactttcagaggcaactgttcttggtggctcttgcgggtcagcacgagccgtgctgcacgagcgtgacctagtgaaggccttgggcgagttggcgttaacaatttatggcgtccgccagcgctcgctttccgcacgtggcctctgcggagggtcagcccatcttattaaatagtggattctattagaccctgatacccgaggctaataaggaagcttaatcatccagatgtgtaatcgtgcagttcctttcctcaccgtcattgccccccacctctggagctgaatggaaatgagggtctgtttgcttatattgaattcctgagtttattcaagttcatttttaggtggcgttaacagctaagtagctgttcatctgccagtttctcctttcatccaactttctctactaaaatgttgagcacgttttatttaaaaaaaattgaagtgtaataaacatataaatttactcttctaaggtcaaaattcagtggtttttaatatatccgtaaagttatgaaatcatcactaccatctgattccatttcgttgcccccaaaaagaacccctataccgattagcagtcattcttccatctcccagcccttctccctcattttaaggcagctacttaggaagtttttctaagatagagactgagtgagaaaactgagaggtgattaactttgatcctttttctgttactaggtttggggaaaggtgctgctgaagcaatggaagaaaaattaagtattggctgtcctatggggaggttaaaatgaataaggatggaagagaagctgccagtagaggaataattgcctcctgtagagacccacaagttgggaatacattttatccccttagggcacagggatgctttctgggctctagacttgcctagtccataaatcactctagtcgaggttctgcctcagcgaaagtgagttctgggtgtgtgtgtgtgtgtgtgtgcgtgtgcgtgcgcgctcggcagggaatgttagaaggaaaaaagactaggcttaaaagtaattttttaaaatatccaaactggccccaaagaaagaaaccaaaaaaccacaggcaaatggccactggaattgatacattcaagactagtttcatttcatgagtatcagttcacaaatagttctgagttaatgtgtgcatacattaactttttatcccaagtgggaggaggaggatggaaaaggatctagttgggggcagtgcaaggaactgggaagaggaatgggataatggccgaaaggggcagtgcttgtgggagctgaggactgttgagatggaataactatagggtgagcagattctgaaagagcagagtgggtctgtgaaaagttggacacttcactcgggctttttgttggataatgtgtgcatgttttaaaaatcatttttagtaaggagagttgaagctatccaaattatgcaacatccactacacttctcactcacccttcaataagaaaagtcaacttgttttcaagtgtttcgggaagttttaggcctgttgcatgggtgacagcttatgccatcttttttttttttttttggtaatttagaacattgacatagcgagactccgtctctacaaaaaaaataaaaaataaccggatatggtggcacatgcacctgtagtcccagctacttgggaggctgaggcaggaggattgctttagcccaggagtttgaggctgcagtgaactatgatcatgccactgcactccagcctagatgaccgagcaatatcctctctcaaaacaagatgagctgtaccataggtatacatatcccacacccccagccctgccgacggagttttgctcttgtcagccaggctacagtgcaatgtcacagtatcagctcactgcaacctccgcctcccaggtttaagcgattctcctgcctcagcctcccaagtagctgggattacaggcacctgccaccatgcccggctaatttttttttttttttttttgagatggagtctcgatctgttgccaggctggagtgcagtggcgcgatctcagctcactgcaacctccgcctcctgggttcaagcgattctcgtgcctcagcctcccgagtagctgggactacaggcaccgtgtcaccacacccagctaatttttgtatttttagtagagacagggtttcactatgttggccaggatggtctcaatctcttgacatcgtgatgtgcccacctcggcctctcaaagtgtcaggattacaggtgtgagccaccatgccagtttttgtatttttagtagagacggggtttcaccgtgttggtcaggctggtctccaactcctgaccttgtgatccgcccacctcagcctcccaaagtgctgagggattacaggcatgcgcccccacacttggctaatttttgtatttttgttagagacgggggttttaccatgttggccaggctggtcttgaactcgtgacgtcaggttatccatccgcctctgcctcccaaagtgttgggattacaggtgtgagacaccctgctcagccttttttttttttttttttttttttttttttttttgagatggagtttctttcttgttgcccaggctggagtgcattggggtgatctcagctcactgcaacctctgcctcccgggttcaagcgattctctgcctcagcctcctgagtagctgggattgcaggcatctgccaccatgcccggctaattttgtatgtttagtagaaacggggtttctccatgttggtcaggctggtctcgaactcccgacctcaggtgatccgcctgccttggcctcccaaagtgctggcattacaggcgtgagccactgtgcccagcctgtagctatacatcttaagagtacatcttcacaaattgtcacaaagtgaacataaacatataacaagtactcacggaaagaaccaaaatattgccagcattgcagaagtgcccctatactcttgtccaatcactgcccctcccgaagagtaaccgttgtgccaactgtggattagttttatctgttttcatgctctacacagactcacacggtatatagcttttagtatcctggtttctttctcaacattatatttgtgagattcagctgtgttgttgcttgtggctgtagttcagttattttcactgctgtgtaatattcaattgtatgactacaatttatcaatttttaggtttgaggggcatttacatagtttccagtttcttacatggtaagtagtgtgactatgaacattctaattctagtacacgtcttgatacacaatatccaatacaaatgtgtacatttgtacaaattctattcagaagtagaatttcccagttccaaactaggattcagtttagaggtacagtcatgcggatttctgaagtggttgtagagtttatacttctacccgtagtgtgagagagttctgttgtgtcctttttaaattggaagagcagtagatctgcagagtttggcaaatggacaaaatatgacctatttattattttttttttggaggcggagtcttgctctgtcaccaggatgagtgcagtggcgcgatcttgactcactggaacctctgcctcctgagttcaagcaattctcctgcctcagcctcccgattagctggaactacaggcacacgccaccacgcccagctaatttttgtacttttagtagacacggggtttcaccatgttggccgggatggtctccatctcctgacctcgtgatccacccacctcggcctcccaaagtgctgtgattacaggcgtgagccactggcccaatatgacctatatttaccccatcctagcagactaattatttgttgtcttcacttccagtgcttttccatgtctgttcatgtttttatgaagtcacaattctaatattcaattttgtattttgtttcttaacacagtatcttaatattgcttcagtctctgactttttaatccctgcatatgcctaaggatatgctttcatttaataatcctcttattagaaatgtgtgttaatttctggtgttttactagtacataccgttgtggaaatcatctttgtgcatatagtttttacctccctcttgggtatttcataaatttgagatttttgtttatgtggcttgggatctttgttaaactgctgcctgcagagttatccttgaacctaatatggaattgattaaagaaatcttttttatttttttgagacaggatatcattgtgtcacccaggctggagtgcagtgacaggatcagagctcgctgtaaccgtgaactgctgggcccaagcaatcctcccgcctcagcctgcctcccgagtagctgggactacaggcatgtgccactgcactcagctaatttttccttttttttttttttagttgtagagatggggtcttgctaggttgtccaggcgggtctcaaactcctggcctcaaacaatcctccctccttgccctcctaaaagtgctgggattacaggtgtgagccactgcacccagtctaagaaatctttaaattgctaatatgttacctgcaaaagggtgtctcattgggttaaattgcaattctgaaaataatggtgaggttgaccatgataacttctttaaaaatagcataaattgaacctttgtggcaatttcatttaggtatcactgattaattttctttatatggtcctgtttacaaaggtattgagccaagagcttgaaaggatataagaaggatcataccattaagtagttgattgtccagaaattatatctaataattaaaaataccagttaggcaaaattcttacacatgaccaaggagtgttcattctacaaatgcagtgcttgtttaagttctgagggagaagtctttcttgtctagatgattaggagctgcttcccccaaaagtaagacttgagctcagctttaaggagtctctagaaattggctagggagcagacatcactaaagagacactgagccttctcaaggagagagatcagcggtgcatagggagagccccggttgaccactggacagtggggttggtgatgctggcttccttactattctttttctggaagataccgaaaataaatgaactaatatataggccgaaaaaagtacttggaggattttgggagaaagctgtttggtacattcaagtcagcatcatggggtttaatggtaaacacctgccagagattagaatgcagtaggctgcttttttgcctaattatagatcttaactcctttcccctcaggtaaaattcagtgataatttctctaagatgaaggctgctagaccagccttcattcagaataagccaatatcacttaactttagtaaacagtacttaaatttgtattatgtgcaaggccctggtgggggaaatcagagactagaaagctaagagttcatagggaatgaatgtataatgatgcaaaattgtattaataggcaaaatgttagaaatactcaatatcgatacaaaaggttcactctggaaaggaaagggatggagaaattaatgctgagtagagagatctgggtgatatttagggggatttggccttgaaaaatgtgtatgggtgggaattagagtaaagggcactgcatttaggcaataggttttgaaaaagtaaaaggtggcagtgcttgacacataataccatggtcagtcataggcttggagacccaggtgaatggcaatttgagattgtacctttcttcctgtgacttgtgactgctgagccagcctggtgatctctgtggaaatattgtaggtgtaggcccaggctggctacttttaatctaggatctgttgcttgctgtgtgacctttggcacagttactaaacctctctgtgtgtcaatttcccatctataaacagggataataaaagcatctcctttattgggtacttgtgaggattgaatgagttaaaaccaactctgttggttgaggcagtcacctgtccagactcaagaacacttagaagggtggttggtatacagtaagttttatacatgtttgctgttattcccttaatttttgaatttctgaattatagaatttctaatactcacacatagtgtaaataatataaacaacaaagggtttaaaataaaaacaaaactcatcattcttgtctggtcccaactcagctacagtcttggtttaggtgtgataactgctgtttctgtttttagttcttctagtggttattttagcaaattaccccccaaaatttagtggctcaaaaatttgttttatggtgttttggattctgtgggtcagggattcaggcagggctgggctgggtgattctgctgctttcggtgttgactgaggtcattccctggtacccagctggtggatgtgctggtccactggctccaaaaaggctttgctcccatgactattgccttagtgggagtagctggaatgctgggctcagcaatgactgttgagcagagcacctacacatgttgacttcatttgtcttcatggcaactacatgtcttcatggtgacttcagcatggtggctccaggtagttgaacttgtgtggcagcaggcttccctcatgtgttactaagggctctccagagaaacataaccaatagtgtgtgtgtgtgtgtgtgtatgtatatacacacacacaagatttttaaaacaaggaattgacttattcagtttggaggcgggctagtcctaaatactgcattgtgggccaacagatggagacaaggagagtctagaagaagactgaaggaggtctgctggagaattccctccagctcagggaggccggtctttttgtttagttcatacctttagttgtttgcatgaggcccacccacattatggagggcagtctcttttacccatagttacctgatttaaatgtgaatctcatccaaaaacatcctccaagtcaacacataaaattaaccatcataccctgctacgagcaccttgggtaaaccagttggaagcttcatggccttttatgacatattatcagaagttaataacttcccttttgccaaactattggttgtagcacaaaacttgctcaggctcaagcagaggggacatcgacctgccacttgatgggagtgtcaaagaatttgcagtataaaatatactgccagtctatgcttgagttcataaatttgacagtgtctgttaacttcctgctaaggaagaagtggaatttatattccctcacacctctctttcctcttctctctgcctcctggtttttattagatatcttattatttttgccttattatttttagttgtcttcttttggttacctttctgatttaaaataaagcagtccattctttaccaggccgtagagatatggaaaactcaggtttgttgaagggtatggtgttggggagggacatggcagaaaagcagcttcaaatggttgaggcttgacaatgaggctcttgttaaaacactccagccactaaaaatgggaattgcctatgagtgtgtcctctttgtgagcctagcaggtggcataatttgacactttttattttttctctttggcttttaaactcagatacctgtttgcctttttcttccctacacttagcatttaaattatgaatgctggaagcaaatgatattttcaccaatgaagaatcttattacagacacatggttgagttgagtgtttgtatgtggatgtgctgtcagaaataagtgctctcttgcttttttcattaccaaagcaatcagttaattggaaacagagtgtcaggagccctgtaactctgttggaggtgttttgggttttttctttttttggattcatttagttaatacaattgagcaatggggcttagtttaactctcagaacacataactaatccctttttataattatcatccaagaaacatataagaacctctagtcttgttggtttgcattcattgtatattgcagatataacctcttttgatatttgtcttactaataaaatttgacttggttagtggcaagaatgtaaatttgtgtttgatatctgcataatatttttggctaaattttttcagatttctgttgttaattctgactggttcaccctttgaccttgggaaaaaatagaacaaaagcaattagaacaaaagtagatactttgggaggccgaggcaggcagatcacttgaggtcaggagttcaagaccagccatagccaacatggcaaaaccccatctctactaaaaatacaaaaattagctgggcttgctggtgcacacctgtagtcccagctacttgggaggctgtggcaggagaattgcttgaacccaggaggtggaggttgcagtgagtcaaaatcacgccgctgcattccagcctgggtgacagagcgagactccgtctcgaacaaaagttgaaatgaaacataaatactgtattcaccttttctcttttctgtcctcctcctctccttccctccttctcttactccctccctctcttcctccctctctctctccctccctccctcccttcctctctccctcccttcctctctccctcccttcctctctccctcccttcctccctccctctctccctccctcccttcctccctccctccctcccttccttccttcctccctccgtccctcccttccttccttccttcctattcatctcaatagagctgctttttcctctaaaaataatagcttcagggtagccctttttaggggatgggattatccctgttatgagatggttcagctcacttttctgccaaatactccctcatctcctttacccaaatggagccacagaccaatctgaccatcttggtgtcatatccccttctagtcacaactcttgccccgagggtatccttacttctaatatcatagatcaatttagtcagtttttgaactttatgtacctgagatcacagagcatgtactctttcgtgtctagcttctctccatgttatatttgtgagattgatccatgttgtatgtggttatgggttcatgctcattgctgtatagtgttccatcatgtgaatatactgctgttcatcctgttgtccatgaacgttaggtttctagttttggaccagtatgaacagtactgtcatgaatgattttgtatgtattttctggtgaatataggtacacatttaagttagatatatatctaggagtgcaatttttgggccatgcagttcaactggagtaggtaccgtcagagtggttttatcaagcggtattcccagcagtggtgtatgagtttcagttgcaccacagtgcttgttattgtctgttgtcttattttagctaatctggtaaacgtgtgttattgattccctagatgactaatgaagatgaacacctcaaaaagggttcatactttttattttattgcatagcaaagtagaaaaacaaagccagtttgaccgggtgcagtggctcacgcctgtaatcccagcactttgggaggcagaggcgggtggatcatgaggtcaggagatcaagaccatcctggctaacacagtgaaaccctatctctactaaaaaaatacaaaagattagccaggcgtggtggcgggagcctgtagtcccagctactcgggaggctgaggcaggagaatggcgtgaacccaggaggcggagcttgcagtgagccgagatcgtgccactgccctccagcctgggtgaaagagcaagactccttctcaaaaaaaaaaaaaagaaaaaaaagccagttaaagaattcatctagagacattgtatcagttctttaaccactctagcttttctgtttctctacacatttattgtgtttttttgttttagttttatgagagatgtatttcaaggaatttacttctaataaaaatttaaagaacagaagtttatggataactctactagttctgagaattaaggtatttaaaggatgaaactgctcatactgtattactctttcaacttttctaatttgttaactcagtctatttatttttgcctttcactttgacatttttataggagaatttgaatcatgttctatagtttccaggaattaaatttccacataaatgtaaaagaaaacttgagatcctgatgcaccattttttaaagggttttaaaaaggggaattgttaacgtagggataagctatatattgtgaggcttcgatggcagtgctgttaagttcttgtcacttcttagcaaatgaaatgcatagtttcaaggaaacctcacgtgtggtttgatgtgtttgagttcgttttgatttatttcctgttgacattttgagatttcttcctttagcttttattctgggcacctattttatcctctcagttgtttctttttaagacctgtatgcctctttaggaatccaacatgcagctgtcatctagctttgtacttctgtgcatatattccatcttcccttaaatattattggtgtattgctgatcaggggacagacacaaggtggtcttaaatatctgtaaggtacttacaggtgttgtttggcctcttggtggcaagactatgtcctgggtcagattatctaaagggtttttggagaattcaggcttttgaccttggaggcagaataagatttctctgcctccagagacaccaaacttttaactccttttggagttatacttcaggagtaggaggaaagtttgctgaattcctatcaagaaaaggtggttgagagacatgattgaagattgcttaattcatcacagtttctcagctctggcatgaaacagttgggagaagcgattcaaataactgctgatgaaagttgtatattatttttccttttttgaagtttagggaattcagggctagctcccaaatgagatcatgtgaacttagtgatgttctttctggtgggtctttattagagtcagtggggagggaaggggagcggttttggctgtagagtgggatctgaaaattgttcataatgctgggaatgacagaaatgtgggtgcgaagtgcagtgcagagacactggcttgaggaatagcaaggccttttatgatgggcccaggtgggaggggagttactaggttatacttcataggcattcaaaaatacttgttgaatgaatatggatcattttatcagtagcatactaaggctgtcagatctgcatgaagctattgattcactagttatcattatagtggcttagcagcccgctggggggtacctgtccttcaggtgattaggaatttcatgcctccatcagtgtaagtttgaacacttgggttacgaagaaatttgtcctaatgaggtttggccccagatgccctgccaggtgtgcatctgagtgtggtttctattcttcatcaccctctacacacacacacacacacacacacacacatccgtcttgtgttttttggtgggctcagagccacgagggagctattagttatccttccaaaattcagcaagctgtttgtgtttgtttttgtttttgttttgagacggagtctcgctctgtcacccaggctggagtgcagtggcgtgatctcagctactgcaacttccgacggttcaagcagttctcctgcctcagcctcccaagtagttgggagtacaggcatgcaccaccatgcctagctaatttttgtagtttgagtagagacagggtttcaccatgttggccaggatggtctcgatttcctggcctcatgatctgcctgcctcggccttccaaagtgctaggatcacaggcgtgagccactgcggcccggctgcaagctgtgttttgtcgggacggtttcgattagtttttaggctaataaagaacactgtttctttttgtttcttttttaggtttattttagccaacctgaggaaacaaaagcctactgttaggatattcatgggaaaatagggaagccttttttttcctttagtgaaatcctatgtgcctatagagctttttcacactttctagagaaggtaagcatctcttcctgagaaagagtggggataatatgtctgggctcaattctgcctgttgtagggaagggtgtgccggtgggtcaccttttgaggttaagaacgagtaataagaccttgaggattcttttttttttttttttttgagacagagtctcgctctgtcacccaggttggagtaaagtggcgtgatctcggctcactggaccctccgcctcccaggttcaagtagttctcccgcctcagcctcccaagtagctggaattacggagtcccccaccatgcctcgctaatttttgtatttttagtagagatggagtttcacattattggccgggctggtcttgaactcctgacctcaagtgatccacctgcctcagccttccagagtgctgggattacaggcatgagccaccttgcccggccaaccttgagggttcttagccatccccaaatgatctgataaagtagccttagtactgtggaaaaaagtgtcactctttcctgctctgtcaactttgatagcaaaaggaggaaacactgctaaaggggcttgaagtttatatagtttgtgaatcattttcttgggaacttttcaaaagaagtgttgtaaacctctgacctcacatccagtttgaccagataactgtgcttacctgttgaggcccatctgatttgagtcctggcttaaagcggttgttcacatgttgaagtctgtatttaagctccgctcccaggctgggttgtgtcatcccgagcctccccttctccctccttgacccccagtggcccagggcagtttttactttaccgtttcttcctggctttttacctatacttttcggccagacacttcaaggggatctgattcgatgtaggggaggggttcggagcatgggttctagaatcgaaactctactatttcctgcgaggtgtatgttttctttgcttctttgtgtttggaaagaaatattgatattgtcattccgtggtgtttaagtgtgtaaagaggaggagctgggaggaagatgaaggaagacctaggatgtagtatttcctgactataaaactccctaggaaaagtcctcaaagagccaccttgtttactttaggctagaggagcggagaaagggcggtgaccctgtatgacatacagtgaacaagagaggtggaactctggcaggaagtaaagggtagaggcaggctcagggacccaagtcttgtaggaaaccacaactccatgaagcctatatggagtttcttagcattgtctttaaatttttttttttttgttttgagacagagtttcgctcttgttgcccaggctggagtgcaatggcatgatctcggctcaccgcaaactcccccttccaggttccagtgattcttctgcctcagcctcccgagtagctgggattacaggcatgcaccaccaggcctgactaattttgtatgtttaatagaaacggggtttctccatgttggtcaggctggtctcaaactcccaacctcaggtgatctgcctgcctcggcctcccaaagtgctgggattataggcatgagacactgcgcccagtgtctttcaacttttactaggcaccttataattgtgtcttttcccccaaagcccgctctcacgacagcctctggatatcaagatctgtcagccttaacttagtaagtgttctgagtttctctgaacttccaacttctcaggatctgccacaaatttgcaaaaggtggtgttgaatatttttccttcagaaattaagtttttaattcttgtatattttcataggagtagctatgagaggagtcttaactttgggtattgtttttctttggcttctagagaaaagtttgagaggtctagtgattttcattaagttcttttttaagcaatcatttgtgaaactattcacatcctcagatcttggtaagatttccatgcagagcctaatactgaaaagctaaagaagaacctggactttttggaatgatttcgacctctcataaaatcccagacaattacatttccttattttgccaggagactggtatgccagttaagtttataacctcgatccttgttttatcctccatcagttagagattaattacatgcctttggaatggtgagctgttgagccttgtcgtctttgaacctactattgttctcaataaggtcttctaaaggtcagacaaacaagtcatttagatttttctcctccccttaaagcatgcatttataaggcaaaaacttaatgatcattcattccattccattgatcattaaaacagctttaaaaatgaagtggtttcattactcatattagtctagttatgctcagtgacttaaaacaatacattttaatttctagacttaatgagccactccactctgggacatacttatggcagagggtaagaaaagaaatgaccatagccgggtgcggtggctcacacctgtaatcccagcactttgggaggctgaggtggatagatcgcttgagcccaggaattcaagactagtctgggcaacatggcaaaaccccatctctacaaaaaatacaaaaattagccgtgtgtggtagcacgcccctgtagtcccggctacctgggaggtggaggtgggaggatcacctcagcctggggaggttaaggctgtagtgagctgtgatcataccactgcactccagcctgcttggtagagtgagaccctgtctcaaaaaaataaataaaaattaaaaaggaagtgaccagttcattcatagttattaacacttctgcttgtgtgtcacttctactcgccttcacttggctgaagaaagtcatatggccaggcctgccagcaatgtggtagagaagtgtggttaattcttccatctggagatgctataagtcacgtgacaatgggggatataatcctctttcagggaggttagcgaataattgaaaacaatataatctaacataatggaagactatatttaactcaaaaaatttaatggcctgtgttctgattcagaaatagtttttagaattggttaaatctgcactttgggttttattttgaaaagattatgcctcagaaatctgcctagatatggaaaacagggtctagtttttggacaggactgattaatcttttatgaattggagagctgtaccaacaacttggtaactttccattagttgtttcccatggctccagatctgtattttaatcaagaagttacacttcttcctctcttgacttttatatcttgattttgcatgcattgttagtatcctattggtcagatgatttttgtttaattgcctgatttaatatggttttggcagccaattaacagtggatgctactgtcaagagaagggtagagatggggccttttgacagaaataaaatttattaaggcctcatcagtctgtcttggtatttttctttcaaaaatgaaactgatgaactgttgctgatgttcttactaggaaatttctgtcttatataaaagatatgaaatcggaattctttgaagcaagatgacaaaataaagtcatacattgctgtgaggaacagaacgtttgtgcctcaattggttattcaccatctacatgttgagattctttttgtgggggatcttggccatttctgcatgttcaccctcacactcctttttatgaggtgtgggggccatctacttaggcaagagtcttaggtagcttctgtaatttttatgagaaagctgaagtctcttctgcttggttgacttttaaaaagtaggtgcaccaagcctcagctggtgtcagactgctgcacttggggttcttcctgagctcttaacctgcttccagctcttagtgaaaacttgtttttgggagatggtgttcattcatgaaatttcatcaaacactgggcacttggaattctctactttcttttccctccagattctttttttttttttttttttggagacagagttttgctcgtcacccaggctggagtgcaatggtgtgatcttgggtcactttaacctctgccttctgggttcaagcgattctcctgcctcagcctcccgagtagctggggattacaggtgtgcgccaccacgcgtggctgatttttgtattattggtagagatggggtttcaccatggtggccaggctggtctcgaactcctgacctcaggagatccacccacctcagcctgccaaagtgctgggattacaggcatgagccactgtgcctggctcagattcttttattgaatgaacgtctactatgtcttcagcttccattatttagaaatagagaagagtttaagaaacagccacaggcagctcatacatggtgatcccttttgcctctctcagtggcccttttttggagaactgttagaaaagttgctgtaggccttggtattagaaaatgttggcacatttcttgggaaaatgtttgatttgttgaataatgtaaatattgtaagagattgtgatttcctcattgctttgaccaaatttatatcccactgttaaaaagaaatggagaatttcatgatggttatttactaatttaggtctcattttacgattctgttttcccttttgctgaatttatttatttttaaattaaaggtaaatatagttacatctagttttgaaagatgccgcaagtgtttttggaccaaggttgggtacagatacatatatcgtggttccttcatgcagttgaaagttttaagaggactctgtgtgggggagtgcacatacacacagctggatagcactcctaacgctcctttctgtgctcactccgtctctttcatggttttcacaagcagagcatatgctctgtggcatactgggggtactcagtactctgtctcagtgctgagacttggagaaaggcattctttttgagcccttttgctcatgaggaagggggtcctggtgtaccccagggtttgttctccaggcctgggacccacagtggggttgaactggcagaaggcaaagaccataatggttacttctgcagggacagatctggaagggacttcatgctgacttttgggtttttaagttggtattttctgatgagtgactttggtatctcatagaattctgtaaactctaatgcactccttaagcttagcaatgtgtgcctgcctgtgctctcctgaccaccagcctctgacctaccctggttttcacttcattactcctcccttggtgctgacagctcatgggaattaagccagaattggcccaaaagctaaatgcctgcactgctgagctgtggtttcccatgaaaatgccttccctgagttaatgttagccttttgcttgtattgatggataatgcaaaacatgatcatctgtaaggtctcagttcttgatctcttttctgtagacactcattctcgtggtgacctcatcttctctcatggctttaagtgtggttgatattccaatcattatcacatttaggtctccagctctgacttttttctccagttccactctgtaaggcccaactccttccccagtatctacacccgagtgtgtggtggccacctcaaattcaacgtcacccaaacagaatttcttatttcccccaaactccttctccccacagacttctagtggtaaaacccctaaactttgtaatcatcttcactcccctatctcatacaccctacctttaattcagtagcaaatcctgtttcaccttcaaatatatgtagaatctgcatcgtcctccctctttccactgccaccatcctctctcacctcaattactgcactagcctgatacctggactctctgcttcccttgcaatccattctcaacagccatcttttaaaaacaaaagtcacattgtggcactgcgtagactctctgttggctccttgtttctatgggaggaaaagtttttacagtgaactccatggctgtccttgcccggtcccttgttattctgtagcctctcctgtgctcgcccccacctctgctcttccacaggtgtcccttttgcctcccttagggcctttgcactggctccttcctggggctggagtgctctgtcctcacctcagtgaggtccttgctcagatgtcaccatgtcagtgctgtgattattcagagttataacctgtcttctcctggcactccaggtctctcttaatccgcttggcctcttcttttttttttccatatcaaaaattaaccagtattattatggaatttacctattatatttattgtttattttcagcatatcccagtagaatacgggcttttccagggcaggaacctttagctggtttgctggttggtggtacatcaagctcctagaacggaactggaaacgcagaagacacttaaataggtatttgctgttaaatgagctgctgataaggatttactatgctgttcagaacccattatgtgaggaaatatatatttcagttcactgttaggaaaacgtttatttccttgatgaacagggactcccaacttacctgattccctcttctgctttggctaccaggatgccaggaactaagtgtcatgctcagttgtgaaagtgattggcttcaacttgctggtgaagtaatacaacccttcccttcctttcccttttccccagcctttacttgattaagtcgttctgtagttttttgttgttttttttttcttgacaataactctgccttttattgtttgacttttcaagtaactttttggagtgtatgtgtataagaattcaagtcaatcttcaaaggaagagaattcatttattacagagatttgtttatcttagcttacggctggttttattttagctttggccaggttggcaccattgtttcaagtagtatgtcacttattgtggggttttttgtttgtttgtttttgaaactgtgtcttggcctgtcacccaggctgaagtgcagtgctgcgatctcagctcactgcaacctccgcctcccaggttcaagcgattcttttgcctcagccttccaggtagctgggattacaggtgtccactacgacacccggctaatttttgtacttttaatagagacggcatttcaccatgttggccagctggtctcaaactcctgacctcaggtgatctgctggtcttggtcttccaaagtgctgggattatgggtgtgagccaccgtgcccggctcgttactggttttgatcagtgttctgaaatagtaattttgggtatgctgtctctctacaggcttctgtttgattgaatttcatttatacaggtattaacatgcttgtaaactactattgtctattgctttattgctttggttagtcaatcccaaactcttgctgccttttttttttttttttttttttgaggcagagtctcactctgtcacccaggctggagagcactggctcactgcaccaatctcagctcactgcaacctccgcctcctgggttcaagccattctcctgcctcagcctcccaagtagctgggactacaggcatgcgccaccacacctggctaatttttatatttttagtagagacggggttttgccatgttggccaggctggtctcaaactcctgccctcaggtaatccacccaccttggcctcccaaagtgctgggattacaggcgtgagctactgctcccagccaactcttgcttcttaaacccaaggaccctgatttctgacagaatatgtatacatacgtgtgtgtgtgtgtgtgtgtgtgtgtgtgtgtgtatttatttgagacagagtcttgctctgtggcccaggccaaagtgaagtgcagtggcatgatcttggctcactgcaacttccacctccctggttcaagcgattctcatgcctcagcctcctgagtagctgggattgctgggatgcgccgccatgccctgctaatttttgtatttttttagtagagatgggtttcagcatgttggccaggctggtctcgaactcgtggcctcaagtgatctgcctgcctccgcttcccaaagtgaggcatacaaaaagccgtagaatttcatatttttgagctggccagatttgtcaatggctctaataagtgttgcatttttatttaaggaggcatgtggtgatgttagccctgtgatataggagaataagcagcaaaggttgggctggtttccctgctcccctggctgccgtttctccattagaactggaattggggatttcacaaggacctcttggaaaacttcacagttagttttaaaaaaaaatgcatttgtcacccagaggatcaatatttttctaaaatttctaaaataaaggatcagtttgtttctgaaatttggttacctgaagccattgacaaattagttgtttcttattcaggttacttttaattgagttgtgcatgcaaacccacatgtatccctctctgcctctgaggagaatggggcctttcttggagaacacaaaagtaggaattctgattttattttgtgatcttagtcactttacaattataaaaattttggagctaatgagaaacctgaaaaattctgaagtcttcaaggagtgtgatcctggtgctgtctctcaggcatttctcccagagaacgggacggcagagcaatgactgttccccagcccacaggtaggagctggtgggcagcaccagcagcagtagacctagaagtcttagacttagatgtgatttgaaatatggcttttattatgggagcagcacacataagaccatcattggttctcatatgggaaaaacccttgaatattggctctaggacagattttaaggctgggtgtggtggctcgtgcctgtaatcccaacactttgggaggccgaggctggaggattgcttgaggccatgaattcaagaccagtctgggcaacctagcaagaccctttctgtacaaaaaaataaaaattacaaaaaattatttaaatgaaatttagcaatgttttatgtacgtgtcttctcatacttcaaaaagtcaagttgttctacaaaaccgtccatgaaaacagtagctttctgccctgcttttcccacctgattccctctcctcagaggaatctctcatctatcttctgatgttgaaccataagaaaatgctgatatttgactgctttagatctgtgaaaatgactgtatcttgagaaagcatgcttatcatgtcatttcttgatttttttaaattcaattttggatatttactttcctcacactgtggaagatgaagatataactcttatgacttcccccaacacgtctcttctcctgctgtaatattaatatgatttttgtttgattaatatataatgtttatagtattatttagactggaaataattcacagccaagacatgtaatttaaatatttccttcctcatacagcttttgcccacccagagttaatcattgttttgagtgcttgttttaagtacctgtcactgactcattcccaaactgaagcctaaccttcctttctgtgtgtttgcacacctcagggtagctgtccattcatcctttcttcctgaaggcgtcccttctgaagtttccaggccgttctgtaccttctctctgtttctcttccctggatactatggtatcctcctcctttgtggtttcttttggtctctggtttttgtgtgttttttgtttgtttgtttgtttgtttttgaaatggagtttcactcttgtcgccctggctggagtgcagtggcgcgatcttggctcgcggcagcctacgccacccagtttgaagtgattctccttcctcagcccctcaagtagctgggattacaggcaggcgccaacacacccagctaattatgtatttttggtagagatggggtttcactatgttggccaggctagtcttgaactcctgacctcaggtgatctgcccacctctgcctcgcagagtgctggaattacaggtgtaagccactacactcggctgctctctggtcttggtagagagcattggccaacagcttctgcacaaggttacaagggagatagtctccttgagatttggcatatctaaattgtcttttttttttttttcttttaccttcacacttactagtttggccaggtgtacagttctagtttgaaagtccttttccctcagaactttaaagagattgttcccttaagttccagctttttattaaaaaaaaaaaaatagagtttcccctcacttctctttaaaagtttttaggggcggggcgcgatggctcatgcctgtaatcacagcactcctgatcacaaggtcaggagattgagaccatcctggccaacatggtgaaaccctgtctgtactaaaaatacaaaaaattagccaggcgtggtggcgggcgcctgtatagtcccagctactcgggaggctgaggcgggagaatggcatgaacccgggaggtggagcttgcagtgagccgagatcgtgccactgcactccatcgagcctgggcaacagagcgagactccgtctcgggaaaaaaaaaaaaaaaactttttaggatttttctttttgtccaagtattctgattggtctttttgcattcatttttctgggcacacaatggccttctcaaactgggaacttaatgtttttcaattattggaacatttaaaaaattatatttagataactttccctcttttcattgaatttgcattttctaatgttggtggtccttctgggcaatcctctgattatcttacctttttctctcctattttctatgtcttggtctttttattccattttctggtggatttcctcagctttaccttacaaccattttactgaattaaaaaataacttttttttttttttttttttttttttttttgagacggagtctcactctgtcacccaggctggagtgcagtggcttgatctcggctcactgcagtctctgccttctgggttgaaggttgaagcaattctccagtctcagcctctcaagtagctgcgttacaggtgcccgccaccatgcccagctaatttttgtatttttagtagagacctggtttcaccatgttggccaggctggtctcaaactcctgacctcaggtgatccagccgcctcggcctcccaaagtgctgggattacaggcatgagccaccatgccattttcaagctaatatgtctcaatttttttttctttgaggcaggatcttatttgtaagccaggctggaatgcagtcttatgatcactgctcactgcagccttgacctcctgggcttaagcaatcatcccacctcagcctcccgagtagctgggactacaggtgcataccaccacgtccagctaatttattatttgttgtagagatagggtctcactatgtttcccaggctggtcttgaactcctggactcaagtgatcctcctgccttggcctcccagagtgctggggttacaggtgtgagccactgtgcctggcccatggctcagatttaaaagatgtaaaaggtgtatagtgaaaagccacccacttcctgtactagctaccatattctctctttacaggcaactggtattcctccttccagagataactctgttaatatatatatatatacacacacacacacacacacatatacacacacacacagacacacacacacatatatacactttttttttttttgagacggagtcttgctctgtcgccaggctggagtgcaatggcgccaccatgcccagctaatttttgtattttcagtagagatgggctttcaccatgttggccaggatggtgttgatctctcgacctcgtgatccacttgccttcgccttccaaagtgctgggattacaggtgtgagccaccgcgcccggcctcatacatatttttaaaatgtgtgtatatgatcatattctctctccctgtgaaatcacagatgataatagacttcatatattgttatgcatctttttttcatagaaccatgtgtcttcagactgctccatgtggaggtatgggtttctttttaaaatcattttaaagagcagcatagtatgattttaaactccatattttgtttaatcagtttcctattgatttgctacatccaacaatgctgcaaggggtaactttgtacgtgtattatgctcacacgtgatagtgccatgtgtgatgaatatggaattaccaggtgaatgcatatgtgcatttgtacttctcacagatgttactccagctgcctttcatggaagctgtgctaacttatgctctcacaggcaaggcatgaaagcacttgtttctttatatcgttgccagtacagtatgttatgacatttcttaatctttaccaatctgttaagtaaaaaatggtatctcatctgtttttaatttgcatttctcttaggagaatgagcatattttcataaatttataagagctgtttgtatttgtgtttctgcgaactgttcatatcctttgccattgggctgttaccaagttgtatgacattatacctaagggaaataagcccctcatgtgataagaattggagttgtttgcagtttgttcatcttttgattcgggttatattacatttttccatgttggtgaatttattagcagcttattttaaagtctttggatttaatatcatgaagagaaaaaggcgttccccatcttaaaattattatttttaaaatgtccagggtttcttttggtacttttgtagtttcaatatttttatatttaaattatttatccatattgaatttattttagtacatatggatccaagtttactttttttcccagatggctactggttttcccagtcatttattaatagtccattttccctctgactaaatcccccatgcctatgtgtctgtttcttgacttctgtttcttgacttctgttgtgttgctctgcctagctctgtgatgttgagctattcatgttttagttgtgacactattctaattgttaagaatatgtttgtattagggaggattgggcttgtattaaatattttattgttgatgttaattgtcagttttgtagtggtatttaaaaatgaattatgtggctgggagcggtggctcatgcctataatcctagcactttggaaggcccaggaaggtggagtgcttgagcccaggagttcaagaccagcctggacaatatgatgaaactctgtctctatgaaaaatacaaaattagccagacgtggtggggcatgcctgtagttccagctacttggcaggctgaggctgcagtgagtcatgattgtggcactgcactccatcgtgggtgacagagtgagacaacatctcaataaaataaaataattttaaaaaatgaattatgcaaactttaaaggaaactgatcatattttatgtaactcaaagaatgtttagggacctaggctggtaaaggtcagagttttctaactcaaggtttgcttccttttttttttaaatccctccaatgagggggaaacagatgctaaaacaatagtgagaagtacttaattggctgggtgtagtggttcatgcctataatcccaggactttgggaagcccatgcaggaggatcacttgaggccaggagtttgagaccagcctgggcaacaaagcaagaaccttccctctataaaaaatacccagatgtggtggtgcgtgcctatagtcccagctactgaggagactgaggtgcgagggttgcttaaacccaggaggtggaggctgcagtgagctgtaattgtacccctacactccatcctgggtgacagagtgagaccctgtctcaaaaaagtaaaaataaagtagtacttaatttgggatcaagatcggcttacaaatcagaacattcaggcttgaggaagagaaaaagcaattaaataggtcaacaattgcaaagcaaaactcaatttgagagttggataaagagatttgattgtggggactctgtcatttgagatgcaactcttggtccagtctcaggtgatgaaaatacagcatcagtagttaactggagtacagcagcattggtgcctttctttctgtgaaaaaagtctttatttgcctaagatgtagaaaagagactgtagtgaaccagagaccattttattctgaactgtggcagaataaaacgccttctggcgtctgtcctcactgttactctgaaatagcccatatatcgggaaaaaatgtggctgcttctgtgtgtgtgtgttgtgtgtgtgtgggccagattgttgttgtgttacattgtgataccaagagagaagagaacttttgtctagatgctcacctgagacatccacctggcctccaagcagcatgcacatgagtgaggaatttcaacaacttgtttttttcctgtaagataataagtgtaaaacattcattggacatgagcacaaacacagaggcgttatagactagactgtaaaatcgtctgtgggccactctgagcccctgtggtcagtcctttccttggatgactctaaaggggacttgggccccacttaggcataacggtgaacagagatttaaaaggagtttgagagcattcgtgtacagagatttaaaaggagtttgagagcatttgtctttttttttttttttttttttgagacagagtttcactcttgttgcccaggctggagtgcagtggcaccatctcggctcaccgcaacctctgtctcactggttcaagcgattctcctgcctcaagcactttttttttttttttttttttttttaccatttcaatcattttgagtgtatagttcattgatgttaagtatgtttacattgttgtgccaccatcatcaccatccatctccagaactctttcatcttcctaaatagaaactctgcacccattcaacccttaactccccatttccctccactccctccagcccctggtaacaaccattctacgttctaactgttttatttttaaatttagacatatagttgatactcagaagcttaacattccttatatgaaagtcttcaccaagctacttggcgtgagcatcttatttgccctttaagccttaccctgggaataaaatatagcctttatcactgtttttggaatatcttggaagtgcgtaaaactgcttcagtttattatgtagaagtgcatttccagatttctggagtgtggatcgaagattttcataccagcagtagggtctcaaccttgtttttcttatctcttggcaagaaagcaaagctggccattggggtataataaaccttgtgtacacagctgcaggagggaacagggaggtggctgtgcttggaggccgggtgttttgccgacgataatggggcatctctggcaccatgttgctggtcggaacagttttggagttggattttgtcctgcagtgatgtctttgaagaggaaagcacttttgaatatttgcattgctttgaagccagtgccatggagatattgtgacttattgccagtcagaggcaaagctgagtgtgtgaggttttgaacaaaggttgttgaaaaaaggagataatcattaattttttcagtaaaattcattgaaccccaagggcaatttggaggggtcatagctgtttttagaatctgttgctaatcactgtatatcgtagatattaagcctaggttaagagcattagtgtgggtacagagtttagatttgccagtttgtgactttaggcatgtttaacctttctaagtctgtttttccatctgaagaatggacatagagaaaatttatcactgggctttttgtgggggacagatgaggtaaggcataatgcatttaaagtggcaggcacagtctaaatactacctagtgctcctgcacaggcatagaaaatggaaaattgtttatatattttaccctcctccaaaacactcttagaccatctgatttttatttgacttatctgaatcctgaatagtttttactggatcatactctggtatctggactgtccctggtttgaaggtggtgctgctgggtgagaagccaaggatgagagaggctgtgttttggaggcccagtctgtcaaaactgaggtggcatttctagttcctgatagagtgagacagatgcaaaggtcatgggagctttgaacagtttctatgcattatgtgttgtttttcatcttctggaagtgggctggaatttgttttcagcagctaagttcattatgtagttgcctctaagccatgcctccccttttccatgtttgtgaaaagcaaaacaaaaccaccaggcacattatcttttacgaggacctggagattgactagctgacacccccagatttcacatttatgttgagataaggagaataatgtaagtcacccagactttttgtcattctgcatttttattcacagggatgaacagaagcttgcagattgggagaaaggggggggcagaaccagttgttttcaggtggacccaaataatgcatctgctttgataactgcctatctcgatttgcttggaaagggcatagagtaataaatagtttgtgggagtgtgaagaatgagcctttagactgacccaacttgtggaaattcagaaaatgcagaaatgtacgttcttccagcttgtgaatgttgaacaatggaattgttagaagaacttttgaaacttgttctttttttgaaagtattattgtgctcggttggctacatgtgctttggtctcaaaaatttgtgccttaatcacattgctggggaggctgtggatttcactatcaacagaaagtaatgtaagatgtgatatcttttcagcaggacctaaggagattttctcgaaagaaaaggggaaaatgccgctcttaagcaaaaaatctggaccatgttggcagacatacgtctttgaaacataccagcagagaattatttaatcatttgccccttagttttatcttgatcactcctagcgtgattttttccccctcttagttatgcagcagcctactggctgacatttaactattgattgttcatcctggggaatgaattactgtgatttatagtcaagggtacagatgtaaagagacagaaaggatcagatgtttctagtgccttttttcttcctctgatggcttctcccagaaacttgataaaagcaccaacactaaaacatgtttacaataagaaagctgtttattcatcttaagtagaaaattctataagtttatgtaaaattttgcccatgtgggaacaattagtcttttaatttgagttgtgtattgtaattccatggatggagatgggtggaggttgggccgaggggaagctgaggtaagaagccagaccagagaatttaaaatgatgtctttctttgaggatgccccctttgcccctcctgctgggcctcgcagccgtgggattggccacatcacttcctgtccaagttggcactgagagtggcacagtaactctgcccagtgttctcagactgcagtgggcaagtttccagcaatagagtcacccaaagaaacaacgcagcctcctttttttctttctctgttgcctagggcagttttcctcagacctcagtacctatgtcccttgcttttggaataaccccattaggtccccaaaccttgcctttgatgtatgtggcttcttgaggatcccctacatttgcatctgtttccttcccttatgcaaaggccctacgtcttccctgggagaagagtcctcgggggctttcctgtgggagaaaggaaggatctattcctgcccacacttctttctctccagatagagaaatagctcacatttttggtgcctactctgtactgggcactgtactgtgagttttcatgtgtgacctcacaggtactatgatcatctccaagtgacgttcagagaggtggtctgccccaggtcacagggctaaaattagtaacatgtaaggaaaatggctttactctcagcgtgagatgaaacagacaatacagtacacctgctgagtgacagagttgtccctgagttgttagggcctttgcccgccttggagctccacttgcttggtgcacagtaggcagcaaatgggctgtagaatcatggtatttgtgatttcctgtgtccttgacagttgagatattctctaaggctatttatgttctctctaccatgctcgtcacaagcagtcttctgggtcctcacaagcagtctttattgtttatatttctattaacaggtctgttcaaggcaacgtaaacctttcctaccatgttcctcaaaattcttccaagctccttcactacccaattccaaaaccacttccacattttttggtatttgttataacagcaccccacttccaggtactaaagtcttttagttttctattcctgctgtaataaaacccacaaatttcatgcttaaaacagcacgtgtggggcgcggtggctcacatctgtaatcccagcacttcaggaggctgaggtgggcggatcacttgaggtcaggagttaaagaccatcctggttaacatggtgaaactctgtctctactaaaaaatataaaaaaaatagccagacatggtggcgggcacctgtaatcccagctactcgggaagctgaggcaagagaatcacttgaaacccaggaggcagagtttgcagtgagctgagattatgccactgcactccaacttgggcaacagagcgagactgtctgagaaaaaaaatacacaaaagcacacatttttttatattacagttgtgtagatcagaagttggacacaggtctcactggaataaaatcaagaagtcagcaggaccagttccttctgaaggttttggggagaatctgtttccttactgctgcagcttctagaggttgcctgtattccttggcttgtgacccgtttcttcatcttcaaagccaccactggcaaatttagtcccttttacgcctgacatttcttctggctcctcttatgtgatcccatctttctgtctctgaccacagaaataaaagactttttaaaaagactcattagattgggtccatctagataatccaggaaaatctctccatcccaaagtccttaatcttaatgccgtctgcacaatgacttttgccatgaatgtaacatagtcacaggtttgggaattagaagttgggcacctttggggggcgcatttttctgcctgccacacatgataaggtgtagacacaatacagttaactctcttagttcgcagtcggcacccctttaagtaaagtgtgtggtttctaatcaagcattttattcagggtgcatctgttccacctggctggcagcacgcaccttgcaggtcaggtgtgagatgagcaagacccattggaagactggaagctacctccttctctcttttaggacaaggaagcgagagagaagcgaggagaccacttgagttgtgactctcctgcttatggtgaaattaagaactaaaactaaaacaacaggaaccctttcataacggaaatactgaagtataaaatgaaaccacctcctaaacaactctttttcctttgaaaacaaagctaagctgcgttgatgcttgcacctctgctcttgcgtgggaaaattggacccctctgtgacatttggtatgttactgagcagggttcccttggggaggacgagaagcctcctctccacttgacacttggaatttgataccagttcctgtctgacagctggttagcctgtcaggccctcacaagttaaatcttgtctcagaaaataatttgctagaagatcaaagcatggatgggataaattaatttttcaacaagccacaggtttgggataattgtctctcaagtgttgctaatgtctttgataaacaagtaatttgggggggctctttttttctcttgagattataaatcttgattgattcatatgttgaaaaagaactctgaaagcttgcacctaagatgaagccctggaataacctgaaataataataataggtatatttcaacacctgtgccattcggagcagtgattctcaacaggtgggggtgggagatcgatttttgccccccaggggcatttggcagtgtttggagacatttttggttgccatgattttggggaggggtgctactggcatctagggagtagaggccagagatgcccagaatagcccacaacaaagagttatagaatgtcagtagtgctgaggtggagaactcttgattgagaaaggagtgttttctattttacttattttcgtgtgtcttaacactattcctggatttaatttctttgaggatagggtccatccttttattttctcactcaacacaacaagttgccctgagtaggctcaaacatttatttactgttgattcccctctctcttgttaagctattcatccttttttttttctgtcttggagcagagctattgagggcagcactgaaaagcagatggtagagctgtggcagaatcaacatggttgggagagcggaaagaacacaagctctggacttctctcagccccttctttctcgtctgtaaaaaaaaaaaagttaataatagtgcccaacttaggatgattgtacttgagaaagatcgtgttgcaaaaaatggggatgtagtaagtgctcagtaatgccttctcaggcagctgagcaggagactgtgtgcaaggccctctatctcagggccctgtttttttgtaaaaagttgagtaaaggaggggcagacatcttacacatttcagaattgttatcagttctccaggaagaagagggaaagaaaaacatttatagcatttcagtaaagattactccatgattgacaaaacaattttgaggatcctaagaggcacattctgcctcaggctggagcagtttttaaaactaaattgacagcaactagttcaagttggaacagtcctaacttaattatagatacctgcagaggttccttcaaacaggtgggtttcaacagcgtggtgctatctagcaaaagctattgtttgcttagttatttgtttgagagtcagcttagaacataaggaaggagtcagagttggggtggaattctgtctctgattggatcagagcctccattttcctaattgtaatatggaaataatgattgtccctcagaggatggttataagggacaacatatttgttacacatttggcatagtaagtacttcataaatgacacctataaaagtttttgtttgaaaattttccagcttttgttttttatttatttattttttgagacagtctcactgtgttgcccaggctggagtacagtgacacaatctcagctcactgcagcctccacctcctgggttcaagcaattctcctgcctcagcctcccgagtagctgggattacaggcatgagccaccacacctggctaatatttatatttttggtagcgacgggatttcaccatgttggcccagctggtcttgaactcctggcctcaagtgatccacctgcctcggcctccctaagtgctgggattataggcatgagccatcatgcctggctgaaaactttccagtttttaaatgtcatgcatgtttttgctcaagaacgctttggctgtttggggcattttgtagttccatacaatatttttttccgctgtaaaaaattacattggaattttaataggaatagtattaaatctgtaggtcacttcggggagtatgaacagttttaacagtgttaattcttccaacccatgaatacaggatatctttccatttatttatgtcttcagtttcttttagcaatgttttatagttttcagcatacagatctttcacctccttggttaaatttattactaagtatttcattctttcttttttttgagacagggtctcactctgtcacctgagctagagtgcagtggtgcgatcacagcttactgcagcattgaactcctgggctcaagtgatcctcttgcctcagcctcccaagtaactgtgactgcaggtgtgtaccaccatgcctggctgatttttaaatttttttgtagagacatctctgcgttacccaggctggtcttgaactcctggactcaagcagtccttctgccttggcttcccaaagtgctaggattacaggtgtgaaccattgcacacggccttattctctcttgatgctattgtaaatgaaatcattttctttattttttagatagttcattattagtatatataatagaagtgctactgatttttatatgttgattttagtatcctacaacttcactgagtttattctaacaatcttttggtgaagttctgaaggttttctatatataagattatatcatctgcaaacagagacagagtaacttcttgctttccatttttgatgtattttatttttcttgcctaatagctctggctaaaacttctagtactatattgaatagaagtggttaagagtgggcatcctgttttgctcctgatcttagaggaaaggctttcagctttttaccactgagtatgatattagctacgggcatgccgtatgtggcctttattatgtcgaggtccattctttatacctaatctgttgagagtttttatcatgaaaggatgttgaattctttcaaatgatttttatacatctattgagatgatcccttgatttttatcctcgattttgttaacgtggtattagttaattttaattaatttgcatatgttgaaccatctttgcatcccagggataaatcccatttgttcatggtgtatgatccttttaatgtgcttttgaatttggtttgctggtattatattgaggatttttgcttctctagtcatcaaggacattgacccataattttattttcttgtagtgtccttgctggccttgcaaaatgagtttggaagggttgattccatcctcttcagttgttggaaagagtttaagaagggttggtgttaattcttctctttaaatatttgatgaaattcaccagtgaagccgtgacatcctgggatattctttgttgagaggtttgtgatttctgattcaatctccttacttactattggtctcttcagattttctatttctgtattattcagccttggtgtaagttgtatgtttctaggaatttatccatttgttctaggttatctaattggttggcatatatttgtctatagtagtatcttatataatcctttgtatttttgtggtatcaattgtaatgtctcatctttcatgtataattttgtcttttagttcagctaaaggtttgtcagttttatcttttcaaaaactcctggtttcattaatgttcatttttttccttctgctgactttgggctgttccttttctaattccttgaggtgtaaagttaagtgtatttgagctctttcttccttaatataggagttgattgctgtaaacttccttgtagtgctgcttttgctgcatctcttaagttttggtttgttgaaaaacgaaaaaaaaacacaaaaaaacagagagctggaggcatcatgctacttgacttcaaaatatactaaaaagctgtcatcaaaacagcatagtagtggtgtagaaacagacatatagaccaatggaacagaatagagaccccagaaataattcatatttacagtcggttggctctttgacaaagttgccaagaacacacaatggggaaaagagagtcttttcaataaatggtgttggaaaaactgggcatccacatacagaaaaattaaacccctttctcacaccatatacaaaaatcaactcaaaatggactaaagattgggggcatggctcaggggtagaggatttgactgcaaaatggactaaagacttagtaagatccaaaagtataaaactacttgaagaacacacagagaaaaagcttcttgacattagcctgggcaatgatgttttggatatgacctcaaaagtatcacagaagcaaacatagacaaatgggattgtgttaaactaaaaaaaaaattctgcatagaaaaggaaacaaacaatagaatgaagagatggcctgtagaatgggataaaatggttgcagaccatacatctgataaggggttaatatataaaatatacaaggaacccatacaactcaatagcaagaaaataaataaccggattaaaaaaatgaacaggccgggcgcggtggctcacgcctgtaatcccagcactttgggaggtcgaggcgggcggatcacgaggtcaggagatcgagaccatcctggctaacacggtgaaaccccgtctctactaaaaatacaaaaaattagccgggcgtggtagcgggcccctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaatgaacagaggaccttaatagaaatttctcaatagaagacatacagatgaccaacagatacatgaaaagtgctcaatatcactaatcagggaaatgcaaattaaaaccacagtgagtggccagatgcagtggctcatgcctgtaaatcccagcactttgggaggccgaggcaggcagatcacttgaggtcaggagttcaagactggcctagccacatggcaaaacctcgtctctactaaaaaatacaaaaccacagtgaggtatcatctcacatctactagaatggatattatcaaaggcaaaaggtaacaagtgtgttgggaaaatgtgagataaagggaccctcttagactgttgatgagaatgttagtacaaccaatatggaaaatagtatgagtatggaagttctgcagaaaataaaaactgaacttccatatgatccagcaatcctacttctgggtatacatccaaaggaattgaaatcaaagagatacctgtacttctgtgtccctcgcagcatgattcacaatagtcaagttatggagacagtggaagtgttcatcagtagatgaatgggtaaagaaaatgtggtatatgtgtacactggaatactcttcacccttacaaaagaagaaatcctgtcatttgcagcaatatagatgaacctattcataaatgaaatagccaggcacagaaagacagatactgcattttctcacttatatgtggtatccaagaaagtcaaactctcacagaagctgagagcggagtggtggttgtcaggggctgggagatgagcggtgcttgggagggcgttggttaaaggtaaaaagtttcagttaagttaaatatgttctggagatctattgtacagtgtggtgactgtagttaatgtatacttggaaattactaagagattagctctcaaatgttctcaccacaaataagtgcgaggtgggtatgttaattagctagatttaatttcacgaggtctatgtacatcaaaccatgtatattgtaaatatatacaatttttattttttaattataaccttaataaaagtgggaggaaaagtgataaacggtaataagcccttaaaggtaataagttaacttgtcacccaacgtatttattaatttttctatacaatgtaatgtgcttggagaacattgaggccgggcacggtggctcatgcttgtaatctcagcactttgggaggccaaggtgggcggatcacttgaggacaggagtttgagaccagcctggccaacatggtgaaaccccatgtctattaaaactacaaaaaaaaatagctgtgcatggtaacgggcgcttgttatcccagctactcgggaggctgaggcaggagaattgcttgaacccaggaagtggaggttgcagtgaatcaagatcacaccattgcactccagcctgggcaacaagagtgaaactctgtctcaaaaaaaaaaaaaaaaaaaattgaaaatccgcaagcttcagaagacacactactgcgtgtttgtccttctacggaagtcagtacagatctcaatgacttgttctcatttcaccagaaaatgaccattgtgcattatgctgtcagtgcagatggaaaactagcagcagtttacaaagtttccacttgaaaaaacataactctaattgatttaaaaaagtagttgattgttgcaagacttgacatttctctagttaatttctatgcctgttgttttgccccttaccgtcttcaaaatctgaatccaaatccagggcttctctattaggaggctccatatcatatctctttaatcctgataatttctcagttttttgtttcctacctacctggctattttcttacgctatctttatttgcttagtaaatataacatttcatgttctattttattttattttattttattattttattttttatttttgagacaatgttctgttgcccaggctggagtgcagtggcatgaccatggctcactgcaacctccatctcctaggctcaagtgatcttcccacctcagcctcctgagtagctgggaccacaggtgtgcaccaccatacccggctaatttttttattttttgtagagacagggttttgccatgttgcccagactggtctcgaactcctggaatcaagcaagccaccccccacttggcctcccgaagtgctaggagtacaggcaagagccactgcacctggccctgttaacttcttatgtcatttccccactttaatatatttgagggctagttctgtgtcatgtatgtattttaacatcactaccgcatctggtgcagagaggggcattctgtagtcttcgtacttcttatcttcactattgctgatgagccataacaaatttgagatgagcaattaatagatggaccggccaacaaacactatgtggaggaataagtgaggccaaagctgatggatgatgcaaagtgaggacgtaacatatttcgctggggaaccagacagatatgcagagtaagcgctctgataggggaagtacgggctgttatgggcgcttcatactgggaacattaatgggaggtggaggtcgtagttgaagctgaaacctgttgggtgaggtggagttcgccaggtgaagtggtagacttggggaagaggagaggagggggagcatcctgtgtttagaaccaaagagagtttagtgtgtgattattgggtgggggtgggagggtaggtcataaagggcctggtaaactgttaagaaattttaaactttatctcaagagttgtgggaaatcactggcaagttttaagttggtaggtgaagtgctggctggaggaatccctccagcttgggtatgtgaggatggcctgagaacggaggcacctgcagtaatcccccagtgagagacactgtagcctgagctgaccttggggctagaaaaaggggacaaatggcggctgaggaggagaatctctgtgagttgattgaatggggagaggcaaacatcaagcccagtgcccagacttctgggaggatctggctgctactcagtatggcggttgaggaggagaatctctgtgagttgattgaatggggagaggcaaacatcaagcccagtgcccagacttctgggaggatctggctgctactcagtgaaaggaagcctgggaggtttgggagggcagatggatgagctcatttatggacagattgagttcaagcatctacagatcattgaaggggaaatgtgagcttgaaccctgcatttgaagttcagaaaagagaaagagcagaatgaattgagttctgggagtctttcccatgtggatagtaactgcagcggatgaggtgataagatcacctagttagaggtgggggagcagaagagggcttagggcagaactctgaagagcaacctgcaaaggagactgaggaggaatggacagaaagggtggaggaaatcttcatgggtgcttttcaaggaggcagtggttaccagcattagctcctgcagagccaagagaattgagtcattttgctgggcttagcaacaagaactttcagggacttcatggcagcgtgacagcatatggagatgcagtactgttggcctgtacagagcctttttttttttttttttttttttttttaaattccctgagatgtagtctcgctgctctgtcgcccaggatggagcgcagtgactcgatctcggctcactgcaacctctgcctcacgggttcaggtgattcttctgcctcagcctcccaagtagctgggattacaggcatgcaccaccatgcccggctaatttttttgtatttttagtagagacagggttttgctatgttggccaggctggtctcgaactcctgacctcaagtgatccacccgccttggcctccaaagtgctgggattacaggtgtgagccaccacaccctgccagtacagagcctttgaagacattagaaaatgtgtgcctttctggatggacacagtccctggcttggtgagtggaccgtgcatgggacttcagctcttatgtgccaccttagctgggtgcacttgtttagtgtgcagaatacaccttccatgcgtggtggcctaggatatatctgcacttctcaatcgaaggcaatgttgcctcccagggaatatttggcaatatccgaagaaatttatgattgttatagctgaatcagagagggtaggtgctactgtcatctagtgtgtaaaggccagagatgctgctaaacactctgcagtgtccaggacaacccctgacaacaaagaattatccagccccaaacaccagttgtgctgagaaacgctggtgtctgtgaccctttcaggctcatgggaaaaggcggtcagagagggtgatagctggaggtgggtggacctgagaacaggctccttacatactttgctgcagtctcatttgcttgtggcagttttcaccttgcctctcctacctctctaccatagaactcttactcatcatgttataggttttcatttgtttattcttatgtagccattttcactattccctctcccacccccactcccccaagcagtaaattctgtaatgcaaggcaatcttgtgtccttatttctgtttctgggcacactgtaaaacatctgtattttaatagtatctgtcaggaaattctattttggcaaccaagtacgggctaatctaaagtagcccatacttgagtgctatgttgataaggctctaatgcatagttagccccttgactgtcaggcttggaaaaaagacaggaagtattccttgtctttggaaatgagcctactctggctttgggaaggaaagagtacaaatggttctcaccagatagggttgcagcagctctcccagcattttgggaacaaatcaggtcattatctcaacaatgtcaaaattgtgttcccagatcggttgttgtttgaaacatttggggctgatgcggaggaggagaattaattagcagctccctctgttggtgttctttttcagccttctcacattgcagcacgagagtcccttagacatgctggctgctcatttgataatctgtgttttgctcagtacaaaaggttgctggctaagttttgtgagcccctctaacgtcaggctggcagtatcttgggttcaattaacaagaaagtctacagtaacattttgtcaatggggaaggacttgaattcacagaactgtctcggaaagccctgggtaagtttgaagagcaaagttgccttttctgttttcagaaatattttaccccgcaacgatgtgtaaatctaaagcctgtgcaagaatgaaaacgagcttgagtattaagatttggcacagtgtgtgcaagcaatgagactgggttaaaaacaggaagtgtcttaatttaaagatggtgatggggagacggattaaaataaactgctggccatgttgaatctgagataggcaagccttggttgtgggcacattcccttctgaattactctatgcagatatattttaggcctctttctattaaattgtctttcacatggtttcaaagatagggctagtgataagaattctcttcctgcatggtgggtaccattatataaacggtatgagcatgcttttcttgtgtctctgtataactgcttggtctggcactccacaaaatagtaaaacacatttctgcagtggactagcccatgctgtgaaagaggaaggtggtggtggacaaaaagtggtaagttttaggctgaaggatgttgatgttaaactttatttctgattatggcagtctttcatcatgtaatttaagaagcctgagatcatctgacttttttttatgttttttttctttaggactgcaggaagtgttgataaacatctgtttaagttgtctataccatgaaatccataatcttccttcataactatgatagcatatggttttctatagttaggaaaactatttctcatgtatttcatggtttggccaaatccttttattacattagtactaaaaaattccttaggatttctagagaaaataatatgtattatggataaataagggaaagtaagataattcttaaaccttagtatcagcagtcattctaaaccacattacacatcttcagtaaaagtggttacaaaagatttttctcacttcaaaagatccgccagggaagagtcccagctttttcttggtgttattttaggtattaactcaggagggcttcctgaaggtttgtcagtgagatagttggggggttcctgagctttttattgttgtacgtgaacttggtacttacttctttggcttttaaactctcagcagcacgtacagatgccctcacatgctttctgggatgactttaacgctaaatagcaggggtgtttctcaagaatgtttaagaaaagaaagcagacatttgtttgcacaaacagatatttgtgacttctgtgaaaaaattccaatagttgtaatataggaaatttttataaacaaacacccctaccaactaacccatcgtgtatttttatgtgtgtatagaaaaaatgaaaggatatactaaaatgttaattgcatagtttctctgggaattgaatttaattaaaatttttttatcaagatttttaaagttttataatgaccacgttatgtttatgtaataaaaataaaatagaggctaggcacagtggctcacacctgtaatcccagcactttgggaggctgagatgggaggattgcttgagtccaggagttcgagaccagcctgggcagcatagtaacaccctatctttatttttaaaaaataaaataagagagggggacaataaatgcaaatatataaatgacagaaattttatggtctggtcaaagaactatcattgcatgaaattatagatatggtcatgtaaggttaccttttttcattataattccaccaataattctaaagtttcttttctttttttttttctacttcttccacagaaaaacaggacaaagaaacctgtgtgaattttcagcttttcaccttctctgattttatttcttcctcactcttcctttgacagtcctcgcagtccgcctgagagagtagagaagaccccctcccagaaccttcctgtaaggtctccccgctgacttcctgtagtggatgtgactgtgtgccaggtgcctgccgaagacccctgtcactgactgtgccctttgggaaagagtcaacaatggcctcctcctatggctgacttcgttcatgttcaggctctccagcttgctagtgagaattgccaaggattggttcatggcaggatagaactaaactgatagatgaaagctccacagtgcttcaagacggggtcccgttcatgttaagcagttttccttccttcaaaataaaaaactagcagtccttagggaggacagttttttccttccttttcctattctggctccaacagctgtctcaacacagcccgagatggggagcagcctggcttccaccggcaatagctgtattgtgggagtgtgaaagagaagccaccttttcctccctctgcccaagccacctggcccctttgtcctttctcctcctcgtcctctgaggtatgagtggctgtgactgtatgacataggaactatgaagcggggtgaggggacggtttggtgcgtaaatcctcacgcaggtggcggttattgtctgtgtggaggaaataagcccggttcttcctgggactgctttcatttccctctagcttccagagggtaaaatgaaccttaatggaggttggggggtggcacgcacaaagtcctgggttgagggggcagtggtcagaaagttccctagggtaatatacaaaggagaattaacactggggacactgaggtgggttttggtcctttccacataactgacacctttcaaagcaaggacttgctttctcgtgaggaatgtcagcagtcgcaacaccactgggttggatgcaggataattattcagaatcacgagttacctgtttgcaagcaatcacattgcaggtgggataaataagcagacagtctgtggtaggttcccccaccccaaccgcctcccctccccccagggatactgtaattttaagtattgttttggatattggtaattctaaagctccaatcttaactgggttttatgaaagccgttatagggtgtttattaccaaaaaaacctccttcttatttaataatacagtgcctagccactcctttttccctgcatccgtacatgaagcctgattgcagatctcgaacagtatatttctttgagctaaacagcaagaacagataaggtatcttatcaaaacaccacgccaggtggcgtggctcacagctataatcccagcaatttgggaagctgaggtgggaggattggttgaggtcaggagtttgaggccgcaatgagttatcgcgccactgcactccagcctcagcaacagagggagaccctgtctctaataaaacaaaaacattacaccattgtcagaaagtgatttgttcttctttgttggattaaattctctcacgtgcaaggtagtggccagcagcctaagaagatacacaagctcttcactgtagatgtttggcggtgtgggagttacaaggttaattatgagcgtaaggcccaggcatcttttcttcctaacaatttcatttcatcctatttctttttccattctttctccgaactgtctatactttattaaagtcttctttttcccagactccagaataatttcctgtgatatgttttagcagtttctccaggaaaaggctccaggagtctttaaatccagccctctttctgctgtatctttgtgcctcacatcttgagagaagttgagtggtagaaagtaaaggaaagcagaaaaagagatgggtcagggaggaaagccaagatggaaaatggatgggaatgaatgaggaacatgatgtgggttggggtgtcaattcatggttaatacaacatgtgtggctcagtataaccagattgtcataagaagctcaggcagctctccccctctgttgcctggggcttttcgcagttacaataaaagtggaaagatgaagaataagggcaagcagaagacacacacatttgcctgtttccctctttttgtccagattgagtagatgggaggcagggctgttacccatgatggtgtttcataccagagtcaatctactagtttgcttggttttataggcgtgattcccaaattttgaatctgaagttagctgtcagtttaaattcagagggtccgcagttgtttttcaggtttttcttgattctgcctttggaaaccaggaagatgttgaatttacttttcatctgacaatattgcacatctgtgaacccaactgatctgaaagtgtttacctcttaactctgtgaagttagctggttattctggatggctgggacaatggtgaggaccgtttataatggttactctcacctgtgctccagacgctccacttggtgctagaaatacagcagtgaacagacatggttcttgcctccacacagcttgcagtttagtagggcagactgacgacattaaaaagataccatcggtgttgttataatggtgataagagttacaaaataaggggccaggtgcagtgtctcacacctgtaatcccagcactttgagaggccaaggcaggaggattgcttgagcccaggagttggagaccaccctgggcaacatagtaagaccttgtttctacaaaaaaaaaaaaaaatcaaaaattagctgggtgtgttgatgtgcacctgtggtcccagctactcaggaggctgagttgggaggatcacttgagctcagaaggtcaaggctgcaacgagctatgatcgcaccactgtattccagcctgggtaagtgagaccctgtctcaaaaaaacaaaaataaagggagcatgtaacagtaggatctaatctagcctaggcaagtacggcattcttgagaagtgacttaagacctgaaggactgatcgaattgtctgtgtgaagattggcagcgggtgctctgagggggaaaagcggaaatagcatatgcagacaccctgaggtagaaagggagctctggcctgcttgtgtgattactgtgggagaatgaacaggaagaagacgaaagtagaagcaagaagaccaattaggaggttccaaggacctgcctaactaaggtcagttagccggtgattgcccaagccaagactcaaactcatttttatgaaggccgcacaccctcatctcctcagcagttgttaaacaatatttgataatggtgttcatgtcaacctggcacatgtctagaagattcttaagtgactttttcttttcacatggctttttgaccttttaaatataatatgttttaatatgacgttattagctgcacaaaggaagggaactgctcatttgaatgaaccagaagaaacttggaattttgcctgccttctgcttcagccctgccaaaatgtaatttctttaattcatcaaatcacattcttgactaatctgctcaagtctgtactatgccttggcctttttccctgtgacaatttagggatctttaaagaaaatattttgaaatgttttctcttgatcagggtgcttgtggttaggtattgcatacactgcttttatttgcagaatgagctatttttctaccatgtgatcctttgttagaaatgaacatgattgtggctggccgcagtggctcacgcctgtaatcctaggactttgggaagccaaggcaagaggatagcttgagcccaggagtttgagaccagcctgggcaacatagcgagaccccttctctacaaaaaaattagaaaattatccaggcctggtggcacacacctgtaatcccagctacttgggaggctgaggtggcaggatcgcttgagcctaggaggttgaggctgcagtgagccatgattgtgttactgcactccagcctgggtgacagacagcgagaccctgtctcaaaaagaatgcaattgtaattttgtcacctttatttaaaaaaatcatttatcaggtggttgcaatgaaaagcaatttagttgtttacaacctctaccttccagggacttaagtgtgttcagaagtatttaaaatgaaataattatcttagctaataatgataaaattactgtggagcattgagggctactttgtgccaggcaatcagctttaaacacctttgattttctccctatgatgaggggtatactgtgatttttattaaacatttggggaaactgaggcttaaagtggctgagttttctaagagcacgcaggtggaaagtgatcaagctgagtcctcagcttcatatcttctcagggtccttgatcttccgcaccctgtagttctggttcattttaggcaattatcagaagtcacctcaaatgccaagaacctgtgtaacacaggggatgaagtaaatgtgagcaatgtaatgaagcgtttccttataaactgttgtaaggattttgttccagagatgaagtatgagaaaaatataagccaattgttcagtttcatattagtcaccctcttctactgaactttggtaaattcaaagcttccctctatacgaatttacttttataggaatattacaaaatctatactaagaaatattagaaaataacctgtacttaataggtttaatggaaattaaacccaaatataatggaaatctgaatgaatgctcatttaaaaaaatataatttatagcagtggttctcaaactttagcgtgcatttgggtcctctggagcattatgttaaaacacagatagctgggctccaaccccagaccttctgattcaggagttctgggactggcgtacaaatgtacatttttgacaagttaccagctgtatgagggttctccaaagagacagcataggtatattaggaaggagattcattataggaattggctcatgtgattacgaaggccaggaagtcccaggatgttccccaagaagtctcaagatctgccatctgcaaactagagaacaagaaggccattggtgtaattcagtctgagtctgagggctgagaacctgggagcacctggcgtaagtttccatctccatctgagtctgaagatccaagaaccaggtgcgctgatgtctgagggcaggaaaagatagaagttccagctcaagcagagagcaagtatttgcctttcctctccctttttgttctattctggccctcactgattggatgacacccatccacactgatgagcatccatgttggcggtcttaacccttttcccacttagaaaaaaagtgcggtttgtggccagtgcttatttaattttacataaacaggctgttggaggctaaagcaaatcggactgattttcagtgtgaaaataaaatagaaaatattatttctaaacagaactaacatcacaaccatctgaattatcagaatcatctatttcagaaaaatcggattcatcaaatgaatcttccatcaactgttagagaacgatgttaacatcactcataggaatgctatgttttctaggatttgacattttcagcaattgagaattactatattttgtaaatggaaatgccactactaaaaacagaatcctataaataggatgatgtcttttgtttccaaagtcgatatactagaacgatgtgaaaatttaaaaaacgagatctttcgtggcaaggttatcttggggtaaacactgcagctgcaagcaccatgggcaagtattctcagggcaaacaggaagagagttagtgaagtctactaattcaaatgctgatctcttcttggcacacccagaagtaatgttttaccggctgcctgggcatccgtttgcccagtcaagttggcacgtgaaattaacctgcataccaggtaatgtttctgctgctggcctagcgaccacactttgagaacaactaataagtcataagacagtagaacccctggatagtaataagtgctcgtgaaatgagctggccagtagctaatccctgagaaagccatttcctagtcttataccacgtcagtaatccaaagcaggatggcgatctgaagtcctgaagagtcaagggtgatacgatgactctatggagccatcaccactattgggaagacagtggggacacctgcctcccctaccttccacaccatgtacatgatggcacgtgacttagatgtgcaaactgtgcagtgtcagctttgtgatgataaactcttccactcagtctgctatgtatatggcatagtcactatactgctaaattaaataaatcaaatgagtgaacataaatcaggattcagataccaattaggtaaaatactatagtttgtatatgatggggattatcctttttctggaatgtttcagcatccaacctttgctgcgtttgtcttcttgcagtgactgagaattagctgaaataactgtaaaagcgtaagattcccatttggctggagatgaaatcacagaggttggtttactaagccttaagaaattcctttagatttgatgtgtccagacttgtactggaatatgaaatattcaatttgacaagatctgtgagttcctagtacatacgtgtttttagaaatgtgtttctcaaaatacaattaggaaaaaatccctttgaaatgctaaaactacctttagtggtgataaagatgccgacaaccccttctgtttaaataaaaacaaacaacttttaaccttcatgatgttataataacatcattaacttgtgtagacaaacatcagtgctcacatttaaagtaatcattaaacattttcagagttatacttaaaatgactttttaatcatactataaaatactgctgcaaagttgttggtggggtactaagttgtagttcttatttcttctttctctacagtctgttttggctctaccttggggggaaaatacccaaagaattgtaactgaatacagaagcattttaaaaaatcttattttaaagaggaggagaaattttagagctatttctgataataaacctcaaaaagtgagaagtattagaatttatcttggttaattttctttttttaattaacgagcatgcattgcttatataaaacttttctctgtatgtgtctgtatctgatgcagttagaagttcaatgtgagtttagtgattcccagggaagacttagggaaccttggtttctgagttgtgctctcctctgactacgtggtgagtcttagtctctggagtcagccagatccagatcttagtctcatggagttagccatgatcattttaaacttataattattaaagtgctatgatgtacaaaggtgcttatgaaactaaaatttgaggaattagatacaatgactatgcggttttgctttttagtaactgtttctcattacttcattgatccaaagtgagatttttaaagctaaagtccttgttccattaagataattctgtcatttgtccagttactctccttactcaaattgctagcccctttggtacttttctctctagctcttgccctgcttcatgatgttcctgaatagttttagttttctttgtttatttttccactttcttgggccagacctccaatttaattcttttagttgaatgagctgctttctcgcttgttacagactcacttagggctcattcctccctgccttagtcccagtatggtctcagtaatgacatgcagtatggggactttggactcctgtttgaacaaaccagctttgagatgataaaaatttgaatatgaattgagttcttgaagataagaaattgttaattttgttaggtttgttaatggcatggtagttactctaaaaacaaatttctgggcgagtgtagtggctcatgcctgcaatcctagtactttgagaggccaaggcaggaggatcacatgagcctgagaggttgagcctgcagtgagatgaaattgcgccagtgcacttcagcctgtgtgacagagcaagaccatgtctcaaaaggaaaaaaaaaaaaaaaaaaaatttattcattagttataaatgcacactgatgttcttataagtgaaaagatatattgttttggttttgctttaagattccagcaaatataaaacagaaaaagagggaatatattaaaaaggctggcaaaatatgtatcattgttgaagcttagtgatgggtgcattgtattcaatatagtattctcttttgtgtatatttgaagtttttcatgatagaaggtttaaaaatttagaacaaaaatgaatgtggaggttcaggatcctaccagatgtttctaaatgaactttaagtgacaatggggaaaaatgtccatatcatcctggagtttaaggcagggaattcttggtagggggctattgaaaaatagccaaactgttagtcaaaaatgtacatatgatctcatggccacagatagtaatgtagaagacagatcacgaaagtactaatccttgggtgaggaagaacaggagaaggcagcccaagaacttaactgaggccccaagaactaaggaaatctgttttgtaaaaggacctgtacggccaggtgtggtggctgacacctgtaatcccagcactttgggaggctgaggtgggaggactgtgtgagcccagaagtttgaggccagcctgggctggtttaattaaattagctgggcatggtggcacacgcctgtggtctcagcgacttgggcggctgaggtagaaggattgtttgagcctgggtggttgaggctacagtgagctatgatcgcgccactgcattccatcctgggtgacagagcaagactctctcaaaaaacaaacaaacaaacctatacgaacaatggtaggaatgtcaaggaacccaggagtgaagatcggattagtcagatgctgtgagaggaggtggaaaaaaccagtgtagaatgggcaggcacctttgaaaaggctagaggaaaattttggaagggcattaaggaggagcatagcaaagaagtctagacctatgacttggagctgttctgttatataaataggatatccagagatagcaaactgctcactgcaggaaataggggaaatagaggataatttggaagaacaccccactgttattatttgtggcagttatgttctataaagtcgctgtggacataattagtgaatactgagccattgctcctaggggaacaatacagagttagattcctgtgagcctctggttataacgattttgtcagctgtcaaccgatcaatacatagccttgttttgcatgtgtttctgtttaaagataccttgtttaatatacattgttgattcattaacattgacctcatggcgaagagcactgtatctcatgcctaaatgaagcttagccaatgcgtctcttcttcctaaggcacatcatggccttgttgtgattaagaacattagacgacactaaggcatgatgtttggggctcattttaaacagcaaaatcaccaagaaacccacaaaaatgaaaaaaaaaagccctaaaaactagccacaaaagggacatttgttaatagtataagggctagaacaaagagtgtaggctggttttttggcttcagctgggtacatgtatgtggagtgactcaaatattttggtgtgtacttgcttcagtggcacatatactaaaattggaatgatacggagaagattagtatggcccctgtgcaaggatgacacaaattcgtgaagcgttccttaataaaaaaagaaaaaaaaattttggttctctccacctgtgcgcaaatgaccatgagcattagtcttggggttataaataagttttagtagatgaatttgcaaatgtggaatccgtgaataataaggatgtactgtattttttcatctttatttcttaattaacaactgtgatctgtattttaaatgagcctttttgggggagcttgataggcattgagtgtttttcccaaagatttgtcaccttcttgtgagttgtctagtctgttcttttggttttatagatttattctaaactaaaagttaatggtagttgccatttataatttcttgcagaggtttttgcagagatcatccatttaatatttttgtgcattgaaggttttaattgtacagtcaacactgtcattcacttgtgattttcattttttccaagcttagaaaacttgaaggatgatgacttttttattggagaggttaaaaaaaaaaagtaggtaaaagtgatggatgcttaggctgagggtggtgactgaatatgtggtacttgaaattgagtttgagtgtccaggcctggtttcattatatcttgggacacttaaaaaagtcttgcagaggcaatctgcttgaaaatgctgtataaaccttaaacctctaaattgtaaaatgtaagtgcataataatttctgatttgtagacttctgttgacaatctttcaagacgggagaagggtgaaaaagacggaaaagacaaacagatatttttcagaaatgaaaaacatgtacattttctgacatagggaatgagagatttttctaaatgtgacccagaaggctttcaggtgatttcctaacaagatttgagttttctcggattaaatatggttgtggctctctaccatgtgccccagtcttatctttgttatgccccttcacacatactctgttcttcacatactcttccttctgctggctagtgcttccctgtttctggaactttcttaagcatttttaccatgtattatagttatttgtattgtagttacgtgtcatccttcttcgtcttagaagagaagtttccatctgactccatgttttctattgtagaccctagttcagtgccttttaaacagcagatatggaataatcctctaatggaataaatggggagaagaagggatagtttgtggttacctgggaaagcagtgtggttaagtcagcatgggtttctcaagaacaagcctttcttgaattaacctcatttcctgtataaatcagatacttattggagagagaatttgggtaatgttgttgttagaggatatcagaataaaaaaactacatgtttcattaagttcttaggattttttatggataagttggaaaagcatgggcttgattgtaataagatagatgaatgtgttgcaggttgattaactgttgactttgtgcaattcactgccttgccagtgctattctaacttttccatcagggaactattaaggaagaggaaagtttatactttattttggagggtttagagggttgagggtacaggaattgaaggttggattgtgggcaggatgtagggagactttagaggcacagccaggagcgaaatgtctttgaagactcatgttttcacataaagatgcattcactttgtatttttaacatgcccatgtttgttttaaaatactttaaattatcaccagataaaatgtttgagtagccctttcccaatgtcatgatattctagtttgagaagagtggtctttgatcaagaaaggtggatcaaatttgtgtctatcccattgttgggagggaagctaaccaactggatgtcagacatcaggatagaaaaaaaaaaaggctgcaaaaagttgaaggcaatcaacatgaacaaatacacaattaagctctactgaatgcagcttcctagagtcgggggaaagttgcatgtttatagaatgggagacctggatcagtagcagctcttgttaaaaagattgaaggtttcagccaaccatttgatatgggtggccttctctggcagctttaatggcacagtactcagaattaaggagataatcatcccgttgttttctgacttcgttaggctacctccgagggcttgttttcaaacaagttctacattttaagagggtaagccagggaaataaatggactagaaactatgccctaccaggaatagttgaaaggctatcggggtggaaaggagagcaaagttaattctcaacttcaggggggcaggattggaatttatgggtagacataagaaggatatgtttttctatttcaatcaattaagaatttttgctttgtaaacacacataaaatggatatcatatactatttagtaatcacttttttcacttgatagagcatgtatatcttatgtaactatttgatatgttcatatgatttttaatggctacatagcatctctctgtatgagtgcactcttatttattaaaaccatccctgacagttactttggtcatttccaatttcttagtataaacaacaactctacaatgaagatatctcaaatacactcatcactgtgcatttgttgagttgtttccttaggacaaattcttagcagcaggacagctgagtcagcattggtactatttacttatggcttttgaatacttattgccaaactgcttcttaccagtaataggaaccgcatgtgttaaagaagtcagattaccccaaattagagatgttgtcataggattttggcagtgggttgaatgttggacagtgatctaaggctccttaaaaaatgcatgaaagttttagtgtaggaccagatgactgtttcatctagaactttcacatttcagtcttactatgtaagtcacactgttaaagaaaactgtcaagagtctgtaacagagaaaatactgcagacgttttctgtattcagaaagcactgtagaaattgaccaaggaagagaggctcatggcaggcaacaacgcaatgctgttaggttgcatgtatgatagaaatagtaaaggaatctttcagcagattaaccattttataacttaggtaagttggggttttccaagtaagtaaattgcattttctttttttttttttttttttttgagacggagtctcgctctgtcgcccaggccggactgcggactgcagtggcgcaatctcggctcactgcaagctccgcttcccgggttcacgccattctcctgcctcagcctcccgaatagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccaagtaaattgcattttctacaccctgccagagctgggtaacaactgcttctggggaagatgggaacggacaaaaagctgctctagatcatgttcccagtaaagagctcaaagtgattttgcacgtgttttatcctcatgacctaaagctcagctgcagtgagatggtgtagtgcactgagattatcagcaaaggggattccagcttcactgcttgagtaagccactgggcctctctgagctgtagtttcttaacctgcataggagatgaattaccaatacaagtcagagagttacagtgaggatttcctgagatgatatattggatagtactttctaacctgtaaaatgctttacaaatattagttgtcaagttagacaaccgatgctagtggagatttccaatttaaagctttctaatggatgaaagagctagtgaacttcatcacggcagaagttgggtctgattttgcttgattttgccttgatgtttggctcatagttgcaattcactaaatatttgttgaatgaaaaaaatgaaattagcatttcattgttttattaacacattagagaggcacccatgaaaatgtgtgcttctcatctttgtggagtaagtactgctattcattcttacaagcagggaagcagatccatcaattctcaaatcactctcacagccagattctgcatttttcaggtgatttctaattacatgaaagagattagatcaagtactcttttttggttatttaagaggaaagatggaaccaagcctgtgttctgtagctctattgtgtaaaatcacttcgagcaaatgaatgaaatattttgtcagactttttttttttttttacttactgacccttaatagaaaataattttatgtgtagccctccccagagtctctgttgccaggaagctaatgttgctatccctaatacggcaactttgtctatttttctgttctttgtgcattgtgtttggtcttaaactgtgaatattccattaactgagaactctgaacagccattgtgtaactggagtgatagtctgtgtcagttcaatgcattgtacttgagaataaacatgctgttttatttgtggtgggacttctctcattgccactagtaatatgttgttaactgaaaatataaggctattaataagcctcataagtactttgcattgttgaaacaatccttcagtgtaggatcacatgattttgtagatatgtatgtgtgtgtctatattttcaaataggcagtagacccattcgtttcttatccttgggtgtgaggtcagaagtgtcagtgaaattgagtccagaattgtagttatgcgtgctttcctagggagaggtttctcttctttttaatcagaatctcaaaattgctctatggttcagaaatgtttagggaccactgacgcagcaaattcagttcagcccggatagtttatttgatctgtggtgactgtgtcactagaaagtgatataaaatacctagactagcacagggcacacataggttctacacaaatatttgttggaaacccaataaaaatcactggtgctttttttctttcttccctgtaacacattatggcctgtgaacctctagaagacaggatctttgtcttacttagtctttggcagctgtgttaacttctcgcgtctgtctcctagtgtcatagaatgtgcactttctttctttttttttttttttgagacagagtcttgctctgtcgcccaggctggagtgcggtggcgcaatctcggctcactgcaagctccgcctcccgggttcacgccattctcctgcctcagcctcctcagtagctgggattacagacgcccgccaccacgcccggctaatttttttgtgttttttagtagagacggggtttcactgtgttagccaggatggtcttgacctcctgacctcatgactccgcccgcctcagcctcccaaagtgctgggattacaggagggagccaccgtgcccggccagaatgcactttctgtagcaaagtagaagttgtaaaactttttctcaccagacacccttatacatacaaaacaatctgaacatgtgtcctcaacgtagacacctagttataaattatatacgtgtacatatctctattgaggatatatgttcagattgttttatgctaatatgaaacatacatagttgcaatgttgagagatgaaaagtaatgttttagcatgtattgataaccatgatggctttatattaatattaaaagctatacctatttctgcccatgcctacttttggtgttctcataatctgagcatgcgctcagctctggctctttgcagccgctcttccacctcctaacactctttcaggagatgcccttactgttaactgcttattctctgtgcttcttaattcatattcttgagagtcagcatctaattgactcagttcaccttatcattccaggtcaactcatgtgagtctcattgacatacagtgttgtttttggcttctcttgggaagcccactctggtccacacaggtgactgcatgaagtgggaaatgaagacacttggcacagacatggctgttcaggtaacaaagagtgtgtgcagggcggcttcactgagaaggagcctggtgaggctggaatggtgactgctttcaccattagacaaatgtcagtgggtagagaagagagaccaaagtgtgactttagaaacagaaaaatccccttttcttcctttgcaaatccatacctatatattttgaagaccactaggcatgtcaggtaaactttcagcaatttaaattaatcagagagctggagaacatctattcctgttaagatctttcccacccattcaactccctgactagttactgctaaagagaaaaatggtagcagcttcatctttaagacttaagccatagttcttgcaatgggaaagtcaaccctaaagaatggtttcatgtttgctcccattctaccttgtgcagacagtagtttaaggatgtcttctgcagagcataacttgtgtagtcacccaaaagggtcttccagttcactgagaccatggtattgcagtaaagaaagagtttaattgacgaagaggtggctagccgcatgggagatggagttatcactcaaattaatctccctgaagttttgggggttgaggtttttcaaggatagttcggtggacaggggactatagaatggatgttgctgattggctggggatgccatcataggagtgtggaaaacagccctcatttgctgagtctgcctctgggttaggggccataggaccagttgagtcatgagtcgcaggtccaggtggagtcagccagtcgtcaaaaatgcagcagtctgaaaagacatctcaaaaggccaatcttaggttccgcaagagtgatgctatttaccacagtaattggggaagttacaaatcttgtgacttccagaacaatggctggttatcatttatacctacgcttttaacaaaacttttattttaggttcaggggtgcatgtgcaggtttgttaatatgggtaaactcgtgtcatgggggtttgttgtacagattgtttcatcacccaggtgttaagttaataatacatagttatttttcttcaccctctgcttcctccccaacctccaccctccattaggctgcagtgtctgttgttgtcctctatgtgcccatgtgttctcatcatttagctcccatttataagtgacaacgtgtagtatttggttttctgttcctgcgttagtttgctgtgggtgatggcttccagctatccatgcaaaggacatgatcttattcttttttatggctgcatagtatttcatggtgtatatgttccacattttctttatccactgtaccactgatgggcgtttaggttgattccatgtctttgctattgtgaatagtgctgcagtgagcatatgtgtgcatgcatctttatgatagaatgatttatatttcttttggtgtacacccagtaatgggatttctgggtggaatgggagttatatttttagaactttgaagactcatcacattgtcttccacagtggttgaactaatttatacttccaccaatactgtgtaaatgttcctttttctctgcaacctcgccagcacctgttatgttttgatttcttgataatagccattctgacaggtgcgagatggtatctccttgtggttgttatttgcgtttctctaatgatcggtaatgttgagctttttttccacatacttgttggccgcatgtgtgtcttcttttgaaaggtgtctgttcatgcctttgcctactttttaatggagttgtttttttcttataaatttaagttccgtgtaggtgctggatattagacttttgtcagatggatagtttgccaaaattttctcccattctgtaggttgtctgtttactttgttgatagtttcttttgctgtgcagaagccttttagtttaattagatcccatttgtcaatttttgcttttgttggaattccttttgacattctcgtcacgaaatctttgcccattcctatgtccggaatggtattgcttaggttatcatccaggtttttgagtattacatttaagtttttaatccttcttgagttgatttttgtatatgatgtaaggaaggggtccagtttcaattttctgcacatggctagccagttatcacagcaccatttattcaacagggagtcctttccccattgcttgtttttgtcaggtttgtcaaagatcagatagttgtaggtatgcggccttatttctgggttctctcgtctgttcccttggtctgtgtgtctggttttgtaccagtgccatgctgttttggttattgtagcccagtagtgtagtttgaagttgggtagtgtaatgcctccagctttgttctttttgcttaggattgccttctatgcctacatcttagcagaattcaggcccttctcataaccctaaccttgtggtgtttcattagctttacaaagttgatttagttttggaaagtgctattctcattcttgctttaaagttaaactataaactaaattttccccgaagttagctttgcccatgcccaggaatgacgaaggacaacttggaggttagaagcaagggtcagatatctcttactgtcacagttttgcaaaagcagtttcacttccctcttctaagtaccttctgcattgattggagccagcaaagagaacttttgcagcatttcttagtttgaatgtgccatataaatgaaacatgtttggaaatgtgaaaccaagtcatccatgagaatgttttcctctgaaaggcagcacttcttgataagtcccttcctcatggaactttggtgcagtgttggcccattttaaaatttattggttacccagggagatgcccgagcttatcagaattagagtctctcatttgagtacgttcttgcagtatagaagtttgcagatgttttataactttaagaggcccagtggtattgaatttagagttaatttttaaaactggctccaaagtcaccagcatggacaaaacttacagtcttccaaagagagagtgccaaagttcaacgcttggcattgttggtttttttttttctttgtgcccatatcaggtagctatgattatcttcattttacagagaagaaaacaaagctcaagagttaatttgactaaattcacagatgagtgaagtatgaggtagagagtgatcctgtgtgagaatagtttacatttatcttgatgtggttataaccactaccttatctataatgcatgttaaaaatcaacttctcaagattttttacaccaaaggcaaaaatattcaaatgttgatatagtcccttccattcatttttatatttttgtttaaaatcttcaacatcatacccagttttcaacctaactttataaagtaagcatttccttaatcttcataaacatgtttaagatatgtatcataatttaacaaattattaagtttctgaaatttttacagtagtgaggcagtggatgtatttatgtgtaagtctgtggggtttttttcctgtctctcccatagaggcagagacttgctctgtgacccaggctggagtgcagtggcatgatcgtcactctgttgcccaggttggagtgcagtggtgcagtcatggcatgctttaacctcaaactcctgggctcaagctatcatcccgcctcagcctgctgaatagctaggactacaggtgtgcatcaccatgcctgcctaattttctaaaatttttttgtagagacaaaatctcaatatgttgcccaggctgatctcgaactcctggcctcccaccttaacctcccaaagcactgggattacaggtgtgagccaccatgcctggccaaggttgattttttaaaaacattatttccttagtatgtgtatgattagaagcaaaattacaggtcagaagtcacattttaaaagatcatgaccacttaaaaaacccttaatatgttttgccaaatttatatcttttaaaaatgggatcgatttccacactcatcggggtatatttgagtatgtagctcactgtagacagagctcctggggagggaggaatggctctggtgctcttctacccacctgtagaggttcagctggggaccagctccactgtggggcattgggaggctgttagtgcagaggtatcttctcagtatctgcctgacacactactgtatccagctgcctgacccagtcctgcccacctgccttcctttcttcctgcctcccctctgttttatcaactttgtctcaaaaaacatagcttcctatctctatatgttcgtctcctatttatggtccctcagtatgttatagtgcttgctaaggtttgaatgtcccatgtgaatctcatgttgaaacttaacccccaatgtggcaatattgagaggtggggcctttaagaggtggctctgccctcatgaatggattaatccattcatggattaatggattaatgggttatcaggggagtagggctggtggcttttaagaagaggaagggacctgagctagcacactcggccgcctcaccatgtgattccctgtgctgcctccagactctgtcaagtccccaccagcaagaaggccctcaccagatgcagccctagactttggacttctcagcctttgtacctgtaagaaataaataccttttctgtataaattacccagtttcaggtattctgttataagcaacagaaaattgactgagacaatacgtatattctaattgtgttcacttttctttcatctagacttaccagaagtttacttctctggttggcttttcaaggaagcttttgaatttcacttctattttttctattaatgcattcattattagtgaagtattttgtaatcatttttcaaacagattgggtgttttttttttctcatttcaatatgtagttcacttatgttaattatttagggcttacatttttctctgttctcaaccttcatcagattccgtaacacttgatacgttgtaaggtttctgttttcattcattatacaccttccccaccccaggccttttcattactttcaacacagtctcgtattaggatttatgttttttaaaacaattatttaggagaatagaatagtttttttctccttgtattgggttttttgtttgtttagatgtctgttgtttctgtgatggctttgttttaatctgtgcttggagagtgctctctcattgctactttggagaatgtattattctttggcctagtatgattgtgtgtgtacatttggggacaaaatgtttttgtggagataatgtagacttaaaattttaaatccgtagctgtattttcgtcacaatgaaaatttgatgtccttagtaagccccgaatagaaagccttgacttgctttttgagcatagttaacagtgttgagataagagaggtttgctggcagttgcactgatggctgcactgttgtccagtgggcccagctgggtgtacagctcgccgtataaacagaaatctagacacaggtccctagaagcctaatctgtgacctagaccctgtctctgaggtactcttaccagaaagttaatctgttagaggatctttcatcagcataaaaggcagaaataattttctaaatgctgttgataaaatgtgagtgcatgctgcttcattcgattatggaaactgagcattggagacttattctcctttttaacaccacttgcctccagtaacttacactaattgtcatctataccaagcctttgaaaatttgtagtttttgtaagtttttaggaaatatgcatgctaattagataatgcctaaattatgttgcttttcatgtgaatttagtaaagtcatttaagacccgttggcttagtttttcatgagactttctaaacatgcttaatctctgcatactattttaataataatgtaagtttttgactttttgctattataatgggcagtgaatatatttgtgctgaaatctgtgtggaatttttttgaacatcattttcttactgtatattattagaggtgaaatgtttgggtcaggagttacaaacatatatatttttaaaaaactactctaaagatccttgatacattttgtcaaattgatttcttgtaaaaatgggaccagtttgcacctctgttgtggtatgagagagtgcccatctccttggggacctagccccttgatggttccagcactccatcgaaaaccagctccactgtggggtgttttgtgtgacatggtggtgtcatatgtcttctctgcaagaaaaggcattgttagcaaggcaaacagaaatactcgatacagttatgtataaaccagaggaagcctttgccagagagattgttgacaattgctagagggtatgataatgcagaagttacagagtgttcctttggcaacacgtgttaatggatttgttccagtgttggagccctttttaatgaaaattctcaacacctacactggaaaaataataaaataaaaagccttagtcaggaatgtattgcttgttaagatttagccaaggaagtcacatgttatttaacaaggtagattacttttttctttgtagtaggcaaggaaacagctatgcttcacttctaaataaaaaaaaaaaaaattttaaaaacgttttttaaaaagaaaaacgtgactaagataactgtctcattcccaggcactttttaatctcatataaatttacatttagagacttaacagtttggcttttttgaatgaatgccagaaatacagttggactatagagtctcagctgagaagcagacacatggagcaaggtatgttctgtcatttatcagaaaagttaaagaattcattttgtttaaaaggcagcacatagattattcagagagagaaaaatatgggtttataggaaaattcttatgtatttggtaaggactctgagtttgtactttagcttcatgtctcataaatcaagtcccaagttcaccaggtgatagtattcccaggttacttgtgggtgtaggtgcagaacaactcggaactttgtggttgggcatctttttctgccgtccaactttggaggttgctgggaggagatgcttattttccttttttagggcatttcagtttaaaacaaattaaaaatggaaagtcaatgttttccctccactaatacaactcttaacttatggttgtaataaacagtgattttttttttttttttttttctaagagacagggtcttgctcttttcccaggcttgagtgcagtggagaaattgtagttcactacagccttaaactcctgggctcaaggcatcctcctgcctcagcctcttgaacagctaggactacttgcttgtgctgccatacccagctatttcggatcatgaggtcaagagatcgagaccatcctggctaacacagtgaaaccccgtctctactaaaaaatagaaaaaaattagctgggcgtggtagtgggttcctgtagtcccagctactcgggaagctgagacaggagactggcgtgaacctgggaggtggagcttgcagtgagccgagatcgctccactgcactccagcatgagtgacagagcgagactccatctcaaaaaaaaaaaattttttttgtagagacagggtctcgatatgttgcccaggctggtcttgaattcctggcctcaggcaatcctcctgccatggcctcccaaagcactgggattacaatatggacataagccaccatgtccagccctacttttgcttttttgaaggacatgtgtgttaagcagaaatttctaaagtcagtgcattttttgcatcagaacatgttttaactcatgagttaaaacatcgctgtttctggcataacggtcttcccacatttccatctttatattaaaaatttctgaaataaaatttctttttgggctagaaaaaggtaagattggatcaagtgatccatttaggacttgccttttcatactttgcagtctcattactattatcacaatgtatgtcctaatacaataaagttgaggtttaaccaaaagttctcttttcttctggcatgctttgtgagaaaatatttgagctggtgtaaattgtaattactggcagatatggaagagagtctgacttggagtattcatgatgctgatatgctgctgcagtcagtcaagtgctgcgtgagttgatgtcattaccaaaggacagtctctataatcagagaataaagtataatttgtaaatgtggaggagctagaggaacaacttgatttcacttgtcactaaacttatctaataaataaaaatgaggatttattattattattattatttttttgagacagagtctcgctctgtcacccaggctggagtgcagtggcgcaatcttggctcactgcaagctccacctcctgggttcacgccattctcttgcctcagcttcccgagtagctgggactacaggtgcccgccaccacgcgtggctaatttttttgtatttttagtagaaatagggtttcaccgtgttagccaggatggtctcgatctcttgacctcgtgatccgccctcctcggcctcccaaagtgctgggattacaggcatgagccaccgcgcccggtcaaggattttttttttaaagccagaagtaatataagtcggtatcagtgagaaaaggtggtgaggatagcagggattaagtaagtcgcgggcattttatttttatcttaaagaaaatgttaaaatggttgacgttttctagctcaacactcccacccccacctcacccattgattgatggtttgctttcgaaatcctgagtgaaaagacaggaattacttcattgtgctgagagtgactgatgtcagaaggtcagttttcctacatttacaagattcatacacacttctgaaaggttttctgttagactgggtggactgtagatgaacagggcactttttgttttgtaattgcatttagctttaattagaggtttagagtagaaagctgagagttgcttggaggagccaaccaggagattaatgggctgtgcccatccgccgcagctctgtgcttccaagaagtttgccagggtaacctggatttgtctttattgtactggaaggagtcttgtcctgtagaagtagaaatcactgatgcatcactaacatcatgtggcctttgttctctgccgcacatgtttgaaaagcgcagctcgcacccactcttcccttaggaaagggggccgaagctctgtacctgtaacattccataaaggctaaggatcatgaggatgttgagtgggcagggccccagcggtctttactgaaataccagagcctgcactctgataatgaatgaggctcgagggaacattcctttggcatattttaatgcttgacctagttgactggggtgctctgggaaaatgagcctcacttcctgcttttccaccttaaattgaagtatggggtgctctgggaaaatgagcctcacttcctgcttttccaccttaaattgaagtatgtcatttatatgattgttaatattgaaatgagcagctgtaccactctgttctcaacagggaggaagcctttttatttgtaatgtttgaaaatattctttctcagccgcgcgtggtggcttatgcctgtaatcccagcactttgggaggctgaggcgggtggatcctgaggtgaggagttcaagaccagcccggccaacacaatgaaaccccatctctactaaaaatacaaaaattagccaggcatggtggcacgtgcctgtggtcccagctacttgggaggttgaggcaggagaatcgctgaccctgcgaggtgggaggttgcagtgagccgagattgcaccactgcactccaacttaggtgacagagtgagactccgtctcaaaaaaaaaaaaaaaagaaaaaaaatattttttctttttttaagtgtatatattttttaagttgaaacctgtgtttgccttgtctttatgcccacaggggaacttgaagtcattttacatatcaaaagcatcttctcaggttattctgaattttgagaaggctaacatttgctaggctttatgtttaaaaaaacaaaaacagaaaaagatcctgggcttctcccatcttgcttggcaaatgaggagtctagggtacttgtcttaaatgttctgacatatttcaattaaagcagtgaacaatattctcaaagacaaggcagcagctgatacttggtaatgtccttaaaactgcatagtaataaccttcagtgagatttgtataatttggagataagctccacttatatctgtaaagttaaagcacagagaaagttagtacagtatttgcctgaggtcagtcacgcagttggtgacaaaagccactattcttagtacttcatgagacttctgttttatataatagattacagaggccaggcacagtggctcttgcctgtaattccagcactttgggagactgagctgggaggatcatttgagcccaggagtttgagaccagcttgggcaacatagcaagaccctgtctctacagggaaaaaaaaaaaaaaaaagccaggaatggtgatgcacacctgtgttccagctgctcaggagactgaggtgggaggattgcttgagcctgggaggttgaggctgcagttagccatgatcatgtcactgcactccagcctgggcaacagagcaagaccctgtctcaaaaaaaattaattacagagatagtgttctagttaatagcaaggaaagaatggcttaagcaataagcttggccgggcacagtggctcatgcctgtaatcccagcactttgggaggccaaggcgggcccgatcacttgaggtcaggagttcaagaccagcctggtcaacatggtgaaatcctgtctctattaaaaatacaaaaattagtcagatgtagtggtgtatgcctataatcccagccacttgagaggctgaggcaggaagatcgcttgaacccagtatgtggaggttacagtgagctgagattgtgccactggactccagcgtaggcaacagagtgcaactgcatctcaaaacaaaaaacaataagtttaatgaatgattcccaaagtatggtctatggaccagcatcattcacatcatctgggaacttattagaaattttaaatttttaggccctatcagacctactgcttactctgaaggtgggagtctaggaatctgtgtttttacaaagccctccacatacttctgattcatgataaagtttcagtaccactagcttcataccatccttttataattttatgagtttaaatgctcagggctgctgagataacatacccttgggtcctgagtgtatacaaggtaagaagcagctggcagcctccttgaaggcccagcatagacaaccttactggcctcccttttaatatacagataggtaagaaagcagaagaggaaccaatatttgctctgctaggcactgtgcctatctttcccacagttcccttgcatttagccctcatgccaatcatatgcttgtcatagtgtgctccttatatgttttgggtacttcatcattttctagttgtaatctcagtcttgagagcaggctcagacgtttgcttcgattctttcactggcaatcacggagacttgacattgtttcatttaggggactgtacatttcctcatggggcatgcagtttgtgttggagatacagaaagcttcatcttgaacttggtgcttcttcctggaacagtaattttatttcaggtttgtgggagaggaagaggagggaccttgttttttttttgcaaaccatgacattccctgtacgtaccatgtacctggtgcatgataaataactgttaaatagatttctatactattaacagaaagcttgtattgtgtccggaattggttccttcaggtggtttcttggtctcactgacttcaagaatgaagccatagaccctcacggtgagtgttacagttcttaaagatggtgtgtccggagtttgttccttcagatgttcagatgagtccttagtttcttccttccagtgggttcatggcctcgctgacttgaggagtgaatctgcagacctttgcagtgttacaggtcatgaaggtagtgcagacccaaagactgagcagcagcaagatttattgtgaagagcgaaagaacaaagcttccacagcatggaagggaacccaagcgggttgcctctgctggctctggtggccagattttattcccttatttggccccgcccacgtcctgctgattggtccattttacagagtgctgattggcccattttacagagagctgattgatccattttacagagtgctgattggtgtgttattacagagtgctgattggtgcatttacaaacctttagctagacacagagtgctgactggtgtgtttacaaacctttagacacagagcgctgattggtgcgtttttacagagtgctgattggcgcgcttacaaacctttagctagacacagagtgctaattggtgtgtttacaatcctttaactagacagaaaagttctccaagtccgcacccgacccagaagctcagccggcttcacctctcagtatcatctcccagatagcttgtgcccacccttcagacttctttgtttaaggcagttattctcaaaatgtcccttgaccagaaacagcatcacttggaaacttggtagaagtacacattctcaagttccaccccaaacctcttgaatcagaaattctgagggtagggcccaggaatttatgtttcaacaagtcttgcaggtgattttgatttatgctagcatttgagaaccactggctttacgcatgagaagtaggattttaaaattgtactttttattataattttctgggaaagtaaagctgtttcacctgtaaactttgggaataggagcaccctgaagctcacaatggcatcctgcaaagccccaaagagtgctagttgttgatcattacctgtgcacacatcattccctcactcagagcccagctaggaggcctcctttcaccttgtaaccaggtcacccctagatgtgatcacttcctccacaagaactgagagagaagagaagaacaccagaggatactgaactggccatactggggcttatggtttaaagggcagaactgagccaaatgaggactcctcagaaaattgctttctcgttggatcaccccagaaataaatcagtaaaagcattcaccttttgttttatttgcttcaaacaaagtaggaaacattcttcttgctttatatatctagataccaagtaaggaagtatgatttggattcttgagtctctttattttatttttcaactgtgtgtgtgtgtgtgtgtgtgtttgcctttgctaagccatggagggtaaaaaatgaaatatattagcaacattgttgacatggaccacagacaattaaatgtttcatttcttattaatcctgaaagaaaaagccttttttttttgttgggcggcagggagggggtgcagtcctctatacaaaaatcttaaaaactaaatatatctattctaattgttttcccctggaacatcatcatagtttaggagtatatctcaatgttgattttaaaaaataaatatgtaaacagctagatttatgcactgttaaagcatcagtgcaagttttaggaaaaaatcaagcatgacaattgaaaataaaataaccattactaagttggactcttctttaccctcaagaaattgtacttggatgtttatgggagaaattattccaaatcctaccagttctgtcagaaaactaatattactctacataatcattttctcccacctctgtataatatttaacttttatttgaaatgtaggctcaagctatgctaaaaatcccatctcgaagatgacgagcttatccatggggaggggatggagggcagagcactctcataactctaggaatttgactgttatatcttgacttaataaatgtctgcagctgaaaataggaaaaattgactatatgcatgtttgaacacatagacataaaaaatgccagctgaagcagagtattccgcatgcaagccaagaaaaatcgggttcagtgaggcacagtttggcagggaaggcacactgaagctgcagggatgggaggtctagtaactggggaggtattcagttgagggctggtgccctccacgtagccttccccgacccacccaccctgggtctgcttccctctgcccccagtgtgggctcccgtagcacagctgggtattagcttggtaatggggaaaggatggtattcaactgggaatctttggcttctaggaacaaaacaaacttggggaggatgttatcaggatactgaagtcctccccaaaatccaggatcttcagagaaaacctaagaatcaaaaatagaaaagcacaggaagttgaaggactctgtctctgtgtgttgtccctgcttctctcagctccatcctcacctttctgcactccagctctgttgtgtcgtccacagcatgcaacacacagatccagctccatctggagcccgcctgtcagctcctcagccccaattttaaaaccctaggggagaagcatcttctcagcataggtctcacatctttatgtggtccagtgagccatggtgggggaggtaggtgggtgcagggaggcagtatgggaggtccacctctgaccctgtggcccagtcagaagaccccaaagagaggagtagcttgcatagatggaacaaaagcattctccctatgttattccgttcacatgttgctgtgggttcattaaccccacacttagaaagtaatcatctttggctctaagaaaatctggaggttggacctgaaaaacctcaggccagacagtgaatcagtcctggattgtgctgaattttctaatatgactccaccccatgaggcttcatgactgtcagcatctgctgtctccagtgatgctgtgtccgaaattggtgggttcttggtctcacagacttcaagaatgaagccacagacccttgcggtgagtgttacagttcttaaagatggtgtgtccgaagtttgttccttctgatgttcgtacgtgttcagagtttcttcattctggtaggttcgtggtctcactggcttcaggagtgaagctgcagaccttcgcggtgagtgtaacagctcttaaggcggcgcgtctggagttgttcgttcctccggtctggagttgttcattcctcccggtgggttcgtggtctcgctggcctcaggagtgaagctgcagaccttcctggtgttacagctcataaaggcagcgcggacccgaagagtgagcagcagcaagatttattgcaaagagtgaaagaacaaagcttccacactgtgggaggggacctgagcaggttgccactgctggctcaggcatctgcttttattctcttatctggccccacccacatcctgttgattggtcaattttacagagagctgattggtccattttgacagggtgctgattggtgcatttacaatccctgagctagacgcaaaagttctccaagtccccactagatcagctagacacagagcactgactggtgcatttgcaaaccttgagctagacacagagtgctgattggtgtatttacaatcccttagctagacataaaggttctccaagtgcccactagactcaggagtccagctggcttcacctagtggatcccgcactggggccgcaggcggagctgcctgccagtcccgcgctgtgcgcccgcactcctgagcccttgggtagtcaatgggattgggcgccgcggagcagggggcggtgctcgttggggaggcttgggctgcgctggagcccacggcatctgggggaggctccggcatggtgggctgcaggtcccgagccttgccccacggggaggcagctgaggcctggtgagaattggagcgcagcgctggcaggctgacactgctagggaacccagcgcaccctccgcagctgctggctggagtgctaagcccctcactgcccaggggccggccgctccaagtgtggggcccgccgagcccacacctacccagaactcctggcctacccagaactcctggcccgcgagcgttgtgtgcagccccagttcccacccacggctttccctccacatctccccgcaagcagagggagccggctccggcctcggccagcccagagaggggctcccacagtgcagcggcgggctgaagggctcctcaagcacggccagagggggcgccgagagcaggcaagggctgacagcacgttgtcacctctcaatgcctatcttaaacagaccctttacatggcattggtggcaagtgagactggaaattctttgtgaaatgcttgcatgatacaagagccttctcgtaaatctgttttaaaagtgtcctttattctgaataccattttgatccgtgatccactgatggaagtcaatgatgttgaactaagaaaatacataggttactagctatgaaccattcttcattagtgcacttgcttggtaatgggttaatttgaattgggaatgaatcttagtccacaaactagaggtgcagagaatattgcagtttgctaaatagacttaatcttgactttaagcttctactgctttcaggtagcagaaagattcacctcgattattcttggatttctttcccatatcaccctcccagagttgtgccaaggttccaggctttactaatgtcatgatgtcaggaaggcctgagaagttatccgtttacaccagtccctactgcttctgggctgcatttgaggctagggagggtgctttgtcagcatccagccatcctcctggggttgctgcacacctcagggtgcagccagagtgcaggtatggccatctgccactcagagtttcacagtcattcacttccaagatctcccttaagtgtgagagatcttgctatcttctcacctgcttttctcctcaagaaggtaagccagagccctcgacccttgtgaatgaggaaatttcagagagaaaaacattggaactccccctgccccagagttggtaactgctcaaatgctggctgccgccaggtggtgcaagaggcgctgcttctctgtggtcacctagcagcagtctcctgtggccagttccccacgtagaggtggcaactgcccttcttcatggctacttgctggaggtttgtgggaggaggggagtatggggggtgtgtgtggctttacctgccccaaattgtcaggaggatttgaggcatttctttgttgttgttgttgtttggctgtttccaaaacccatttggaaacctgttattccgtaagagtagccttcaaattcttaagcattttctataaatcttcagtgaactaataaaagtatttccttttcccttttctggcaatgggtagtctagttctgttaatattcctgcaaagaaactcatctaccagcctcactcacactgtgcacttttgccctcagaatcctcagtggctagcctaattgactacaaccagtttagatgatcagctaccttccttttgccattatttcagatgctgccttgcccatagcacaaccaatgcatttaaaaaataaaaacatttggggtgggagaactatgattaaataaaggagatctctgtagagtatggcaaagcttgcacacaactttaataaaaatatgctgtcttgagtaaccagcatattacagaggctctgtgaatgcctcttcatctagaatttcagtacaagctgtacataaaatatttatacagcacagtgtgctttgcccctcacaaaagcgtgggttcagatgtacactgttactatagacgtcactaacatataagccggtgaagaacctttaatgtatttgtaatgttagcaaagtatctgtcatcagattaaacttgtagtgactgataatgtagccttggctcctagccaaaaatattttttttgatatcagaatgacacttaatagtaaagatatgtcatagaggaaggggaagaagagaatttactagagaaacttaaaagactggttggtgcagaacctagtaacttggtttgtggctggcagaaatgggagtagtccctgggattacttctaaggaggaaattttactacaaacacagctgggaataattctgttaccaagtcttttttaggatcaatacagagcttatttgtaaaaattaaaatctaactatcactttattgtctatgggtatctgttacattttatctgtaaaagaggaatggaaatgcctgcctagtaggttcatcataaggactgagaggatacgggaccttattaagtcctcagtaagtagcagcaattttgcttttgtttttatgatgattacttccactcatgactttacctgcatgttctttaatcttcaaaatagattagtgaagtagtgatgtttccattttagaaataaaatacgctggggaaacgaattgtaatacacatgacaaagcttaatattagtatccttctatgaaggatccctcagtatccttatataaagatcctttatggctctaatatgcttcagttgattttgttccttgtaggcaaaagtttcaataaatatactgttttctctccattatcaaggatatatggattaatattaatatataaatatataaatccattatatagtaatatatattaacatatacttcctttattaatatcctggatatatgaaattaatatcttggatatatgaaaaggtattccagatcaataagatgaacacagtagtagaaaaatagagaacatgaacaagagtgtaaaaaggtgcgaagtgttcaaccccaaagatatgctaatcaaaatttaaaaattaaatctatacaatacaatttaaaaaataacattacccattgttagagggggtgtggaggagtgggtattgtcatgtgccactgggtcaaacattgtgtagggcaaattaacaatatcagatcctcacattttctgtacatttgaccttgaccttatcccaggcaaatacttgatggtatagtgaaggatatctttctcagcattacatatataatcaaaaataagaggtgacttaagtgcttcaagggaatttattaaaatggattattgatcagtcattaaaaatgaaagcatacaagactattaaatggtacagaatttctatcagaataagtgggaaaaacaagttacaagtaatatcatatgatttacttttagtgaaacttacatgcacttacacatttgtgtattatgtttatgtgtcatgcatacatataaaagtggaaggcggttcaacaaagtgctaattatcctcatgatttttattttttctttgatttttatgaacttacagtaaagaacaaagtactactttgaaggaagaaaaattattttttaataattcagcataaattacataggttatccaaagatagtaatatggtatttgatctgaacctagacttctgttctgttgatttgacacattttggtgtctttccttttatgttaaataagtaactatcatttacctacagcagaagaagaatataacttagcatttgagacttgataacatagagctgttgaatagttctgtaagatttgttagggaaccaaaaccaggcatgtgaggatggtgctggaagagaaaaggcgggaagggtttgcagtcaactgtcagttatcttcagctttcaggctcgctgcacatggacaggtgaggaccaagggaagaagagcaagcttgggtatttggttgagctgttaagttcagggttagaaaatgaccagcacaaaccttttggcttgagagccaaagttcttggcaggaagtctctgcttgtttccgtttgccttcctcccagtttctcctcaatgccttgcagtcagcatcctgtatctgccattttgaaaactgcccttaggggtcatgagtgacccccttccttattgttaaacccagtgacattttgtccttatctgcagcatttgatgtgttactcaactctctttgggcttgtgtgcctctccacccttgtggttattctcctgcctctgtaaccactcagtgtcttcttccatgtcccttgacccttcactgtgtcttctactgattccccttagaactttcatttacccctggagcttcaaccatcatcttcaggtaaaactctagcaacaagtcatctttgcccgctgtgcatcatccttgctgccattgagagtttggtcttaaaatggtacttgcaattagaacacgttcactttgtcacaaaatctgacagacattggacatacttagaattcatatctggcttcctgagacagctgtcagattgtctaccaatggtctacccattgatgatggaacaagctccttgtatcagcctcaaataaaaatgatggaattaataaaagacgcttaccttaaggcacaaaggcctatgaatttcaaaaagcattgacagaaccgatccaaaaaatatgtagtttgtaaaaactctaatacaatccacactgaagtaaaaagcttaacttagaataatccaaatagtctttgtcagctggacagctaatcttggtgaacatggaagagtagacaataatgttaaggcattgtgtgagggttaaattgtttgcgaggtcggcattgctggggcttcggattcaaactgggccttgaaagagggggtaagaaaagtctatggggaactgatgggcacaaaggcagggtgtaagtgtttgttcttgggaaaatgatcagactaatctgattgaatagaagacgtttattggaaattaaaggaagataaagtagtgatagataatggaagaactgaaggtcaacaggggagtttatatgtgatggaagagaaaatcattatcactagggatgtagatgtaagaaaacgttaggtttggaagttataagacaagagaacttcaaagtttgtgggattctgtaaggtgggatgggaataagcaatattgttgagtacctgctgtgtgatctgtaaggcataagatgtcattattattttacagcaagctttggagtagatgtactagttcccattttatgcatagtgagatggaattttgagcagacatacttgtctaagtttggcagagtggctggaccaggattcatgcccagtgacatctgacttcaaagcacagtgaggatggagaatgttgagaccagttcttcattttacagtcaaggggatgggcccaggcctattcaaggttacaggaataggatgaaagcaatttctctgtaagagagagtggataggctgtgatctgcagagggtccaagttagaggctcttgttataaacagatgaggtatgccaaggaagttgggttcagcagtgtgataggagtgaaaaagaaggggtagagagcagctggacattcggggaaagtggtggtgactgttagtggaaggtaatgacgagagagatgacttgaaaacagttccgaggttttagtcccagggaactgccattaacagttttaggagaaaagccatgtgtgtgttatggagtggtctgagtaagtatgatagacattaaaaaatacataaaaatagagtggtatgcatgtgctgaattatgtttgtactaccaaacacacggaggaggagaacagaacagaaggtggaaagctatgagggatccagcgcttttctttgcagtggtggagagtcacgagagcaaatagctagcctttacctaaagcaaaagggactctttgcatgatatcttaggctcccttttattctggcctgcccctgcacccccagcaggaaagtggcttaactgtactttgatttccaaaatgcgtagcagtctctagtattgattcccctctcctgcagatctcaagcctaaaaatgagtattgttccattacatttccctcaaaaacatttctttttcctttcagaatgatggtcactatactggatggacttctgaactagtgaattactttcatcttttgatcacactaggaaattgtccacggagttgaaatatttattgcagtaatttctggccttacataattaagataacatatcgtttttttctttataactatcatgaagttgtcatgtttgtttcctttaactttgctttttagaggtacgaatctgttccctagtcttttatgctccaatgatctgttcagactgctcttgatctacaaatgtatgattgagaaaagacttttataggatgaaatatgagcaagctgttttactctgaagaataaaagtgaattgtattactctgcagattaagtcaataaataccccattttcataaacacaatatgcacagactagataatactagggaaacttgatacatcaaaaggagtattaagactgaaaaaaatggagatactcaatttattgcaggctttattcaataaacctagaaaatagagagtttaaatcaaaatctgttactctgtttctagagataatcaatgttaaaattgtactatattattttccaagtttttagaatatgtgcatgtgttgttgtgttagctttctctatttttgcaacttgagtaacatttattacatgcttgtgctgtgccaagctaaataccaagcattttatatatattaatttattctcataacccttggtacttttattatcctcatttacacacaggacaattgaagctcagagaaattagccaggcacagtggctcactcctgtaatgccagcactttaggaggccaaggcaggcagatcacttgaggtcagaagtttgagaccagcctggccaacatggcgaaaccccgtctctaataaaaatacaaaaattagctgggcgtggtggcacatgcctgtaatcccagctactagagaggctgaggcaggagaattgcttgaacctgggaggcagaggttgcattgtgctgagattgcaccattgcactctagcctgggtgacagagctagacttggtctcaagaaaaaaaaaaagaaagaaagaaagaaatgacttgcccatgttcacatagctggtaaacccacactggttcagaacttaaaccagtgagataccaaagcccatatcagtgggcttttttacatacttcttttccttaataaaatgcttatttcttttttctacagcatcattttaaatgacagcatagtattcagttatatggaaatgtaatggtttctctatcccatctccttttattagacatttatattgtttcttgttatttacttttagaaataacattgcagtgaacatctgtcatgcacatctatgattatttccttaggataaattgccagaagtggcattgctgaacaatgatagaatgtagcactcaggtgttgatgtattctgttaatttactctgttgatgtactgttttctcgaaaggccacaccagtttataatctcagtagcagtatattgaagtacctggtaactttcagctctcagcaacattggtagttagcaatttgaaaaaaaaaagtgtttgtttttaaaaaacattctaggtattcctttttaagtccatattatctcttgcctctaatgctgtagtagtcatgatctccttactggtttatttctatctagcacccactttgccactaacagaatcggatagggcacggactgtagagttagatgcctgggttcaaatcatgactgtgctgtgcctcaatttccccgtaagtaaaatgaaaatagtaataaaagccctctggtaaagtactttagaacagtgcctgacttttggtatgtgttcagtaattgttggcctactagtattgtcttccagaagtccctgcttatatgattaaaaaaacccaaggttatacttgtttttgaattgtaattattaccaaatcagtaaatcacagtagaaactaaagtgctgaccttgaagcattgttagtgttaacactgtgaccaacctgaagatcacaaattaccttccgtgactcagttgatgctgagaggtcagggatagagtaataacaggaataactagaatgttaaagtgctttatattaagctgccagtgcacttccacacacattatctcattcgatcctcacaacacagctgtgaaggagatggagcgggtattattaatctcatcttacagaggaggaaattgacttggaggattaagtggcttgctcactgatggttgtggaaatggtcagtggcagagctgaatgtgtactctgggccttctgactgtaaatacttactcttgatgcttcataacatcatgataagctaaggaggtgcaggtgtagatgcccaggtctggagatttgctggaaaagaaggagcaaaagaggatgccactgggaggagggagcagagttggggtaaggaaacttagatatactaaaagagagggaggtacccagcggggagagaggtggggaaggagtcataaagaaagggaaaaacagggggccaggacttccgtgactacagggctggctgaatagatcagggtggagggcttcatctttgagactgaaggaatgcgtcccctgagccaggaaggagggaggagatggagcaagtagacacaggtgatttgaaatagaaaggaacattaagagggctgaaggattgtggcctgaatgaagaaagaaggaagtatttatttctggagagtaaaagtggtaggtttggggttttagatttgagaaagggaaaccatttagagtatctgtgtgggaaatgggccaaggaattagaaatgcctgccagagacctctgcaggatgcaggaaggacccagataaaaacgtctgggctccaagtcgacagattctgtgaaccccttaggcatgctgaggatttccttgccagatgatgtaactatctgaggatgtttctttgtgagctcagtgctagacaggcacaggagcagtattaggatggaaacatttcttaattgcttgaggagtgaggaaaaaaacggcactctgcaataaccctcttgtttccaaataccaaagcagctgttgggctgtgctcctgtctaggtaccttttcctcaggagttaagtgccacatgatgatatttatggttgctttttagggggtacatggttttttaattagtgaagaccgagtagcaatagttttgttttgtgttctaatagcctttgttattatagtcagggaggtgaagtgaggagatgatagatgctttcctaatctgtgaaatgaggagttggactaggcaggtgctccccaaagtccctttctaacattaccattttctcatccaactccagtctacgctgcctcctctccatttcctcctttaccagacagtttagtgtgtctcaagttatattttatggtgctttagatatatatatgtatatttttgcttagagacttcatgcattattattagagacttcatgcagtatgtagtgactgtagaaaaatgaaagatgtatcgataaataaaagacctgttaaaaatatgtaactttaccaccattaaataaccactgtttatattcttccggagatttttttttttaggtgtgtatgcctaaataagattcttaaatacagaaatgcaccctgcttttctcagttgaaaattataaacctctctgcttatcagtagtcactgctgtgtaattattaaaggttgatgaagactctgtttcaggaatgtattttaacaaatctcactttggacatatgcattaatgtacattcttctaactgtatttgtgaggctgctctgaattattttcttataaaattaggaaagaggtttaatatataatacacattgcctggaagactgaaccgatttacagttccatcaccagtatgcgagaggtctcttttcccacacccttaacattggatagtggagtttaaaacaaacaaacaaaaaaaccttaccagttttatagacagatgaacatcttttcatatgccatttatattcctttgtgagttttctgttcatatcctttgcccatttctccagaggggtatttgctatttttgttactgacttgcagcaacgagattttaaagatttaaaatttttaaatgtcttttattataaaagtatgttagttgttttgataatttctttgaatttttatactgcttttaaatgtatataaatatttaattttaggttgtcaaatctttttctttatggtttccatataggctaactaggaagtaagaatgccttggtatttgttgcccattgtcagttctttacatagcagagtaatctctttcaagtgtgatcacatcttggcatacccctgcctgagctcgtcatggcattcttgttatcatggcctgcagggcctggcacgatcttgcttttcctgctgtaaagccccacctcttgtcactcacccttgaacactatgttccagccccactggtctcttctcagtccagggaatatgccaacctccttcctgtccctgaaattctgcaggtgcagtttctttgcttgggaaatgtgtgcacacgcgcacacacacacactcttttgagcacttgtcaatatgcaattatttatttatttttgagatgcagtctcgcctaggctggagttctgtggtgcgatcttggctcactctgcaacctctgcctcctgggttcaagtgattctcctgcctcagcctagcaagtagctgggattacaggtgcccactacgacgcccagctaatttttgtatttttagtagagtcggggtttcaccgtgttagccaggctgatctcaaactcctgacctcaggtgatccacccacctcagcctctgaaaatgctgggattacaggagtgagccactgtgcccagccacaattatcatttcttattaacttactcttttcctgtttccccctccagcctgtaacaccataggggcagggaccttgtctgtgttgaccacagcgaggtctctagtgcttaacatgtggtatttgtaggagatcggtcagggtggtggaagaaattgtaggaaaagatgcaaaccttcttggaagaggttttgcaaaagcttcaaaaaagggtttggctgaaggcagccaaattctcttacctggagcctgagagcaaaggttagataataaggggatgtaaaggaattgatctagataagttagtttacttaggcctcagaacctggcctttaatcatctgtgcgcaggactgctctttcccagggagcagcgggaagccgggggagggggaaccatgttaattacccacaagtgtgttgactcaaagactttgtcattacatccatactgaataaatgcccgcagcactggcttgtcagggccacagctgctatgactctttctttctgtgagcaccccgatcccctagtccgctctttcactggatacctgtgtctaagtacgttttttcatccatcgctcagccagaatctgccggtcagacctggcaagtatttatagaagaaatgaatcaatattacatctctaaccacaagattgcacaggcatttaactatatttaccttattgtagttttatggtttcatctcacattttaaaatattttatctgtatgaaacttagtttgaaatgtgacttgagataggaattaaaattaatttctttcccaaatgaatagccacctgcaatttttgtagttcttgtttattagagagtccttactcaaagtatagtccttaagcactattatattgttttttctttcttctgtttgcttttctctccttgggtagtcctttgtgcaaaacgtaaatgcagaaactgctcattgacttgagccaaattgctcatgagcatgctggttcaataccaagaaagatgatcttggcgtcacccaccatagcctaccttctaagaagaaagaagacatcatgtgactgacttagggagttgtactatttgttcaatatctaatgctagtagacaatcttgttttagataattctggccgccagtttttttaaactgttggaacctggaaatttgaacattccagtgactacctttcctaactgcctcttatctctagatgtggaataaaaatcctttggcagaccatgtgttccagtttttggtttggaaaatatggattattattcttttccttattttaactctgaaaattaaaattaatgacaaaagtcagatgtgcccattctcacatattcaaacaataaaacatacagacaaaaaaaggattcttgtatcccactttttgatcctattcctaatataaccactgctgagtttattgtatatactttcagacattttttatgcttagtggatatattagatctttatacattccccccccccatatacttgcatttttttttttgactaatgtcataaactttgttatacacctcagtgggatttaaaaacacctgaagcctttgttttttggctggtggcaaaaaaaccagagtaacttagagaagttacccattgatgttttcacagggctttaaacacgaagacctgatttgtttgtgtaaatcgttggatgtaatcttacagaggaccagggcttgagcaccttcagaaacatggtatcatctgatcatgatgatttccatcccacgacagaggaagaaatggagactccaaagggacagaagtgaattcttccaaatttatgaaaatgaacacttagctaaaatgtgttcactgggttatgacaagtaactggacttctagggaatgggatggcaggtggggtgctatcagtttataaaattttttgtaaccttgtctcttatttctgcttccctcccccagccatgggaacacaagataaatttggagtaggtgagggtggagagcaaagtgactccctgggctgtgcccttcacactggttttagaaagcatgcagctgactgccctggggtctgatctatggtgctgcgctcgagagaactgtaaggtctgctgtaagtgatgggggctgtggacttatgcagaagtgcacttgttgggggttttcacagtacccaccttattatactagagaggcaggtttcattgcttaaggggacaatttatggcaataggcttatctccttgttttagctctttatgtttttctgcctttaataaaatgtgaagtcacaaagcaattaaatagtagtgtagttttcaggcaggaggtggagaaaggctaactagggggaaaaggccaacatgattgacagaggctggctggagatttacattgagaataactcgttcttcaaaactttcttcattttctggtgagaattagggacaaatcatataccagaaggatggatgattaaaaatgtaggagttatgatttctttttgactttgtaagtctctaaatcctccaccttaacatagagttctcatttcaaaatgggaaccagccctgccagagactaaagtgagccagaaatactctaaagtcttaaatagttaataagtgtgagattgtttatattttgtaaaatgtcttaagatacaatgaaatggagaatccctgagtgtttttttgatttcctaaactctgatccacaattatagatgtgtctgaaggttcaaaaatattgaacgtgatttcagttgtttctagaatttaaaaaaattaataatttttaataatgacactttaaatgaggagaaggcttttaaaaccaaatataaaaatctggagagttcagattccctgtctctcctctttcaacctttaatgtataaaacaaatccttttgattcagccactgtgtattgataatggcttatttattacaatcagaggaattaaacaaagatatgtagatactttgtcatcttttcttattatagaaacagtttgattttaagaatttttattcagaacgcagattcgaaaagaaaaaaaagaatttttagaaaagttgccttttaatttaaatttcttgttttgtcctaataatcacattgaaatagccaaaacaaataatataaattaaaatgcaacgatggcccggcatggtggcacatgactgtagtcccagctactcaggaagctaaggccagcagattgcttgagcccaggagttcaagaccagttggggcaacatggtgagaccctgtctctacttttaaaatgtggtgattggtacctgttgagagaagggttaactgaaagttattcacatggcccagaaagtggctgaaaagtgctctttctggtgtgaatttctcttgctgtgaaagcactctgaaggggagacctaatgccattgcaggagcacttcagctccaaacttgagcgttgcaatcagaacaagaacccgaggaaaagcctgcaaaatgagcctgctgcgatatagggtgtgcttttggacagttatacataagaatttttttcttttttcttttttcttttgtttgagacagtgtctcactctgttgcccaggctagagagcagtggcgtgatcattgcttactgaagcctcaaattcctgggctcaagcagtcctcccacctcagtctcctgagtagctgggactgcaggaatgcaccaccacatctggctaatttattttttgtagaggtgaagtcttgctttgttgcccaggttggtctcaaactcctggactcaggtgatcctcctgcatggacctcccaaagtgctgggattataggcatgagccactgtgcccagcctcatgagaagatttatgatgatagatagaagaattattaatttccacagtttgacaaatgataacaaatagcttttacagtttgagcatcccctatcccaaacgcttgggactagaagtatttcggactttggacttttttgaatttgggaatatttgcatatacataatgaaattccttggggatgagacacaagtctaaataacaagttcgtttatgtttcatatacaccttatatacaaagactgaaggtaactttatacaatatttttaataattttgtgcatgaaataaagttttgaccgcattttggctgtaacctgtcacatgaggtcaggtgtgaaatttccacttttggtgtcatgtcagcattcaaaaagtgttggattttggagcatttctatttcagatttttggattaaggacgttcaacttgtatgccaaattagtaaatattttttgagttcctacccacatccctgtgtatgggctctagaagcagccatggtttagtttcctcacctgtaagggagggtgtagaacttcttttaatgtacatcactgtaggttaagttcgggtagagaaaagactaaaggcaaccaaggctggctgtcctctgagcccctatgctaagctgaactaggcttttgtttctggcaatggatcattttgctgtcacggagccagtgattatttaccacccctggttttgagtaggtttccttttcccctggcaatagctcttagagtgtttcacagagaggcaacgggattcagaagatgcccgtttacactggtaccactgtctcgttatgtcatggtaaagtaatgaagtccaccatcattactttaccagttccccattggtgttttggtcttccctatacattttttttaacttttatttatttttaatgagatgaaattcacataatataacaataggcagtttaataattgacaattcagatgtatttagtacattcataatattgtgtagctgccacctctctctagttccaaaacatttttgtcactacaaaagaaaaccccgtacccagtaatcagtaacacactattctctcctctctctcatccctgacaatcattaatctgctttcagtctctatgaatttacaattctagataccacatgtaaaataaatgttctcatacaatatgtgaccttttgtgtctggcttctttcacttagtatattcatccatgttgtaatgtcttagccattttatggctgaatagtccatggtacggatatatcataatttgtttatccattcatctgttgatagatttttgattttttccccaccttttaattcttatgaataaggctgctatgaacatgggtgtgtaagtacttgagtccctgttttcagttcttttaggttcatacttagaggtgtaattgctgggttatatggcaagtctgtgtaacctttttgcaaaactgttttccacagggccaaaccatttctagtcccaccaacaatgtacaaggttccaatttttccatatccttgcaaacatttattttccctttttaaaaaaattatagtcgtccttgtgggtataaagtagtattttattatggttttgatttatattttcctaatgattaatggtatttatctttccatgtacacattggccatttgtatatcttctttggagacatgtctgttgaagtcctttgcccatttaaaaattgttatttgttgttgacttgtaagagtgctttatatattctggatactagacccttaatagatatgtgatttgcacatagtttttctcatttttaaggttttctttttttttaatttttatttatttttttttagacagagtcttgctctgttgcccaggctggagtacagtggcaagatcttggctcactgcaacctctgtctcctgggttcaagtgattctcctgcctcagcctcctgggtagctgggattacaggcatgcatcaccacgcctggctaatttttttgtatttttagtagagatggggtttcaccgtgttggccaggctatcttgaactcttgacctcaggtgatccacccgcctcagcctcccaaaatgctgggattacaggtgtgagccaccacccctggcctccctatgttttcttctaagaagttatgcttttattttttatacttaggttgttaattcattttgagttaatttttcatatggtatggggtaggggcccaactttattcttttgtatgtagatatctagttttcccagcaccacttgctgaagagacagtatttccccatttgaatggtctttgtacccttgttaaaaatctattggccatatatgtgagattttatttctggactcttttttctattggtccatatatttatccctatactagtactacaccgtttttgattactgtagctttgtagtaagttttgaaattgagaagtgagagttcttcaacttttttcttttttttagtgttgttttggctatttggatccctttcagcttcatacgaatttaaggatctgttttttcatttctgcaaaaagggctgttggagttttgataaggagtacattgaatctgcagattatttggagtaatattgtcatcttaacaatattaagacttccaatccatgaatataggatgtatttccatttatttaggtcttattcttcagcagtgtcttgtaatttccagtgtgtaagtcttttgcctcctgtgttaaatttgttcctaggtttttttgttttgttttgttggttttcttttttttttttttttttttttttttttttgagacagtctcattctgttgcccaggctggagtgcggtggcacgacctcggctcactgcaacctcctcctcctgggttcaagcgattctcatgcctcagcctcctgagtagctgagattacaggcgcacaccactacgcccagctaattttttgtatttttaatagagatagagtcttgacgtgttggccagactggtctcggactcctgacctcaggtgatccgccctcctccatctcccaaagtgctagaattacgggcatgagccaccatgcccggccatccctaggtattttattctttatatgcaattataaatataattgttttcttaatttactttatgaatgatttgtatttattattattatttttttttttttttgagacggagtttcgcttttgtcacccaggctggagtgcaatggtgcgatcttggctcaccacagcctccacctcccagggtcaagcaattctcctgcctcagcctcctgagtagctgggattacaggcacacaccaccatgcttgactaattttttattgttagtagagacggggtttttccatgttggtcaggctggtcttgaactcctgacctcaggtgatctgcccatcccagcctcccaaagtgctgggattatagttgtgagccaccacacccggcaagaaatattatttttattttttaaaaaataatctctagtggttattttaaaattcaaggtaagaaccccactattcctccaaatattctgtagagtggtctctgttaagtttgatatacatccttctacatgttttccatgcatttatatacaaacatactttcttactgtgaataaagtcatatactttgtctaaattttaacttactattttacataattatagattgtgtctttctctgctagtttacttatttctcttaaatgctgcagagtaacccatcatactgatatgctacgtagctgacccttgaacatcatgggtccacttatatgcaggtccacgtgcaggtctgcttttatgcagatattttcaacccaacatggattgaaaatagagtacttgagggatgcaaaacttgcataaagagagaattgacttttcatatacgcaggttcttcagggctggctacagaacttcagtatgtgaggatttgggtatttgcaggcagtcatggaaccagtcctccttgtatatcgagggatgactgtactttgtttaaggctttattttaatgatcatttagtgtggtgttggtgttttatagtataaataatgcaacagttaacaattttatacccacatcaacgtatgtccatgtaagtctttaaggtaataagaattgctgaggcaaaaaaaattaccttaaatttttttaaagttttgtgttaggcataacacataatttactatcttaactgtttttttaattgcacaattcagtaatgttgtttacattcacattattgcgcaaccagtctctaaaactctttttcatctttcaaaacaaaagcgctatatctgttatacaacaactccccacccccctcttcccctggcagccattctactttctgtctctgtaattttgactattctaggtacctcataagtggaatcacacgctgtctgtctttttgtggctggcttattttacccagtgtaatgtcctcaagggtcatctatgttgtaacatgtgtccaaatttcattcctttctaaggctgaataatattccattgtagcatcacattgagtaattaaatgcttggaaagaaagaagaaaaagaagggtatgtctgactcttttcattcccatacaatgtggtaacatacgtaataatctaaatagaatataaataaataaaatgaagtccttttaggtatgtgtatgagctatataaacaggtatttttaaatgcattgtggatccaacttcatattagtaggtgaggaaacaactagtagcacataaatgcttcttgggcttcttgcacacttgccctccatacacctcacctcatgcccaacataactttcattatccctccacccattgctggcagtcatttttaaatagctttggattttatgccaaaagatcttctacttgttgacagattctgtgaatacccagtgttcgcttcttttgcactttccaagaaagatgagtttgggaatttgctaacatgttctaaagttaaagctttttgttctgggataactgaaaagtttagttatccaaaaggcagcccaccttcatttttcaggagggtcactgtgatgttctgtctttctgagtctcatgtctcatacctttctgtgctctgtcataattaactaaagcagaaggagggagatccttttgtaaaatgcccaaagaaaagaaagccagatggaagtgaggagtaagagtaaccacagttgctttcctcttccatcagtctttaaaaactttttattttgaaataatgttagatttagagaaatgttgcaaaggtagtacggggctcccatacccttcactcagtttctcctaatgttgttatcttacataaccatattgaactatcgttaatataattatcaaaattgggaatctaaattggtctaatacttccagctaaacaacagaccttactagcattctatccagttttccgctatcctttctttatgttccatgatccaatccaagatccacattgtattgagtagttctgactctttaaactcccacagtttgtgacagttccttgtcattccctgtcagttatttctggttagttattttgtggaatgactagatttggggctgtctgatgtttcctagtgtttacctttaagttatgcttttttttgttttgaaagaagaccacaaaagcaatgatgtatcttttttattgcctcataactggttacttgatgtcagtttcccttattgctagtgctattcgtgtggactcatcatggacagttacttcattctgtgggttataacccaatattatcatcattattttcttcttcaaattattctagctttggccactgggagctccttcaggctgactctgatgtccttttgacatgcttccatcttttttcaagtacttcctcacattatggcatcccctgatgctctaggctaatcttgtattttccttgccctacttttggaatcagtcacttccctaaggagcctgggtccttttactggacaatggtgtttagaaaccaatatctgagtaccagacgtgcacattgcaactggggtggctttttgtcttccatgagttttatggtgagctctttcctgtgaacatggttgtaccaggtctgaaactcgtttttaacacttctaggtagtcagtcactttgatgtaaagtcattttgatcacttaatgttgagttgttaaaatcaatgcacataccctgtagaaaaataggttctttatcaatggaatagattaactttttgtggaaaaatacttttacattgataggatagcattagcatccagacatttttgacattccttcaataactattcctgagtttctgactctcatttttagcccattccatttttatttattttattttattttattttttgagacggagtctcgctctgttgccaggctggtgtgcagtggtgtggtcttggctcactgcaacctcccgctcctgggttcaagcgactctcctgcctcagcctcccaagtagctgggactacaggcatgcaccaccatgcccagctaatttttgtatttttagtagagatgtggtttcaccatgttggccaggatggtctcaatctcttgacctcatgatccgcctgcctcagcctcccaaagtgctgggattataggtgtgagctgttgcacccggcccccattccatattttaatgagaatatcttttggttagttatagaggtaaatacctggatttacaatgtgtaactacagattcatcatcctataataaagtaactctttttgcataaacttttgataagttatttttgtccttataattttatgtgtgaagtctttacggtcagaggacattgacaaaatattttagattgaaagcctgttctccttgatgattcagtataacttcttttgactgcgcttttagttcttgcaaaatagatcttgtttagatgagattccagcatgactcctttgtaatttttcatatttttgctattacatctcaactcttgaagagctatttctgtgaaaaccaaacatgcagtcaaggcacattccacgtgtggctgatggggttatcatagttacaaatcatatttatccacagtgataattatcttccttagcgttttgttctacttcagagctcatttgtgggccttaccacctgtttcttacatatggggaaagagtctcttattctcttttggaatatagatctaagagtagatttatatcaggatttgaaagatgaatctttttcaaggatgtttttcctctggaccgtggcattgtgtaagaaatttccctactcatcccatccctggggcacattaatttggagatgatgttaaatgtgtcagagtgtggcacaaatctcaactggcagataaagcctagtattgaattgttttcagttcagaaacgtggctggctgactttgaccctgaatgtgtaaattatctttgcagcaataagaacttgaagtagctttgatagctaatcatagtatgataactcagccagaagaattcactaagagcagtttgtgtgtcttccatctaatgtaaaggttagtaatgtaagtcatattcttggtgcctttagacctagttatgcagagagacatcacattgacattcagtaattcttactcttaacagttccttaactctaaaatcatctttttccttacctttccctagttctagaacagcaaaatattttacttagattctatcattaattaatatactcgtttgaatttttctcttctaaaaaatgtaggccaggcatggtggctttacacctgtaatcccaggactttgggaggtcgaggcgggcggatcacctgaggtctggagtccgagaccagtctggccaatgtggcgaaacccaccccgtctctactaaaaatacaaaaattagctgggtgtggtggtgtgcgccatagtcccagctactctggaggctgaggcaggagaatcacttgaacccgggaggcagaggttgcagtgagccaagatcacgtcactgtattccagcttgggtgacagagcaagactctgtctcaaaaaaaaaaaaaaaaaagtaaaattattttggccttaccatgcttggtttctttgtctttgttttttcattcactttatgtttggggaggagaatggagtgtcagtgatttcagcaaaaagttggggtaccagttcataataaattagtgtctaagattaatgttacagctgatattcaaagtaccaaatacgttattgttctgattattctggtccttaaatttgtctctttcctggagacgtggtaaacaataatgatgattctaataatgaccatttattgaatgagcactatgtgtcagacattgtactggtgatgtggtttggctgtgtgtccctacccaaatctcatctcaaattgtaatccccacgtgttgagggagggacctgatgggaggtgattggatcatgaggatggtttaccccatgctgtcctcctgatagcgagggagttctcatgagatctaatggtttaaaagtgtttggcagtttcacccttgcacccatgtctctctctgtctctcctgctgtcatgtgaagaagaggtccttgcctccccttggccttccaccgtgattataagtttcctggccgggtgcagtggctcacacctgtaatcccagcactttgagagaccaacgcgggcagatcacttgaggtcaggagttcaagaccagtctggccaacatggcgaaacctgtctctactgaaaaaacaaaaattagccgggcgggtggcgcacacctgtaatctcagctgttcgggaagctgaggcaggagaatcgattgaacctgacagatggaggttacagtgagccaagattgtgccactgcacttcagcctgtgtaacagagtgagactctctcaaaaaataatgataatagtaagtttcctaaggcttccccagccatgcagaactgtgagtcaattaaaccttttttcttcataaattgctcagtctcaggtagttctttatagcagtgtgaaaatggactaatgcaattgggcaatgtctgacagtttgcaaataccatctcatttgtttttaatagaaacctcctgctgagagtggtggctcacgcctgtaatcccagctctttgggaggccgaggcaggcagatcacatggtcaggagtttgagaccagcctgaccaacatgatgaaacctgtctctactaaaaatagaaaaattagctgggtgtggtggtacgcgcctgtaatcccagctacttaggagactgaggcaggagaatcacttgaacgtgggaggcagaggttgcagtgagcccagattgaaccactgcactccagcctgggcaacaaagtgagactccgtctcaaaaaaaaaaaaaaaaaaaatctaatactagccatgaggaaagataatcactctcagatagtaaagcatttgcttagccatatgttaagctctgaattcagatgaaggggcatctaaaacaggcagagagcatcaggaagggcttcctggaggagaaagtgcgtacactcagtctttaagagcacgtgggaggaaaaaccagtgaagtcctcctgctgtagacagaatgatcagcctgggcaaaggtgtagaggggtaagagagcgttaaacatgaggcagctgtgtaatattgtttcctgtaatctcttctgtacaggtggagaggtagcaagagacccaaatgatgaatggctgtgagtgccatgccatagcaaaattctgggttttaaaagagaataagcatgatcaggctggggatgttgaggaggggaaagaagggggatagagatggagaccacccagtggcccgctctccctcagtgctttggattatggggaaatgaacagagagccactgtgcccagattttattatgggttgagcagtgatcaagatgggagagagaaatggtaatgggactaactggcccatacaccagatggcatttgaggggaaggccgggtctgtgttgtcagggggccctgtgttctgactcccttcccattagaataggtggtgattaaacaagctatgccacaccctaaattctggttctgggttttactattcagtcagttttatcaaattaagatgatcatgtcttcccttctgaaaaattataggggaagaaaaaccatagaactttcccccagtatatagcattgaattacacatattcctacacacacacacacacacacacacacacacacacacacaccactcacacatatatacgtacatacatatataatagaatttttatataatatgtaaaattttaaaaatatatatttttagaagggctgggggtggtgggggcggtggctcacacctgaaatcccagcactttgggaggccgaggtgggcaaatcacctgaggtcaggaattcgagactagcctgactaacatggtgaaaccccgtctctactaaaaatacaaaattagccgggtgtggtggtgcatgcctgtaatctcagctactcaggaggttgagacaggagaatcacttgaacccaggaggtggaggttgcagtgagctgagatcccgccattgtactccagtctgggcaacaacagcaaaactctgtctcagaaaaaaaatatatgtgtgtgttttataaacctataaaatatgtgtgtgtgtgtgtgtatatatttatatatttatatatattacatatatatatatgtttagaaaataaaagatgcagtatgtcagtgctttcttatgacagttgcagctacaaaggaagattaaagctttttaaaaagtagaatttttatctgtttgtggagaggactgaaaccagtaagctcttgaaatgttttcatcctctcatcaaatatatatggacctgccatatgccaggtactgttcttactactgtggaaatagcagaaaggaaaaacaaagtccctgctctcagaaggtttagaatgagataaggcaggctactgagttggcttaaaaactaagaggaaactagtgaagtgtagttgcccgttcacatttttatttttttaagtattttatgcccacggaaaactgtgggactgggacttgaattctaattttatgttttcttgggttattctttaaaacagggtcttagactagtaattaatacagtgtcactctctttcaccttcctcaattcctttgcatgcttgttaggtcattcagagtggcactaaggtaaactttggcatatcaaaatccacttgaaagcagatggttagcaaggggcagtgacttatgcctgtaatcccagcattttgggaggccaaggcgggtggatcacttgaggtcagaagttcaagaccagcctggccaatatggtgagaacccgtctctactataaatacaaaaattagctggtgtggcgacgcacacctgtagtcccagctatttgggacggtgaggcaggagaatcgcttgaatccgggaagcagaggttgcagtgagccaagatcgtgccattgcactccagcctgggcgttacagcaagactccatctcaaaaaaaaaaaaaaaaaaaaaaaggagatggctatgcttgttaaacactgtttcagttgagtacctctcctgtgggcttgttggttcttgtgcagattcctgctcctgcccaagtccaggactagctgcacatacctgcacatgtgcctcacccagtccaggacggctagccttgttctcttcacccagcccagcagcagagtgctaggaaactttgctggcagggctgtaagaacctctgtagtttcttcccatttccttgttctcctaacttactatgctgggaggaaataatatggtgtggtaacgattttaggcaaagaaaaaaagcgccgaaatggatgtggtggtaaaattaggccaatcttttggaagcaccttagcaacctcctttcatgttcttggtacctttacctggttgtattgtaatgttcatttttccttgtgaacatctctctgtgtgtgtgtatgtgtataatttatctagtaccatggaatctttgaaggaaagactaaaaaactttcagaattattattattattattattattttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgaaaactttcagaattataacaataagtttcatttgttgtatagcacattctacgtgaccatagaccaactctcctttatcaatatttgtgtattctcttaaagagctaaaagaaatcattttttaaaaattctttatatctaatgttggccaatgttacctataagaaaagatcattgtttcagagcatgtgagatgaagatgattgactttagggcatttacatgtgggaactgtcaaggtagttgaagtttacaagagtgggctctctctctagtcacttcgggaggaatgccatcatcaggacatcatcacgactgactgatttggtcagtctgtctttcatcaagtcagggagataaacagaattgaaaaattgttcacaaaggttgtcagttattagggtgtggctgacgaaccacacctgaagagctacctagatgaaggcaactcacagagttacttaacaacctccaccccagttgatggtccagagtgtttccaagggaggtgaactaagccaatgttgagactgagtgggataaggccatggtgacatgcataatagatgcattcatacacattgcttcaatagagcattttcttggatggaagcatgggaaataacacatgggcgtatactcacgcttgttgttagctttcggggtcactgctgatatccttccttgttcagttaccctttgggacttgaactcctgcaagatcgttgaaaatcttcatgttctcagaactcaaagggaagaagacttgacccctaacccttcagaaagctggctgaaaaaaaaaaagattgtccataaatagcaattggctttacctagtattatttaccacattattaaactgctaattgcagtggtgtttttataatgccactatattattttaatttagaaaacattttataagtttattgtttgtaaattaaatagatttgcttaacagttctttgggaattccttaaactttattgctagctacaagtcctttttaaatagaatcaataggctgggcatcgtggctcacgcctgtaatcccagcactttgggaggccgaggagggcggatcacctgaggtcaggagttcaaaaccagcctggccaacatggtgaaaccccatctctactaaaaatacaaaaaattagctgggtgtggtggcgtgcacccttagtcccggctactcaaagggctgagacaggagaatcatttgaaccccaggaggtggaggttgcaatgagctgagatcgctccactgtactccagcctgggtgacaagagtgagacgctgtcccaaaaaataaataaataaaataaaataatgaatagactcaatagacattgatcctgctaacatattttgccttttaatctattggtacttcttttattccctttaaagttaattctaaataaaggagaagtatcttaatttggttaatatcatagtttggaactatggcaaaattattttttctcaggctactttctagtaagtattttatatttattcactaaagaaaatttttaaaatttcaaattacgtagaattgtaccactctcacatagaaatgtttttatctttcttatacatatatttatgtggtttgatttttatttggaatgcttgttttacttgaggtgtcaggactttccactcatttatgaagcctttacaattataatgataaatactgttacattaatgtacaataatttataaaactgactttctcatgtttaaaatttagatcgtgtctaattctttgctactttaagtatcattgcagtgaaatcttcaggccataataagttacttccttgcgataagttcacaggaataactagattaaaggtatgaatacattttaatttggttgaacacttacgtttatcaaaaactctttacaaaagtaacacaattatcctaataaattagaatattagaagtatataagatgaaaaaacattctcactgaacttcagtcctgctctccaaagtgaaccatgatgagaccttaagcaaatgttatatataatgagaaaagatagtcctgaagaattgagtgatatggaagtgataatggtgtactatatgggtgaaaaaataaagtactggtttagatacatgatttaagaaatagaatcctgacagttccctctgtggataagccatagaggtgtccagtgttggtttaatatagcagctggtttgaccgagtaccctctgctgcgtcaggtaatgttaaatgatgtccatgcccccttgactctgatcaagacatggctacaacctgcagtttccagctttcctgggtttaagggccattgaagaatccttgtagataagagaagaattgtacattccaggaactggaggcatagctagccttggaaagctcggagggttagttgagacagctttagacttgcacatctgtgacctgagtatctttgagacttgatttcatcttctagacccagaggcagagatcatgtttgtggttatttttctgggaactgagactgggcaaagggaaagaggccagtacgcaagagtgctgtttataaatggttaacatcgtccccagtcccgtagaagaagaatgaaatggtattctcctgtttggtggttttatttgattgtttttgaattctttgtctctgacagaaggcatcttctgtatcctttatgttgtcactcactttattactctggcattattataattaggttaccttatcactccacctgccagccctatctccatccccaagacctgaagggacggttggcttgacatgtgaggaggttttttggccttcagagatgtcgctgtcagccccctgagttccatttgttagtattgggtccagcccacagctttctactaaaaacaacaggcaaactaaagaatcttttagtaagtcacagacaattgtcactgaaccaagagcccagcccacggggccagttcctcaccgactctatgccttaatttccaatgtgtaagcttggatgactacacttatctccaggattcagtgtaggacatagaaaaaagtacaggactcaagtaatgattgaacttggaataaaaaccttaaggcccatgtcctctgtctctcatgcttttcagatgtgtcttagtgcctgctccttgcacagaagctgaatccaaacaagccactgaggaagttacatttcacttcacttcttaataacataggtatgtcgatcccattagataggagtgtgtctaaaattcagaacctttgacactaattatctgactgtcaaatgacagtgtcattctattttgcaggcatttttgatagtttatcttcccagtaatatttttgtaatcttcatcaccttgaccatctaactcttttttttggagacaaagtctttctctgttgcccaggctggagtgcagcggtgcagtctcagctcactgcaacctccgcctcccgggttcaaccgattttcctgcctcagcctcctgagtagctgggattacaggcgcatgccaccacacccggctaattttttgtatgtttagtagagatggggtttcaccgtgttagccaggatggtctcgatctcctgaccttgtgatccgccagtctcggcctcccagggtgctgggattacaggcgtgagccaccgcgcccggccgaccatctaactcttatgtgcccttgcctgtacatataaaagtacatttaaaaataggattggctttcatttgcataatgaacacacatattacccatagtacctcccacacaaagccacctatgcctcttaaattgcactttgttaataggaaactatctgttgttttgtgcttttggcagctgtagagaaaatacacaaagccaggtgttgtggctcttgggtaagactgagaatgtgatttttgcaatctgtgtttttttaatagccagttattggagataagaaagagaaattcagtacaaagtctaagatgtcccagtgatgcactctgactgggtgtcattatctcaacaggaatgaatgtagttcaacagtatgtaggcccggtttcttagacatgatgtctgctgaaatggtgataaggtatcccacattatcggtgtttttttgaagacagcctttagggtttcagtgtcatcatctttatgccttttgctaaaacagtttatgttctgccttttagtaagcctttatgttaaaaacgtttcatattaaaaaaagttatcatttggaatacataggtcaactatctaggaatgggacaaagtacagaaacaatgagacaggatttgtgggatgagaaattaaaaaagcagtcccttcagctgaagaagctgcttagaaatttaagccggacatctcaggcggccatactggaatggaatgtggaaaaggtagcagttatatgtgagcaatacctttgactgtgacactctttcgaaccccagtttagaccagcagcagctctcctaatggggagtcaagaagtagtaagagaccctaagagtcatataagacacaaatcacctttgcctgtgatatttgccatacatatgcctatggttacatgcagaggatcccaacaggagcatcatacacacagcaaataacactaatgtgttttatttatatgtaccaaattaaaggggcatacaaaataaaatttttaaatgagtgggtgaagatattgggacagaaggaagatatcaagaggaggaaatatggagtaaagatagaggtagcatgtactgtaaaagatcttgtaagtagaccagaataggccagtaatttggctccatgcttcctagcagccaaggcaaagaagtaattgtgaccagatacatagttcacagcatctttaagattcagtaagctagcaactcaagaaaagcacaagtagtcaccatatagggacaagtggaccatgctgtgaacagcacactagatagcaagtacagctgtaacaatcgttgctggagatagagcagagcttcagtcctttatgacaagcttgtccaacccatggcccacaggctgcatgtggcccaggacagctttgaatgcagcccaacacaaatttgtaaacttcttaaaacatgagatttttttaaagctcataagctatcattagtgttagtgtattttatttgtggcccaagacaattcttctagtgtggcccagggaagccaaaacgttggactcccctgctgtatggaaaatcgaatttgtttacattctcctgttgtattcatttttgaaattttgctaattcctaaaaggaatccacagagagcaaactctctattactaacttttttcctcttctcaatgtaaattaagtagtatttcaaatgagattaaaaacaggatacttcttgaactttactttaaaaatacaggttcatgagccccttaagttttgtgactttctgttgtaaaaaagactgtattcactagatggcagtgtcaccagccttttgggaagttaaatatgagtgtgactgtcctaagtactaaacatgggtaaaagtaggaagaccatttaactgagcataaaggatctcatttctgcgccctacaggaaagagtagttctcctttttctcctcccctcttatttgaggccgggaagaaggcgctgtgcatagcgctccaagcatctctgggtggcactggagggccatttttcacaaggagcaagtcggccagcagagtgctcagttcttggtcatgccagtggctgcagggtttccagccacttgtccttgcttctttgtttctgaactttcagtccggggcaggagttactgacaagagttcacaaaccagctgtgagataatggtgtattgataaggtacaaaagtgtgtttagcagatggggataatttttcgaccctcagtgtttgtttaaattgtttctagcatgaaagcaatatgatctctctcaggaaatgagattgttttctctattcaggtaataggatcttttacccatttccatctttgaggagtgattatatacttctgcagtttttttaaatgaaaaagatttatttttaaatcatactggcataaagttaatggtattttgttaaattttaggatttttacagcatatcttggctgacactgatcttggtcctatcctagtggcaatctcttaacagttgtgctgctggtgttatgagtaggacagttcctcattgtgtgggactgtctcgtgtgcggcagggtattctgcattcctggcccttgcccactaaatgccggaagtgcccctcagacatgactgcccagtaacactcccatgcatttccgtgtgcctcctggggtggggccagtactctctagtgttgaaaactgctgggctagagattttggtgtaggttgtgggccttgtggatttagtgaacatgatcttttaaagaaatgtatataaatgtactttatatttttaaaaaatcactacagcccatcaccttaaacttctgctcattcatatttatatatgtattctgattgtgattactcctacatacaattcttaatatagtacaaaattgtacatatataattttatggtacccatcccccccctgccctttttttgagacagggtctcaggctggagtgcagtgatgcaatcatggctcactgcagcctccgtttcctgggcccaagcaattctcttactcagccttccgagtagctggtaccaaaggtgtgcgccaccatacccagctaatttttaattttttgtagagggtctccctgtgttgcccagactggtcctgaactcctggcctcaagcaagtcctcctgcattggccttccaaagtgctgggattatagtcttgagctaccgcgcctggcatagtatcatctttttgataccaacatactataaatatattttattgcattttatttgaaactgttaatagacacataatttgctgatgaattgtattctttgctcttttagtccatctggcatcatatgctcttcctttttgctagaattccctctttttttctttctacagaagtatcactgggtgggagaaagccttacctgtgatggtttgagtacccacattttaaaattatgctagttaagaagagggggaataatgttgtttcttttctctttttcttatcaaatagactaaaaaggctactcaagggctggaatttgattcccacttgttcttgtggtacctagcacagagtcagtcccatagtatatcctttaggtaaagacttaattaattggtgtgctttcagtttattttccctggttggtctttgcatttgtccagttaacaccagcttctggatattagatcaccataaagtccaagacatgaagaacaaatgttatatattctctttgacatttaaagacagaagatagtggtagaggagatcccaagtgatacctaacctagctaaagacccatgaggaatgaaagaacgaacagggaaaacaactgctgaatccaggtggaaaaatgctggcctacttctggtccttggtatgccaggatccaaaggtggtgccagctgatagcatatgttcaacagctgtgttgatgccatttgcctgcccagacaagcctcttgaggcatgaaagcctaaggaaggtttctcatattaaggatcaacagggactcttctgtatccgtcctaccagtgtcacctccccacccagcatcagccgagcaccacatccactgaagctcaataaagaaatgtttaatgctgaagagtttcaatcaacaagatgaaattttcaggtttaggtaaacttaggaactggcttgggttactagacttccaaattttatccggtcctaccttattgcatgacataaccgtgaggactaaagtgaaggcttttcagcagtcacttcagtgagtcctcagcatttaggtgatactgtatcaactcgtgtctgaagcaacttggatttaagatagtagatcttgtgctgattattagaatggacatcctgaacaccacttaaattaccatcaaactgcatagccagatctttaatttacgaaacctctattttgtcacttctccaagctgtcatttaagctaaaagctgctgtctttacacatataaatcaaagaaatatttcatttatattcacttgatacctaccaaatttcaccactggaatttctgaatactttatatcctctatccttccatccaggcttggctttactaagtgtcctttctaagccactcattatcaatcaagatagtaattattctgcaagaccccaaatctcagtggctttcaacaacacacactgatttttttactcatatgctacacgtccattatttgtcagctgcagctgtgttcagtgttgacctcaacctgtgatggagcagcctctgcttatgtcgctgctgttctttatagcagaggaaggaaagaaagcaaggcaaagttccacactagcccttaaaacttcttcctggaagtgagacatggtatttctgctaccacttcattggttaaagcaagtcacaatgccacacccgagttgagtgagggtggggatatgtgattcttccttaggaaggagcaggaaattttggtgaatagtaatgtaatctaccacatgtttaaaatgcagtcccttctctagaagatctcagtagtctaagagagaataatttttttttaatatactaccgtaagtgaatgttaggtcagttaggtcgatttttttttcattcttgcaaggaatcattatgtctaataaaatataataaagagtttatggtatatttgaactgtccttaatgttattttactgagtccagttcttttggcagtggtttagtttctttaacaatctgtattctacaacttcactcgttgccttccttgtttaacatttatttttcaaaaccagacatgtcttttgtcttcaaaggataaatggaattggttaggagaaggattggggaggaggggggttgtggcaaatgtctaaaacctatgttttattcccttattttctcaaaaatgttagctcatgttcacacgggtttatctgtttagtctaagaagtagttacttttgctgtctggccaaagaggttcaggaccctggagctttgttctttgggaccctgaaggcagcctggcaggcagagcccagtatcacctttacagctacttgatggtgatcaagagccagctgctcttctttcacctggctgttgggggaggcacaccaatatgggtgggcaggaaaagttacttcccaggctgaaattttcccaccgtaaacttaggctgataggctgacagtctgcacctctcttcctcagcagacattccgatcagcaggccagtttgtgacgcgtgcatgtgcacacttcagattgcttcttccactttcctctttcctgctcaggtttctcataggagtaggctccatgtaagacttctgtcttttgtgaaaaagaaagcacgtatttatagaatggaatttcttactgaaagagggtgcgggcagaatggaggatgacatgaatcctgactcagtaacatttatggaaccactctctggatgccacacttactgtgggcagttaccaaaaaaatcagtttggcctacctgcctcctaatataatttaccctgcacacaaggcagtatcttgaaggttatttcagtagtacccacggaattctgcttcctttaggtaaggaaaagtattcccaagaacaaaatatacaggttaaagcccatgtaatataaaattatggcattcattgaagaaaatacaggctattctaattccagatcacatttatttatttatttacgagacagagtctcgccctgtcacacaggctaaagtgcagtggcgtgatctcagctcactgcaacctccacctgctggttcaagcaattctcctgcctcagcctcccgagtagctgggactacaggcacacgccaccacacccagttaatttttgtatttttactagagacagggtttcaccatatcggccaggctggtctgaaactcctgacctgaagtgatctgcccacctcagcctcccaaagtgcttagattacagtcgtgagctaccatgcctggccccagattacatttttaaaatgaagaaacagatattttctcttagtcaaaatacttatcggaacaattttttttaaagcaaagattgcatcatttaaaaaaacatattcactcctaggcatctgaatcactgcttcacatgcacagtagacattcgtgaaattatttttttaaatgatgatgaatgccagggcttgctttttttaaaaaaaagtctccaaccacaacatccaaactggtcatttgggaagtgatgcttccattcagtaagaaagctcctgcacactgggtgaacaggcggtgttttctcctctcatcgctgacatttaatacctgtcttgaggcaaaattgtctccaccttattaatccatggctcctcacgagccttaaaacagagaataaaacttgtcaaagaagaaaaatagaaaattagagaaaataacctcactacttattttcaggcaccttgtgacttaagaaaatgtttttaaatgtggactctacattttatgaacttaaatttagtgtctgttggtcaaaatccacaggacctttaggagagaaaatggccataactaagtacaagcctctctttttaaatgcttacccaggtcagttaaaagcttccttgtagttctgaatcctcagttcttgctttacagccaatacttaaaaggaacaggggagagctacagtgcttttgaatttcagagaggcctcttatttgtgcctcaagaatagtttgtataaatgttatatttcaagccacacagtacttaaaaccatcacactgtttagtttatctagttgggtagaagagggggcaagagaacaaagcagtattaaattagggcagcagcatcagggacaggctgatgtgagagcaccttctttcttgggatgggtagagtataattgtccctttgcctatcgtcagatttgggtggcccagttgctttaaattttgaaaacatgggagtattaacgcaaagaagagccaacattagttcagaatagctgaattcatcattcttttggaaccagttttgctactgtataatgataatagctcttcagcattcatctagtgagtgataaagataagtgatgatccacaagaaagtttacctttgacttgtgggtgctcacggactgcagaatgcagatgttcgtagatcagccgtactgtaattttcaaggatttaatatgcaatacattcctatattaagatgttgaaacattaaaatattaataatttgcaatgatttttaaatactttaaacaggctcttccactggtgagattgtttttccaagcagagttagctagtttaaattctttcgttgtggctgggtgcagtgactcacgcttgtaatcccagcattttgggagtctgaggcgagcagatcacctgaagtcaggagttcgagaccagcctggccaacatggcaaaaccctgtgtctactaaaaataagaaaattagcctagtgtggtggtgtgcgcctgtaatcccagctgctagggaggctgaggcaggagaatcgcttgaacctcggaggcagaggttgagccaagatcacaccactgcactccagcctgggcaacagagcaagactcccatctaaaaaaaaaaaaaattgttttgttgtattctcagttgtctatttcaggtctaggcaggcaagaaaactttgtcaggtacactggtgtcttccaaaatgtgcatcgtaccctctattactcagtgtcattaatcacatccattcctttcccaccctgtcttggaataggacattaactcttcaacgatctgccccctaaataaaacctgctttcttgggccatagtaaacaacacgtaattctttgcgagaaaagcaaaatagtgataattataatttttttttttggaacggagtctcgcactgtcacccgggctggagaacaatgaatggcgtgatttcggctcacggcaacctacacctcccaggttcaagcgattctcctgcctctgcctcctgagtagctgggattacgggcgcctgccaccacacccggctaattttttggtatttttttagtagagatggggtttcactatgttggccaggctggtctcaaatgcctgacctcatgatccagctgccttggcttcccagagtgctgggattacaggcgtgagccaacttttaaaaattaaaaaaatttttaaaaaccaactttttaaattttcaaaaaccaattttaaaaaccaatttttaaaaagccaacttttaaaaatttaatattggagcataatagaattcagcaatataagatttgattgggaataagaaataacatctcttttaaaaatgactacagccctcttaacaattttactcttaaccaattttggggtaccagtttactaattgatcaaattccagattggaaattagtcatcatttgattaaccagagttaagcctcttgaatcaaattctctaatttattatctcccatctgatctaaattcttttttaggggataaattgccaaaacgctttcagaatgcccagtactagaaatctaagctattcaattcagtctcttctctgttttcaggctcctttcctgaccctttggagaacctaatatatttagctaaaaatttttctttggggcctcacctaataaaggtaaatagaaaactgatagctatcacataacatacatattggttaataattgcaaccaaaagtaaattaataattttgagctatttatattagctctgccaaaattacatcattaaatttggccttatgaagcattgctgactgtagtaaaaacaagtgtgagcaaagtcttcatatgcactgagtctggtttcagttccacgtaatactgacttggcaagtgtggaaattctcatgtcatcattaccaaaaaaaagtgagttcacacagggatttctgatcaagtgacccattactgcgggaaaaaaccacacatacaaaagcctttgaccccagtaattttgtattggtatatttaccctgatcttaaactgcaaggaatgtccgcaattagagtttttctttgttttctaagtctgaaacttgataatccatttctgccttcccatgacgagtggacattcctccagccagtggtgagttcctctttccttcgctctcagcaagagcatgggttgccctcccatctcgtaagcagagcctaccacaaacgcagctcaaatctcagtttccagccctgcttactcactcgcttgttcctgaatccccacattacccatcatggcatcttactctgtagacttcacatgtgaactttgccctcgccggtggaaggggtacagtccagatgggagatgaaatccaaatgctccaccaaagggctttggtttgttctggggagccctggtgctgccgaagcctcttgggaaggaaggagggaagaggagaagaaaagatactaagtttggttttcattaaaaatttttccaggttttctttaaactgataggttcagggtctttttcatacaacagtctacttttagagcttttgttcgtttgttgtgtcatgggaatttataagggatggaaggaaaagggggacaaggaatggtctaatttcggtcagtagaagaatacctgaaacctgtttaaatttatttggaactaatgacttctacttttagtatccataaaagacttcccttggagcacaaagaagttaataatctgtgtatattgtcacttcatgctcttcttaagcgctgtgtgttggggcactgctctaggtgtggtgaaagactgctacaggataaataagtcatggtcactgccctggaaagaagcttaaaatccagtgggagtaaatgataaatgcataatgacctaaatgtcagatggatctagtacgtacctggaggattgcatagaagcatcctgacaagggtgccaagaatacgcaatgggggaaaggacagtctcttcgaagaatactgttgggaaaactggatatccacctgccaaaaaataaaattggacccttaacaccatatacaaaaatcaacttgaaatggattaagacttaactgtaagaggccgggtgcagtggctcatgcctgtaatcccagcactttgggaggctgaggctggcggatcacaaggtcaggagtttgagaccagcctggccaacatagtgaaaccccatctttactaaaaatacaaaaaatgagccaggcgtggtggcagcacctgtaatcccagctaatcgggaggctgaggcaggagaatggcttgaacctgggaggcggaggttgcagtgagctgagatcatgccattgcactccagcctgggtgacagaccgagactccatctcaaaaaaaaagaaaagaaagacttaatggtaaggcctgaaaccatataatttctagaagaaaacacaggggaaaaaagcttcttgacattggccttggcaatgattttgttgctgttacctcaaagcacaggcaacaaaagcaaaaacatacaagtgggactacatcaagccaaaaagcttctgcacggcaaaggaaacaaccaacaaaatgaaaaggtaacatacaggctgggagagaatgtctacaaaccatatatctggtaaaaggtcaatgtccataatatacgagaaactcgtacaactcaatactaaaataaaaaaaaaagtggaggtggggcaaaggaccttaatagacacttttccaaagaagacacacaaatagccaacaggtaaatgaaaagatgcttgccaggtacggtggctcatgcctgtaatctcaccattttgggaagccgaggcaggtggattgcttgagtccaggagttccagaccaacctggacaacatggtgaacccctgtctctacaagaaatacaaaaattagctaggcgtggtggcatgcacctatagtctcagttacccattagactgaggtgaggaggctgaggcaggaggatcacctgaacccgaagaggtcgagactgcattgagccaagatcatgccactgccctccagcctgggcaacagagtgagattgtgtctcaaaaaaaaaaaagaaaaagaaaaaaaaaagaaaaatggtgcttgacatcactaatcattagagaaatgcaaatcaaaaccacaatgagatattatctcacatttgttaggatgcctgttatcaaaaagacaaaatataacaagttttgacaaggatatggaggaaagggaacccttgtacgctattagggtgaaaattggtacagccattatggacattggtatggaagttttgtaaaaatcaactatatgatccagcagtcccacttgtggatatatgtttaaaagacatcaaattagtatgtcaaagagatatcttcacttccatatttatttcagcattactcacaatagcaaagatatggaaacaacccaagtgccatttatcttaggaatggttaaagaaaatgtggtatatatatacaggatagaataatatttagccataaaaataaggaaagcctgccatttgcaacaacatggatgaacctggaggacattatgctaagtggaataatccagacacagaaaaacaaatactgtatgatctcagttatatgtagaatataaaaacgttgaatccacaagccaagagtagaatggtgattgtcagggtctggggcatgggagaaacggtgagatgctggtcaaagggtacaagctttcatttataagatgaatatgttctggagattagggagcgtccttagtcttttccctctccatgcagagggtaactatgtgtgatgacagatgtgttgattaatttgattatgggaatcaatatgcaatctatatttatatcaaataatcacattgtatactttgaatacgtataatttctattaattattcctcaataaaattaggaaaatcagaagcatcctaaaagttgcattaaaaacaatgatgaaaacaggccgggtgtggtggctcatgcctgtaatcccagcactttgagaggctgaggtgggtgatcacttgagatcaggagtttgagaccagcctggccaacatagtgaaaccccatctctactaaaaatacaaaaattagtcgggcgtagtcattcctgtagtcccagctactcgggaggctgaggcaggagaatcacttgaacctgggaggtggagggtgcagtgagctaagatcacgccactgtaccccagcctgggtgacagagcgagactctgtctcaaaaaacaaacaaaaacaatatcccctttaaaaacgcaatgaaaaaaatagctgccttaccaagccaccagtgagagcccatctctgaggaaaaggggtgtgcagccggacaggcttcagtttaaaagcttaaaccttgacttggacttactttatgccctgagcaagctatttaacttttttgttccttaatttctaaattatgaaatggcagtggaatgaaatggaagatgaaattgtgccttgttcgatgccctggggtctgaaaggtgctcctaagggtgtacagcagttagcaccgttagcgtcctgggcaaacccacagcccgcagatctcttatttggcagcgaattcctgcagatcagctctaagagccagatttcctcatggaggaaaagactgctactgtcacgggaaagatttgtttaaacatattttttagtacagttttataagtccttatcaagtagggccagcccccagataaaaaccgttaagtatttatctgtaagccagaggttgagaataggaaacatttgaatctttaagaacttgagtccaacaaaaatactggctaacagcctgactgaggtgaaataaaccttgtttccagttttccagaaaaattgtttattactgggcaaatcttgggcctccaagattgcctatatttttgtttttcttttctcttaatctacaggaaacttctgggttgggccttctcatagttatccgttgttaaaagttctatatttctacaaaccttcttgtgcgaggagtatctggaaaaaaaaaacaacattgagatcactctttaaaaattagtgttttagacaggtttctggttttctctgctttgttaactgaaacagcccccatagaaacattctgaaagacttaatcaaacaagtattcagaataaaatgaatgggaagaagttttgagtctccttgatcaaacatggacctgtgctttaaaaagctgagcccctgagtttgttgcactgtgtacttaaagtctgtgacagtttagcctctttctaggctgcccatatctctcaccactcggttcatttcccggttttaaccactccccacggtccccagatgatcattttcatcctgagcctcttattcccaccttcagtcacttcagaaactcccctgcactccattcaactttctggacctcccctttaatgtttgccatttgtgcattctacagctcggtgcacttgttttctgacctcaagagtcaggagaggagctatcccagcttcaattcctcatcaataaggtacagaaaatactctctaggattactgaagaaatgaaataagcaactgtattttaagtattttatgtactgtaaaagcattgtgcgtccgggtgcagtggttcatgcctgtaatcccagcactttaggaggccgaggcaggcagatcatctgaggtcgggagtgactggccaacatggtgaaaccccatttctactaaaaataaaaaagttagccaggcgtggtggtacatgcctgtagtcccagctactcggaaggctgaggcgggagaattgcttgaattcaggaggcagaggttgcagtgagccgggtgacagagcgagactccatctcaaaaaggaaacaaaaaaaagctgtgccaataaaattatacttattattctagatacaaatattctgaatgctcctttagtcagattctgtgttttctgttttgtttttgtaattttcacttaggaggaggctgtacataaatcaagcccttagtaaatccttatttagtgaataaataaatactgccaacatctggccccagccctatttggcctcaaatttctgagggctggttaccactattgctgaaaatagaaaaggagaaacaaaaaacaaaacccaccaattcaggacagaatatatttgtgcttaaacaagcacacagtactctcacatccaccctcggtctccctgaaactcagacctgcaaaactaggatacaagctgtaatgacatgatgctttcacaatagcagattgaagttagactccagaagacagctttacagtgtgttaaaccagatagaagacaggcggctgctattggtgttttacactggtgtacatcggtgcttctcagtctcttcacattctaactcattccttttggtgttctgtgtagctattttggtctttatttcatatttatttgatttgctcttttcttgtaccctttattccaagggggaaaaaaaggtgggggttggacaacagagaatgaacagcacagaattcctttccttaaatactgccatcctgggaaatctagaatcatgaaatgtaagatacagattgtgccctagatcctcctgtcctactcttcattttatggacaagtccatccagaaacctgtgatggatgagggcagagcctggaagaaccccagtctccattccctcctccttctccctaaaccacaaagcctgatttgagtacccagggctacccaggttggaaatagaagtcctcatcttctgcccaggatttctcactcctagccacagagcttctgccccctcctagccacagagcttctgccccctcccactggaagcattgtgcccaggagaggacctttttctcttatctctgctggtaagcttgattatcaggatattcctggggacctagaatttaatctcttctccaaagctgctctttgatggtgttgagggtgtttttgccagtaatgaacaatcttcttgttttgaagctgccttttatcttgtttaatacattgtaaagttgtcttctggagtcttcttcagtctgctattttgaaagcatcatgtcattccagctcgtatcttggttttgcaggtatgagtttcagggggaccagagggtggatgggagagtgctgtgtgcttgtttaattaagcacaagtatatcctgtcttggattggtgggttttgttcttgtttttccctttctattttcagcaatagtgataaccagccctcaggaattttaggccaaatagggctagggccagatgctggcagtatttatatattcactaaataaaaatttactaagggcttgatttatatacagcccccgctaagtgaaaattacaacaaaaaaaaaagaaaaacacagaatctgactaaaggagcattcagaatatttgtatctagaataacaagtataattttattggcacaatgcttttacagtatataaaacacttaaaatacagttgcttatttcatttcctcagtaatcctagagagtatttcctgcatcttattgatgaggaattgaagctgggatagcttctctcctgactcttgaagtccgaaaacaagtggacggagctgtagcactaagcctcagcctgctcgtcttcaacctgctcctggctgcagagtcttgattgactctgcctgtctccagtgtgctttcattcccttcagtgggtaacttgtcagacctcatcttgtttttgagactttggtttctgtcttgccttcttcctaactttggtattcttagttccaaatcctgaataactcctgtaatgggcctcccagtagggggggttcctgtatttatattcacagatgtacgtattttaatagttaacatctgaaatcagtatacatcttaaagttgccatggaagttcatttcttcagtgtctgcctctgctcgtcacttgaggtgctggtaaactaagaccaaagtttagattccctgcttgagggcacttgaaccacagtggtggtgagttcagaatgcaaatgagagtaactactgacttaggattcaaatcttcaggggagattcctcccctctctgcccagttcccaggttgaaacatccaaggctctttgccatccctttctgcatggcgggtttctttgtggccatttggttccctggattcaagtggtccctgatacctgttcagtttaccatcttgggccgggcatggtggctcactcctgtaatcctagcattttgggaggtcaaagtgcgcagatcacttgaggccaggagttcaaaaccagcctggccaacatggcgaaaccccatctctactaaaaatacaaaaaattagctgggcatggtgatgggcgcctgtaatcccagctactcaggaggctgaggcaggagaatcacttgaacccaggaggtgaggttgcagtgagccaagatcatgccaccgcactccagcctgggcaacagggcacaactgtttccaaaaaaaaaaaaaaaaatcccatcttgcatgcttttcctttctctgtagtatgtaaaataatgtatgtttgtgatcagtgagatctcagatctgataaaatgcagtgttttgtcatgagagttgctcccagccgctgatggggttgccttgttcagcactttttagcaccaggggagtaagccatgttcttgctccccctccctcaggctgaggctttgcttgatcacctgctaagacaaaaaccagagtgggtcacgagtcactctctctcttcccccagccacagtggcagctgcctaacttggtttcttgctggtgcacacatgtgacagaaatacaatgttaataaatatttctacgtgtaatggagaaacaagccataaaagtagctgtttgccatctgctcagatacattattaggaaaggcaatgacattttatgattcagtaacttaactattctcctgccttctgtaaaggcccatcacatataaataaattataaacatccaaacacatcctgagagaagtgcattggtctctgaagcagaaacaaatgatacctgattctcccttctcccagaggagatctcaaacaactcagttacagtgcctcacagttgtaacctatagtacaaacgtgttggagatataacaccttgtatacgtatgtagagagaattggcataacaaagtagagaggagaattagacgaatgggcaccccaatcagtgattcagggagaggaccatattttaaacagcaggcaatgactcatttactgagtgttttctgtgtgtcaggcactgtactacgcactttgttcatctataagtggaagaatgcttgtttttcaagaacaaagggaataataagaataaaagtgaaggccaggcgcactggctcacgcctgtaatcccagcactttgggaggctgagaaaggccgatcacttaaggccaggagttcaagaccaccctggccaacatggcaaaacgctgtctccactagaaaatacaaaaattagcagacgtggtggcatgtgcctatagtcccagctactcaggaggcataggtgggaggactgcttgaggctgggagttcgaggctgcagtgagctgaggttgcaccactgcattccagcctgggcaacagagcgagactctgtcttaaaaaaaagaaaaaaaacgagttggggggcaggcacggtggctcacgcctgtaatcccagcactttggaggctgaggcggatcatgaggttaagagatggagaccatcctggctaacatggtgaaaccccatctctactaaaagttcaaaaaaattagccaggcatggtggcgggcgcctgtagtcccagctactcgggaggctgaggcgggagaatggcgtaaacccgggaggcggagcttgcagtgagctgagatcccgccactgcactgcagcctgggcgacagagcgagactcagaaggataaaaagtaataacctgaagagtagcttcgtttcaggtggaaggtgagagaggctgcagaaagcttagggctgggcgcggtggctcatgcctgtaatcccagcactttgggaggccaaggcggtcagatcacctgaggtcaggagtttgagaccagcctggccaacatggtaaaaccctgtgtctactaaaaatacaaaaatttagccaggtgtggtggcaggcgcctgtaatcccagctccttgggaggctgaggcacgagaatcacttgaacccgggatgtagaggagctccttgggaggctgaggcacgagaatcacttgaacccgggatgtagaggttgtaatgagccgagatcatgccgccacaccctagcctgggtgacagagcaagactctgtctcaaaaaacaaaacaaaacaaaaagtgcttagtcaatatctggttgttgattgtttaaggaaaaggccaagtgagggtatgactggttggtagaaatatgtatcttggtataagcagttctaggagtgatatgtgtcttttgctgctgttattgttgtttctgttcagcgttaatacgttttgcattgtaccacaaatatttccttactcctttgcctttgagacaaagggcatgagtttataagttgagttgaaaatagattaaatatatagtacagcctatgcccagcaagcagaattatctatgcaagttatgcagcccacacggaaaaagaaatgctgtgcggcctcattagcaccccaggatttgtggggctccccctgggcagccttaaccaggaaaatttcatagtctccttggcattccatccaagatttaagacttctcctttcatctccttgaggaccatcaactatacccttgagctcagccatcccacgcactgaggcttatctgtacttccagcccagacctccctcctaattccccactatacctgtgcactgaaacaccctcttaggatctccttcttccacattcctcctcctctaggcaaggcaagtcgttttcctcatctcagccagagcagtagttactgaaaactaacccaatatggtggcttctgagctcaggtgtctttcagtgactcctgctgcttccaaaataaagtccaactgtttagcttggcatgcaaaacctgtagtcatccatcccttgcatatttaactcctcacacaccccattctgtggtctcttcttccctttgcatctgctctgggtgctctttgaagactgtacttcctcccctttggggccaatttagtcatctttaagcctcatttcaggggtggtgtcctcagataacccttcttcacataccagtttgggttatctaccgctgtggctctatagctctcagctcacaccaataggataagtatttaacatactgttaaattacagtatgccatgataacttctcttccatcattctgtattgcatgagtacaaagactgtgtcattaatccctgtctccgtagcattgtgtctagcctttaacagtcacttaataaaggcaatgaaaaggaaataacatttgaccttcaatttaagtttgactaggtatggtcaaacgttagaaagtggcagtgaacttcttttgaagtcagaattcatattttcctttaacatcagatattggcagccagcttttccagattttcttggccaaaaatattactaaaattgcatgcccctagattttgatatctaggatgatacatctacagcatgtaattatttgtctcaataattgagctttaccttagggctctaagagaagaggttaaaggaatcagtggtttagtaattgtattgttaatcttaaaatgaaagttgaatggaaaatattttaaaaactggttaagaagataattattgagagcatggaaaagataattactacatatactgtaactggtgaagatggaggttttatgaaaaataaagcagcttgtaattttttacaacttctttcaaatgcaccttggactgccaaggtgagaggcaggggaggacattttcattccgtggagtcacactgaggatttatcttgtaattgattatcacattatctgctttgatcctcatgagataatgagagtggtgttttgttttgttttgtttttctttgagatggagtctctctctgttgcccaggctgtagtgcagtggtgagatctcggctcactgcagcctacacctcctgggttcaggtgattctcctgcctctgccattcgagtagctgggtttacaggcatgcgccaccgcacccggctaatttttttttgtagtcttagtagacacggggtttcgccatgtttgccaggctggtctggaactcctgacctcaggtgatccacctgcctcagcctcccaaagtgctgggattacaggcgtgagccactgctcccagcctgagagtgagtgttttagcaaagcaaaacggcagaggtaacatggccccctccctccacatcttatgaggtttcctaccattttctgtccaatcgtgactttttctacactcacttttagtgccccataagaaggatatttaatgaaaccttttatggactattgataagaacccaacccttgaccgggcgcagtggctcacgcctgcaatcccagcactttgagagccgaggcgggcagatcagaaggtcaggagatcgagaccatcccggctaacacggtgaaatcgcatctctactaaaaatacaaaaaaaattagccgggcgtggtggcgggcgcctgtagtcccagctacttgggaggctgaggcaggagaatggcgtgaacccgggaggcggaggttgcagtgagccgtgatcgcgcccctgcactccagcctgggtgacagagcgagactccgtctcaaaaacaaaacaaaacaaaaaaaacacctttttttgtcttgccattcaagttacttccaacagtgctaccccttctcccaagactcttaatgtagtctgtctgtccatagcattgtatccagattcctgaacctggcatatgagctctcaataattcattctgactcatctttccaggcttactgtttaaatatgttttatttattaatgtttgagacagggtctcgctttgtcacccaggctagtgtgcagtggcatgttcatagctcattgcagccctgaactcctagactcaaagggtgttcctgccttagcctcccaagtagctgagattacaagcacatgccaccacacctggctaagtttttatttttagtagggacagggtctccttatgttgcccaggctgggcccaactcctagcttcaagtgatcctctggcctcagcctcccacagtgctgggattataggcatgagccactgcactgagccataaatagatgcaagtcaaaatccaagaaaaccttgaaacaaattgccttacatggtaagaaaggtttatctttttcataagttcagaaatgaacttctggggttaattaatttgtaattgcccaattgcacacacaaagccaattcactgagactgtgatattgcagtaaagaaagagtttaatgaatgctaggccagcaatgtggaaaatggagttattattcaaatcaatctccccaaaggctcagagagttagggctcttcaaggatagtttggtgagcggaggacttagggaatgggtgctgctgattggttgaggatgaaatcatagggatgtgcaaaatggtctaatcctgtgccacctcacctgcactgagtccatctctggacttccttggttgagttatgagtcctggctcccggtggggtcactcggttgcctgaatgcaaaagtctgacaagcatctcaaaagactaatcttaggttctatagtagtgatgttatctataggagcaattggggaagtcacaaaccttgcaacctctggccacctgacttctgagcagtaagagattatagaaagtatgcttacatgttagcagaattcaggcccctcccattattctagtcttgtggcctttattagtcttacaaaggcagtttcagcacctgaacaaggaagggaatgagtttcagggagggactgttatcatccttgtttcaaagttaaattacaaactaaatttctcccgtggttatcttagcccatgcccaggaatgaaccagcctgtgaggccagaagcaagatggagttgaaccatgctagatttctctcaatgtcatcatttttgcaaaaggactttcagatttagtggcccactgatatcattaggggcccaggttcttattgtcacttcactctgccatccactatgcactggtacatcctgagacttgctctgcctcttggcaaaatggctacagaagtgccaggcatcacatctagacagggcatcttgtggctcttgtaggagtaaggaaacatttccagacgcaccctagagaacatcttacatttcactgaccaaaaatgagtcacatggtcctttacaaaccaatcacaggtaaagggaatgccgttattatggtaaccagcatgggggaacaggtggagagtcaaccaccaggactacagggcttccttttctccctttgtatgtccctcttccatcctgacctcatggtgaccctaaaaagtctgtgcctgcctaccaccaaacctgctctctgcccctctagattttaggtacccagccccccaggcctatacccgagttcgctttgctccatggaactttccttgcgcactccctgttctacccctttgccacctgtgtgaaggtcatatctctctagctggaccctgaggtcctttggggcatgcctgcgctgctctctattccttcatgtgcttcgtagagaaccacagaccctgactttatttgtgcaaaccttttccccaaaatgctaagactaataccacgcacagatggaagtactcttacatcctagtcatatcagccccttgagactggagctagtcttcaaaatggaataatagtgttccctttttattattagaatagtaagaattctatatgagtagaataagaaaaagttaatgtggcattcacaatttattaatgtcccttcatccatttacccacattcctttttattcttttttttttttttttttttttgagacggagtcttactctgttgcccaggctggagtgcagtggcacgatctcagctcactgcaacctctgcttcccgggttcaggtgattctcctgtctcagcctcccgagtagctggcggtacaggtgcacaccactttagtagagacaggtttcactttattggtcagactggtcttgaactcctggcctcaggtgatccacctgcatcagcctcccaaagtgctgggattacaggtgtgagccaccgtgcctggctttattccttcttaatgaggcacaaactcagtttctgcgtggtacatatagcctttagattttcatagttttactgtttttctgatattctcagacaaataaatggttgtacatcagaattattggaggagctttcaaacaatatgcctatccaagtatcaattaaagattcagtttcagttggcctgggttagggcctagggtgtttttgtaaaagttctcagggattctagtggcggccaggttgagagctctgctcttagatctttatatgcagaactctcctggctgagaattatcagaataatttcaaacttttcagagctcttatccagactgctgccatatattactgcttctcatattagcactgctgatcatgcagggtatgtcctggtttcttttgtgtttgatggctaaatatccaccttcccttttatctttttcctgcctggattgtaaacatctcatttctcttctgttccacagcattcaggacaatattaaagagatcatggaggctcagtcagttcccatcaacagagtccgaaacgttgtccacttcataacttgctgggcattctgtcctgtacacctttaaacaaccttcctggctgggtgcggtggctcacacctgtaatcccaacactttgggaggccaaggcaggcggatcacgaggtcaggagttcgagaccagtctggccaacataatgaaaccccatatctactaaaaatacaaaaaattagccagatatggtggtgtgtgcttgtaatcccagctactcaggaggctgaggcaggagaatcgcatgaacccgggaggtggaggttgcagtgagccgagattgccattggactccagccaggcgacagcgcgagactccgtctcaaaataaaaacataaacaaaacagaaacccttcctttaggcccagagagccaacctttccctcagagactgtttttaaaccaagccactttagactttgccagtccttctgtagtcccctattcaaaactttgtttatacctttcaggaatattttatctagtactttattgatttcatccagttatgtgccccttctctccattttttgacagtttctactttattccactcctccaacaactccttaatttctgctgtatcagcagagcctctcctaggtaattggaagagttgtccttctctcaaccctattctttctcaagtttgctattcccaggtcttctgttgccttcaaacactaccaagtagtctcattatctattcacaataatgatgtgaaagcttttgttccagcatttgttgaatgttcattttttctctggcctttcatcatctgtgacagtactttgtttagaaaatggagggtagggtggcacttgtatagcccattttgtatggttcaacattcatttcattgtgactaatgatgactgatagctgatgtcataagtagtgtttcttgcagcaaagtttcataaattttagcatgcatcacaatcacttggggtacttaactcaagtacgtattgctgggacttaccttcagggatatctaagtcaccaagtctggggtgaagcctgagaatttgtatttctgttaagttcccagatgatgctaatgctttatctggggaccacacttgagaaccactgtcctatgggatcaagaaataagccaggaacgagtgtatattttttctagttaaatatttaatgttaagatgtttagaatttttttagggaggtgcttgtcagatacttttcctaatagtgggtactcagagtatttcatgtgagactaccaatgtcatatattttaaaaactattagactgggacagatgggaaattgccttcagcataagaaaagccaatatttttcataagtcccaaaagcagcttttggggttggttgattcagtggttcaatgaaaccatcagagactctggttcctactctttattccactgtgccatggaccatgtgctggtacatcttcagactcactctgcatggtgacagaatggctgtagaagtgccaggcatcacatccaggttacatacagatgcacactgtttaatagccaagcttatgcagtatcagtaactattagagaaactgaaatggaggatccagaacttcttatcaaatataatccttaagatacaaacaaagcagtcattgaatagtttcttagcccattttctgtggcttatgatagaattcctaaaactgaatggcatataaagaaatttatttcttatagctatggaggctgagaagtccaagatcagggggacatgtggtaaacgccttcttgctgataccagtaaagcctgctgagctggagtgtcacttgaatcatattcgccacttttgctttctcttcctacatgggtcctgaggttttgctctcatcatcatcttgcctttcagtaaggtaactaacttgttaccctctgctatgtcagagagattgtttgtttcaggataaacatataaacagagtttcagataaatctcttatttcctggccactggggctcgagttatattgttagcaccagctctgtaaagtgcctcaatgtgttttttcaaccaaaggcaaaatatttggcaaagaatatgttggttctttacctccaggttctgggcaaactttgagtttccattcttttgagatagatggactttgttgtctttcataaacttgttaaatttgcgatctgcccttgaagaggcacttggttccttctaattcttttctgtagattcctctgattctccatcagcgtatggaaattttctcttctatcccttccagagaattattcttctctctgccattcaatttgactgtgttactgccaggaagagacagataaaagggcatcagcaatgtcgacaacttaggagtagttcattcctttttcctatggctgagcaagtggatttgactgtacttatttttgtgtattttaatatgttcacctgagcaaagtcagtgatctagaagcttcataaaatgaatagtgcataacagaaatcacacctcagtgtaagtcttaccttcctacaggagtcccataaaaacactcttaggacatgctttccccccacacatctgattgctgaacactttgtttcactaggcttcaacaggtctcttcaaagctgtcattttacttcagctgggattacattccaccctatttcacttaaatatacaccttccctttaattttctctcattcttatcattggcagtaatcagtgtggcaagagttcactttcttttcacatggagatttgatctttgattattttatttttatttatttattattattatttttgagacagagactcactctatcacccgggctagagtgcagtggcacgatctgcaacctcctcctccctggctcaagggattcttttgcctcagcctcccaagtagctgggattacaggcacacaccatcacacctggctagtttttgtattcttagtagagacagggtttcaccatgttggccaggctggtcttgaactcctggcctcaagtcttctgcccacctcggcctcccaaagttctgggattacaggcacgagccactgcgcctggcctgatcttagatgatttaccaaacagtgccacaccctctgccttctgtgtgtgtctcaggctgtaagtaaagtctccgtcttagtccattcaggctgctgtaacaaaatgctacagactgtgtaatttataagcagcataaatttattgctcacagttctgaagtctgggaattccaagatcaagatgacagcagattcagtatctggtgagggcctgttcctcaaggatagtgccttctatgtccttacatggcagatgggcaaaagagctaacaagcttcctcaaaccctttgtaagggcactaatcccatttgtgagggttctaccctgatgatttaatcacctcccagaggacccatccttaatgccatcccgttgaaggttgggtttcaaaatgtaaatcttgggagacacaaaacattgagaaccatagcagtctctcagacctcgttgtactcagcttcattttaggataactccacatttgagttaagaaaccaagagtttgtattcccaactctatgcttcatgaggttaaagactcttggcttctcattctcactgctcaggcaggggtagtccatctgaatggaaactcctttttggggggcacacatcatttttattttattttatatttctgagacagagtctcgctctgtcgcctgggctggagtgtgtgatctcggctctctgcagcctccacctcctgggttcaggcgattctcctgcatcagcctcccgattagctgggattacaggtgcatgccatcacgcccagctaattttttttttttttatacagagtcagtctctgtctcccagactggagtgcaatggtgtaatctcggattactgcaacctccgcctcccaggttcaagtgattcttccacctcagcctcctgagtagctgggattacaggcgcctaccatcatgcccagctaatttttgtatttttgtacagatggggtttcattatgttggccaggctggtcttgaactcctgatctcaggtgatccacctgcctcggcctccccaagtgctgggtttacaggtgtgagccaccacgcccggcctaatttttttttttttttgagatggagtcttgctctgttgcccaggctgcagtacagtggtgcaatcttggctcactgcaagctctgcctgccgggtccacaccattctcctgccttggcctcccgagtagctggacctacatgtgcccgccaccaggcccagctaattttttgtatttttagtagagacagggtttcaccatgttagccaggatggtctcgatctcctgaccttgttatctgcccgcctcggcctcccaaagtccagggattacaggcgtgagccaccgcgcctggccaccacttttaaatgtctgtgttgcagtgaaattttaaaagagagagctaaattttgatgtcagtttttaaatagatgctgccaagagccatgttgatagcccaaaccaattttccatttataccagtgatatacttcaagcctgaaaaatgtagtccagtgtgggaagaagccctgtgatggtgagaaatgcagtaagaaactgggttctcccatggaactgataattaatgcaatcagatatgaacagtatgtttaaggatagtctggacatgaatgtgtataatctgtctttatcagataaacaaataaaagtcttttacctaatcgtcgtttcctgagttagaagaatcctccttatcagatacctgctttggtcattggaaggaaagtagaacatccatcttggtggtgatccttgtttcttagtactctgtatatcctttccaagagacaggtttcttttatgaaatggctaagatcatctccaccaccatgaacaacatgcaaatggagctgctgcacaaagtttagggagttctaagcgttgggattccaaggcatattaccctgtactgaagaaactcggaacagaggcatcctcaaatcctaactgcaaggaagcgtagcctgtgtcctttgttgatggaggaatgattcagtgagaaagaacacagtgatttttttctctacctatcttacatcttactctcttgccatttcttgtaacaccttttcatcctgtcttaaccttcagctaccagcttaccctgatcgtaatgacaaggaaattcatacattttggttttttaaggactactttattaaggtataattcacaaaccatgcagtccaccctttaaagtatacgatgcaatggtttttagtaaattaacataatcgtgtaaccattggcataaacaacattagaacattttcatcaccccaaaaaagaaaacccatacccattggcaatcaaaagccgatttcctccccaaccaccacacaccccccagcactaggcaatcattattctactttctgtgtccatgggtatattaaatactgtgttgtaactggagataggatgcccatagtcagaaagcttgagctcacatgaactgttggcttggatttctgtgcggattaaaccagcttacttctgacacggcagatgctgggctttttaacctctttcctcattgtgcttcctgacttgttacctctgtatcataaaagcatgaaaggtcgtagaataaatgagtctgcagaaaactgcgtggttaagttaccccatttgtgttttacaaagatagcggaagggaataacctttgagggtcacatacaaaaagccatttcctcatcctccctaaccttaaaaagtcgacattatttttacagcagcttctctaaattgacttacacttgaacaaactaaaaactacaagaagagtagagcttagctggcaggcctggttttgaacaagtgtttgattttgctaatcttggtagtgcataaggtcacttttgtaaatttcctgtagaaaaattcttggttcttggacacactcagctactagaacagagagatggtttatattttttctatgaattaccagctgataaaattcccctcctttgagtgggagaaaaattcaagccagacaagaacttttgtggcaggtaactcttacttgaaatttatttggatttctagaggcaaattaatttctctctctgtctttcacaataaataggtgcctgtcaccttttttttttctctatctagtgagctgcttctatagatggaagaaagttagtccttccttttggtattttgagagttttatttttaggcctctccttggctgtcttttctccttgtaaagccagtgtcgaagtaatggcaatggtaagtatgcttagcgttctaaatttttttaatgcatgtttattactaagtaatttatctccttttcttctactttatagctccatattaaatatggtggcaccttttaataaaaaagaggaaagcctatttggaaacatataaaaatagcacaggataggtcatttttcagattctggtcagatcaccatttggaaagatcttattctttaaagcaaaagttttgaaccaaggatctgttgaagatggggagtgactctcattcatctccatcttcctttgaaatttcatacagattttttggtgtgtgtttgtgtgtgtctgtattttctaatgagaagatccataactttcataagcatcaaagccactgcctttaaatatctttttgattacttttactgtagttattgttttaagatctgctttttgccatttaaaaacatctttcaaatactagttaactcttaaatgtttttttgcagaataagatcctttttgcagtactttttgttgttgtttaatacctacccaaaattttggtccaagctctaggggcctcctcccgaagaatttggtttaaaagcaaaagatttttaacataaataaaccagaatttgctttttttctttttgatttttttttttttttttttttggtagtgatagggtctctctgtgttgcccaagctggtctcgaactcctgggccaatcctcctgcataggccttccaaagtgtgaggattaccggtgtgagccaatgtgcctagcattgatttgtgggggttttttgttttttttgggttttttttagagacagagtctcgctctgttgcccaggctggagtgcagtgggatgatcttggctcactgcaggctccgcctcctgggttcaaacaattctcctgcctcagcctcctgagtagctgggattacaggtgcctgctactgtgcccggctaatttttgtatttttggtagagacggggtttcaccatgttgcccaggctggtctcgaactcctgacttcagttgaggcacccgccttggcctcccaaagtgctgggattacaggcgtgagctgccacgcctggccttgatttgtttttgcatgtgagaaaatgtatgtcctagtgtagtgtggtgtgtcattagaagcatgatttgttcttaccaatgcagtgattacattggttcttctacattcagtagaatgctaataatgtggtaatgctagtcgccagtcttcttaatctctataacagaggaagcagaagtagagcagatcctatcctagccttgtaggtctagagaccgaactatagtgtcttctgggaaagcacttaaacaaaacacaggtttataaattgttatggtcactaatgtttcagtcaagatggtgactacctatgatttgtgtgtatgtgctacccttttgagaagcattaattagtccgttctctcactgctataaagaaatactggagactgggcaatttataaagaaaaggggtttaattggctcagggttccgcaggccaggaagcatggtggcttctggggaggcctcaggaaacttagaatcatggcagaaggcaaaggggaagcaggcacgttttacgtggccagagcaggaggaagagagaggagagaggtgctacacgcttttaaataaccagatctcacagtaattcactgactcactgtcaccagaacagcacccaggggatggtgctggcccattcatgagaactctgcccccatgatccaatcacctcccactaggccccaccttcaacactcgggattactgttcaacatgagacttgatggggacacagatctaaaccatatcaagcattaatattactattaacctgtgtgaaaaggaactgaattctgctgtgacattttttgtttaagaattaggcctagcaggtgtggtggctcacgcctgtaatcccagcacttcgggaggccgaggtgggcggattgcctgagctcaggagttcaagaccagcctgggcaacatggtgaaaccctctctctactaaaatacaaaagaatattagccaggaatggcggtgtgcacctgtagtcccagctactctggaggctcaggcaggagaattgtttgaacctgggaggcagaggttgcagtgagcggagatcacaccactgcactccagcctcagcaacggggcaagactccatctctacaaaaaaaaaaaaaaaaaaaagaattaggcttagggagtgcatggtggctcacgtctgtaatctcagcactttgggaagctgaggtgggcagatcgcttagggtcaggagttcaagatcagcctggccaacatggcaaaaccccgtctatacaaaactacaaaaattagcaagccatggtggtggacatctgtaatcccagctactgagaagtctgaggcaggagaattgcttgaacctgggaggtggaggttgtagtgatccaagatcataccactacactccaggctgtgtgacacaatgagactgtgtcttaaaaaaaaaaaaaaaaaaaaaaggccttaagataaaaaacagtgaaataaaagaagtcatatttttaagaaatgaaatccctaatgtttaaaaattatttaatgtataaaattatcaatttttatacattagggatttcatttttttaaatatgacttcaggctgggcgtggtggctcatgcctgtaatcccagcactttgtgaggccaaggtgggcggatcacctgagatcaggagttcgaaaccagcctggccaacgtggtgaaaccccatttctactaaaaatacggaaattagccgggtgtggtggtggcatgcacctgtaatcctgaccagccagctgagatcgtgccactgcacttcagcttgggcgacagagcaagactccatctcaaaaaatgtgtatattatatatatatgacttcatagacacacattggtctatacaacaaaaacaaagcattaggaaattatctcatgatttagccacaaaattaaaagatttatttcaacaaacacttattgaatgcttacccatttgactggatgatgcgtaggaataacaagaggtctgaggcatagtagtagacccatggagctgatagtttcagggcagggtagacatctaataaagtctttgtttccttttgtaagtttctctaagtttgtttaggatacctattttgacagccatacagatcttcagaaaatagggattatcaccagacaccacaaggaaataggtggaaaaatatttaaaaataaattgtaagccaagcatggtggcccatgcctgtaatctcagcatgtgatttgggaggccaaggctagaggatcacttgaggccaggagttcaagaccagtctgggcaacatagcaagacctatatctacctaaaaaaaaaatttaagaaaatttaaaataagtaaataaattgtagtaaaaatgtaggttatgtttcttcgtctgaaaataagctattctgaaaagctaagctttcccaatggtacatgagttctctctctaattatatcttctgtattcctctctcacttgaataattttcttttgaaaactttctgaagttatatgctttcagactttgtaaaataatatgttgaacatgattaatcatctctcagttaggttcattattttcaatcatattattgtattgtgctgtgataacaatgtccctagaaactggacagtttatagagcagttcgcctgatcatttttgttttttaagtatctttttttttttttttaaagacagtctctctctgtcacccaggctggagtgcagtggcacgatctcagctcactgcaatctccgcctcccgggttaaagcaattcttggtctcagtctcccaagcagctgggatgggactacaggtgcatgccaccacgcctggctaatttttttttgtatttttagtagagacagggtttcaccatgttggccaggctgctctcaaactcctgacctgaagtaatccacccgcctcagcctcccaaagtattgggattaccggcgtgagctactatgcacaccccttaaacatcattgtaaaaatcacttcccttgctataggaatttggctttgagttactaggccttccagaagccatccccatgactttgttatctggcctaagccataggtggggagtggggagggagacatccaaagttaattagaaccaagtataaatttgccatggatttaagccttctgtataagataaattcatccatagtatttttggattactttatttacttgattatttatttacttatttgattatttctgttctcattaattttctaattatgactagacaactaagttctgggtaagatatgtcattattacgtaatgatgtcttattcttggcattataaatgactatactgtgttgtagttttattatatttatgacatatgagaaataaataataggaactttaagaagactctatcacttcatatctctttggtctctttctctgtctttaacattggtcaggttccaaactagtgaaaactacagaaacaagtgcagttttctagtatagtctttcatcttacgaaaatatatttaatccccactcttttttaagtttcactttgccttaaggggagtggtcttaagaaaactcttagtatagttgtgagtatccatagtgtcaaatgaggggaaacattgtaacaatgttaggagccaaagttctcaccacaatctcatcagatgtcctgagctattttttacttgttaactcagaacaacaaatactaaagaaagtgccaaacaacctcaattcttctggctcacacttatatatagcagagatacgaaatagcccgcaatcccagatcttccatgggtaattttgggaaagtgtttttcatagagatgttgaagtccatggaaatcaggtagaacactaaaggacccggttgacccagtacattgcaaccctctgctctcatgtgcacctcacacacagccagtctacggattagagaccaccatttctgggggttgttatcttttttttttttttttttttgatacagagtcttgctctgtcgccaggctggagtggtgcagtggtgcaatcttggctcactgcaacctccgcatcccgggttcaagcaattctcctgcctcagcctcccgagtagctgggaccacaggcacacaccaccacgcctgggtaatttttatatttttagtagagacggggtgtcatcatgttggtaaggatggtctcaatctcttgaccctgtgatccgcctgccccagcctcccaaagtgctgagattacaggcgtgagccaccacgcctggccagttcttttcctttaacttgtattaactgcatagtagttagtttctctttcttctttctttaataggatcatctcaacatatttaaaaactatgccgtatatgtataagatttgccacctctgggtcattaaatggcatcacagacatagaaatgtaccaattccttttttatgaaatttatccattcatgcaaaagaagtatgataattaaaaataattttgaacattgggtatcctaggctctgagcgcgaggctctcagaaaattaaaatgacatcatcatcgtacttgcaaagcttaaagcccagtggggaagagcaacatgatagtaacaaaggtagagtgtaataagtgcggttgcagaatcgcaggccaaggggagctcacgtctttgagcttcaatttctttatctgttgcgggggagagtatctcatgaagctgttttgaagcttatctaagacaatgcatgtgaaaacactgtaaaattataaagctgcggacatgtcagttgtcatgtttggtttaaaatagaagctgggagactctttattctgaaaccatgtagataatccagggatgagactctagttaaagtgaggaaaacaatgtacttgcatgtcaattgcagttcctgggagaatgtttgtattattaggagactctcattccagaaatcattttgttggcatttatactaagtggcgatgacactgagaacagcacagcttcatctgacatctgacgttattgtcagcctttcttagtacccatggtatgtttttactgtatctcgtgaataagataatatattaagtctcctggcatataaggatatatgtaagatacgtgttgtatagttggtttctagagtgtcttcatagcagtcttccagtatttctatttattgctattccctctccacctctgtttctttcccattagttctttacaggtagggagattatatgtcccagtttgcctgtcctggtttatgtctcttgtccctacatcccatctacttaacattttaacaccctcgaaagcgtcccaatttggacctcaccttatctggtcaccctggctcaaagcatagaagaaaattaaatgaagagccagcaaattagtgaaattgtacagatgtgtgataactgacttcagtcactgagctgagctgatttacagagtgtggatttggtccagtaatatcttggaatgcagcttacagatgtaagtaagtagtgcctgattatagctacacactatagcaggtttcctaatgagctgttaaaacgaaagcatgtgtttgttcactgtggcacagaacagtagctttgacacttcagtagttttcaccatagcatggcttgttggggcttgaagactggcattccttcttaaaggcccatcaaggttttcattcactgtgagctatgtgttaagctggtactgatctcgtttttgaccatcattcacccatggcagccaaccagggaggtgtaaaatgcttttgtccccctgcccacatatgcacctcctttggtgtgacccatgggatgacagttgcgatgcagcttgaaaggatggctctacattgcagcttctctgcgtcatccccgttgcccttttagaatgagaaaagaggattgaaaggttcaaaagcctagagagaaaattctgcagtcctgtgtttttctgagcagagggaaaggtgctacttcgtaagactgcttgcaatccccaatataatagaataaaactgtccctactgccagcattaatatgaaatttgtataaaggtggagggattactttactgttttattaatatgcaatcccaatattttcattgcagggcagcttgcaaattcattgcaaattatgctgagttaaaatcaaatacataaatctacctttctctgttggcagctgtattggagtttgggattggcctctgtgcttattagagccaaagaatgtatattatttaattcttgcaaagtgaaagtaaaagatcaggaaataaagacaaatcaggggaatggaacatttttagtgcgattcctcttttactctccagcaagggaaagtggcttaaagatctctgttaaaacagtgcttctcacactttaatgtgagactcttgttatgtagattcttactcctgggtctaggatgggggcctaagattctgcatttctaactagctgtagagcatgctggtgctgctggaccacaggccatgacttgagtagcaggttgtcaggaagtgtgtgcttcagtgggctgtgactctgcatatccctgttgtgaaatatgcagatgagagtggcacacaccagaccctcaactggcaggaggagctgtgttttagctagaggttagggtgagagggaccacccagacttgtaaagcttaagtattgtccccggtctctttaccagtcttaaggtatccctaacagaggcccaatgttcctgctaatgaaatgaataaagaaatgttgcagtccatggatttgtaattccagtaacggcttattttacatctattaaaggctacaaggaaagaagtggagggaagggctggaagactaagaaaataggaaatgagaagaaatgcacaaaggagagttgcatttcctcctgcttctgtcaaaggaaaaaaagatgttatgtgccttctctttccacctctaaataaagcaacagggccaccactaactagtttgtgtgactatattctggctatttaacctctgctatttcacaaaaagtcctcatctgtgaaaggaggaatttggaatcgggacagttttcggaaccccttcaattgttaaagcatagcgactaagaattttatggtcatacaacactaaaaatcatacatatgtccttaggaatggggttttatttctgtaagagcacctccaaaacaagtggtgtgttaatacatgtgcattttatatttttctttatattctttgttctcttccttttaagaaaatctagtttgtttcattgcttcaaaattcctgaaaaattttctgtctttttatataatacagagttggctgtgttaatttctgcttccatcatactaatttaggaaacgtggcctaacagtggcaggaatagctagaactttcttctgtgacttactggcattttccctaagcatctgcatgtgttgggtgtatgtgtaagtaccatgcattggatacatcctctgttgaaaggataaaggaatgcttgttcgttccacaagttaccttggctccaactctgttccatactcagcctgttctctcaacacaatgatgtcttcagtcttaggacagaagtctggagttcattcacatctctattttgattaattgttttacacatcaggctccatataatgtagtggataatgaaatgctctaagtgagttagggattttcagttcttagacttgtggatgagagaatttcaaaaattatctacaaatttaccaacatagataatgtttgtatgatatacagaggttgagttttataaaatataaattgctctgagccagaaatgaaaaataaatgtagaatcccatgataaaaaactaaagttgctatattaaaattaatagtatactgggatttttgaaacattgttttgaggatgtgtttactatgttcaaagcaataaatttaggaatggaatctagtttcattagccctgctataacattttggagagaatataaattaatacctgctttttgaaggacaacctgacattatccattagaatgtgtaggccctattttcttcatctcacagattcatttcttgtaatttacccatttataattaattattgcaaatatgtgtttggaattattggacaggtacagaaagctatatgtagaagtacattcatcagagtgtttgcagtgtgggccaggtgcgacggtttactcctgtaatcccagcactttgggaggctaaggcgggtggatcatctgaggtcaggagttcgagaccagcctggccaacatggtgaaaccccgtatctactaaaaatacaaaaaaattagccagacatagtggtctgcacctgtaatcccagctactcaggaggctgaggcaagagaatcacttgaatctggtaggcagagtttgcagtgagccgagatcgtgccattgcactccagcctgggcgacaagagcgaaactgtgtctcaaaagtaaaataaagtgtttgcagtgtgaagaaacaatctaaatattcaacaataaaggaaggtcaaatgagacaaagatgaaaggggaatactatgcagccataaaagagagatgtggttgttatcttaggaagatgactataatatgaagttaaaagttacaaaggaacatttgggaagaatgtataggtacatacatgcttataaaaccacaagaaagaactgggaagcaatacaccaaagcgttgatagtagtagaattacggctgattttttactttctctgtcatgcatttctttattgttgaatatttagtactagtacatggagagggaatagaaaacttaatttggaagggatggggaaaaagtagccaccctgggagctgagttagaggagaacacagagcccaggtgtttcagcatctgttccggcgttggcggtgggaattctctgaatagtcctcactgtgccagagaagctttctgcgcacagctgggtcctgtgaggcaagacctgtgtcctgctgactcatacacagcatcccatatggccttaactttatttagcaacgtcagctcaaggaagccttgtgttccctttgggcccaggatttagaagagcataatcatagaatgtctgtcaggcctggaagtgtcattagggctgtcctagtctggacatgaagagtctgaggcccagagcatttaagtaacgttcccagagtcccagaggtagttcgaggccaactggaaatgaaaatgcggttcccaggctcgtggtctctctagtgctactactttgcttgtctccaagctctgctctggtggatgagtctccagttctcacaagcagtttttaaggccagagcaaaaggtttccaggtaagagaattttttttgtcatataagagaagattaaattaataggacttttgttcagatctgcattcagtgagatacatggaaattcagaggttattgactttccttgggtctggcctcttttggatatttaataaaggctgcaaaacctttcccttgaacgatgcaagtttgctgaaaaccacaaaactttgcatttgatttcggaggtttcaagagccctgtaaagcctgtccctgggttctgaatgtcctttgtcttgtgctcccctgttttcaagcagttcttttgcatttggaggtaacagaactgtgatctggtttggttttcatacctttgttgcagatatgttttcttcaaataaaaaagaaggagaggatagcaactaggaagatgaacaagcctcatcacattggatacttagtgttgtctttgtgtttacagttgctgttagattgtcattccaataaaagtaaaattatgtaatactttttaaagctcccatcacactagcacaactgctttcattttttgcagagtgtgccaccctgttcctttccacatggatacttcctggttacagccaaagactgttcattatgccctttcatgcttccacatgaaagacacaaactgaggctgaaattgagtggcttcttaccagaaattaggtatttgaataagagcagatcgtttttacttaaaagatgtaagttttgaaaatgaccacatgcagcagttaacacactgatgactggacttacctgaagagtctctgattcagtagcccgttgtggggcccaagcatttctaataagtcctcaggtgatgctgacatcactggtccacggccagactttgagaaacagtggcccagagaataacagtcttagaaggcagggtgttttccaaattttgctgaagacaagaatcagttgagaatgtttgttagaaatgtaaattttaacaccatgtcagactcactgaatcaaaatctctgggagaatcttggaatagtatattaccagatctggaggaactactattctcttgctatcaggtaagccccatagagtgtcacttgtttgcaaaccactcacaggacaatagaattttttttttcaaacactaactcaaccagaagggacaatgtaatatatttaccactcaatcgtttctcatccattgtctgctttgaccctatgagcccatgagcacctagcagcatccacatttttaaatgaattttaagtcacccttctaagacataaatatttttgtttcaggtaccaatatattgtttgaaagagataccagaatacctgctttctgagaatttcctcaagttttactgagttcctttttaataagcatagtcacaatatgcatttgtgtgtgtgtgtgtgagagagagagagagagagagagagagagagagataaagggaggaaggaaaaagaaatgtggttttctgccaagttcaagttccctagtgatggtgatgctgctgatctcggaacacgttttgagaaccactggaatagaccaataactctcaaatgtagcagttggaatctcctggaggagctttgaaatatacttctgctcaggtctcacccccagagattagttcaattggtctttgatgagacctagacagtaattctaataatcatccagccgggcgtggtagctcacgcctgtaaccccagcactctaggaggccaaggcgagtggatcacctgcggtcaggagctcgggaccagcctggctaacgtggtgaaacctcgtctctactaaaaatacaagaaattagtcgggcatgatggcacacgcttgtaatcccagctactcgggaggctgaggcaggagaatcgcttgaacccgggaggcagaggttgcggtgagtggagatcactccattgcactccagcctgggaaacaagagcaaaattctgtctaaaaaaaaaaaaaaaaaaaaatccaagattgtgaaccattactgtaggttgctccagataaaaggtaatgggttaggaagcttaagacttgatgaggaaaaataaaggttaaaccagtgctccttccacttcagtgtgcatacaaatcacctgggggtcttgctggaatgcagattgattctgtaggtctagggtagggcccaaaatgctgcttttttaaatcaagtcaggcagatgctgctaagattgcccaggggtctacactttgagtagtgaggtggttagaaagtgttgacctatgtaagtgcttatcaacacacagtttttatatatttttacgtagtatagaacaaataaaagcaatgtcattgagatttcagataccttagaaacaataaatattttgccattaatgactatttcccttcccttgatggctaaaacgttttgtttttgcttctccctacctgcttactcagagtttcaatcaaatgtttgtaaattaattttgctttagtatgacacatgtagtaacaggcctttcccctttgtaactgagtcccaggattcacggagtttgaggatcttgccttctggcttcctccttgcctcagaccctgccctttaggggttactgccctaagaggctgaaagtttagtaatgccccagagcctcgttgcaggagctagtcacttttggcactttcttgctgtcagaccgcaggctctgggagccagtcttcttgggacatggcttcatcctgtgtctctggcttgagcccaacctttcaggcctgggttaggggtgaagccttttatctggcaggtcccacagtctggcgcctttcccagcgtggtggagttgagaccttgctgtcagagcctgttcagaaggagagagggagagacaagaccttcgcgtgaggaggaaagagtttaagtcccgtctgtggaatctgtttcccctggcttgttgaattttctcagctgaacatggcagaagtggttgatatttgaattagaggctatgaaagtgtccttgggaaatgggtggggctgagccagtggtcttcccttttgcctctacctcatgctgaccaggggacaaggctctgtctcctgggtgtggcctgtcattggtcagtctgtgaccatactgctattctccaaggcattcctcaacagaatgggatcaggctttttcagtcatttcccatttttaaaggacatctccatggcagatgcccctactccctcccggtgcctgaatatttgcctgtctagcgtgggtaggtgaacgtcagcagaactcttgaagaatcactaaagggatgtgcttgtcctagcaggagagcctgtgacaataaaaaagcagagaatgttctgagtctcctgtattaaaaagggaaaagcttaagtgaggtttatttccactaaaggatagcaacataaggcagcttgacctttagtgtgactggagcaccgtaaatgctacttctacttttttcctttttttttattgtggtgaaaaacacatagcatagatttgccctctgaatgtttaagtgtacacttcattattgttaactgtatgcacaatgccatgacagatctctagaacttttccatttcacatgactaaaatgctgtgctcatcaaacaactctgtttccccctgtgccagccgctggcaccaacctttctactttctgtttctatgactttaattacatgtatgtgtcatagaaatttggctttttgtgattggcttatttcacttagcatagtgtcttcaagtttccattctattcatgttgtagcatgtgatagaatttccttttttgtaggctagataatagtccattgtatgcatataccacattttccttaggcattcatctgttaatggacttttaggttgcttctgcatgttggtcattgtgaataattctgtagtgaacatggggatgcaaatgtctcttcgagttcctgtttttagttcttttgggcatatacccagaagtagggttcttgaatctcatggtagttctatttcttatttttttgaggaacctctatactgttttctgtagcagctgcaccattttacagtttcaccaacaactctcaccaatgtagggttccagtttctctacatgctaccgatgctttgtttttttgttgttgtttgttcttgtttttttttaatagtggccatcctaatgagtatgaggtgatactgtggttttgatttggttctgcctttttaaactccaaattcagtctctggttacagcttttcccataaccattttcaggtgaggtgcgtatgctgcgttggtaacataaatttaacattgtgagagcttttatcaggcagcaaattgtaaagccccttctaggtcagacagttgacctctgtaaagcttaagttaggaacttttatgttcttaataaaacacaagaaaatatgggaaatttccatttggcatgagcctttctgttttcttggtggtggtggtgtgggggtggtataggctctccctaaattgcccaggctggaatgcagtggctcttcacaggtgcaatcatagctcactacagcctcgaactcctgtctcagcctcacaagtactgggactacaggcatgaaccaccatacccagttccattctgctttaaacagtggaaaaaatacatgtattttttaaatggaagggttggttatatcttcaatgtgaaatcctctatgtgaaatctaaataaactattcctggaatgtccagtgtcctttccccgtgatgataaacaaagcccagagctgcctctctttaaagatagtaagaagcctatgcataaacaaaacacttaaaaataagatcatttattttattttactcatccgcttaaacccatcaatgacttttaacttagaagaaaacctagtcttcctactatgaccaacaggactaagcaaatctcataacctagcctctgcttacctctcacttcagcccaacctactctttccctctcttaaaaactcagtagctgaaatatatggagctctttctggccccgagcctccagaccttttaaagaaaaaaaaagattgtaattttgatgaagaccgcattgtcaatttttatttctatggctcttacttttggtattatgtctagacctctctaagccctaggtcttaaagatcttctaggttttcttaagttttatagttttttttttaattttagatttaagattcatttggaattaacttttgtataagacagacggttaagaagattcattattttgactatagataccagattgctgtagcactgtttgttgaaaagactttccttccttttctgaaagagtttttcttttctgaaatgcctttgtcaaaaatcgcataggcacatctgtgtgggtctatttctgggctgtatgctgttcctgggaccatttttaccttccacctttcccctagttaactcctacttatccttcaggtcttagtttcaatgttgtttccgtggaaagacccttaaggaccacccattcctatacatctgcataccctcaacttcagtcctaaggaagggtacctctgttattctcactcaacacctgtttttttctccttcgtagcatttagcataatacgtttataactttttttgtttgtgcacatatagttcgtgcctataagcctcaaaaaggcaagaactgagtttattttgttcaccactgtagtgcccagcactgtgcctattacatgctgagttctcagtcaatatttttgaataaatgagtgaaacaaagttaggcttcctgggggatgttttctaaatccctaggtatcattttcttaaaattagaggatattcttggctcttggagccttagggcataatttttttcccagttaacccatctttgaagatagggattttgagaacttttggcctacctcagggtcacctagcgggttatcaaaatgcagattgcagggccccaaacccagagttcctgcttcagtaggtctgggatgggccccaaaatttggatttctaataagttcccagaaaataatgctgatgctgctgttctgggaacccactttgagaactgtattagtctgttcttgtactgctatgaagaactacctgagactgggtaatttataaagaaaaaaggcttaatcgactcacagttccacaggctgtaaagaagcatggctgggaagcgtcaggaaacttacagtcatggtggatggcgaaggggaaggtggcacgtcctatgtggtgggagcaggagaaaaagagggaagaaggtaatgctatgcactttcaaacaaccagttctcgggggaagtccgcccccatgatctaatcacttcccaccaggcccctcttccagcacggaggattataactcataagatttgggtggggacacaaatccaaaccgtatcaagcactagtgttttaacgttaagaatctgaagaggcccgagtcactgagccgccactgccaaggactcatctcccccttctcccgccaccgcccgcttttgcagccatttccactgaggaaaaacaatcgtatgtccacagtccagaacctccactctttccacccctttgctgatacaagtaagggtgatacctgtcctgctggcactgaggattatatccatataagaattcatccaacagagaaatggcaggaagacccttactactgtccaagggactgctgatgattatgataaaaagaaaccaatgaaggcatttaaaaagaaatttgcctgcaatgatactgtaattgagcatccagaatatggaggtcattcagctacagggtgaccagcacaagaacatgtgccagttcctcttagagattggaatggctaaggacaaccagctaaatgttcatgggttttaactgctgtggctcgctgaagcttgaatgaggttttccttgcaatgagtagaatttcctttctgtcccttgtcacaagtttaaaaacctcacagctttgtataatgtaaccatttgtggtctgcttttaacttgacctagtgtaattccttcatgcagtaaacttgaaagagccatgctgtctagtcttgaagtccctcatttaaacagaggtcaagcagtaggcgcctggcagtgtcaagtctgaaacaaagcaatactgtcatgtttcagccacacctagacccctaagatcatagacaactacgtctggccagaagctcctccgctctccctctgcagagttccctgccctaagagactgtcaccacccgaacaatcctcggtgaatctaagaggagaggatggggtaaggcagcaacagcaactctaccactggaagggagcctttggtggtcaaagaaagatcccctggtgtctataacctgaccaggtgcagagttttagagaggcccccttcccaatagcgaggtgataggacatctggcttgccacaaaggtctttttgaccagacatgccctagctaagggatgtccaaacaccagaatgtgagaccaaccttccatcaaagttaaacctttgacaagggaacaaatctcaaaactgatgtaccagtcatgtagctagctgtagagcttgcaacttaatggcaacagctgtccaatttcatggaaagtaaccaactggttttgaggtttgtttgtttttttcccctccagttttaatgttatgtgtaatgtatttaaaccccttttttaaatttaagttctagggtacatgtgcacaacatgcaggcttgttacgtatgcatacatgtgccatgttggtgtgctgtacccattagctcgtcatttacattaggtatttctcttaatgctatccctcctctcttccccctccccacaacaggccccagtgtgtgatgttcaccgccctgtgtccaagtgtgctcattgttcagttcccacctatgagtgagaacatgcagtgtctggttttctgtccttgcaatagtttgctcagaatgatggtttccagcttcatccatgtccctacaaaggacatgaactcatcctttttaatggcggtatagtattccatggtgtatatgtgccacgttttattaatccagtctatcattgatgggcatttgggttggttccaagtctctgctattgtgaatagtgccgcaataaacatacatatgcatgtgtctttatagcagcatgatttataatcctttgggtatatatccagtaatgggatcactgggtcaagtggtatttctaattctagatcgttgaggaatcaccacactgtcttttacaatggttgaactagtttacactcccaccaactgtgtaaaagtgttcctgtttctccacatcctctttagcacctgttgttccctgacattttaatgattgccattctaactggtgtgagatggtatctcattgtggttttgatttgcatttctctgatggccagtgatgatgagcattttttcatgtgtctgttggctgcataaatgtcttcttttgagaagtgtctgttcatgtccttcgcccactttttgatggggttgtttgattttttcttgtaaatttgtttaagttctttgtagaatctggatattagccctttgtcagatgggtagaagccaaatgatgagtgaactcccattcacaattgcttgaaagagaataaaatacctaggaatccaacttacaagggatgtgaaggacctcttcaaggagaagtacaaaccactgctcaacaaaataaaagaggacacagacaaatggaagaacattccatgcttatgaataggaagaatcaatattgtgaaaatgaccatactgcccaaggtaatttataggttcagtgccatccccatcaagctaccaatgactttcttcacaaaattgggaaaaactactttaaagttcatatggaaccaaaaaagagcccgcattgccaagacagtcctaagcaaaaagaacaaagctggaggcatcacgctacctgactttaaactatactacaaggcttcggtaaccaaaacagcatggtactggtaccaaaacagagatagacactaatggaatggaacagaggcctcagaaataacaccacacatctacaaccatctgatctttgacaaacacaagaaatgaagaaagcattccctgtttaataagtggggctgggaaaactggctaactatatttagaaagctgaaactgcatcccttccttacaccttatacaaaagttaattttttttttttttgagacagggtcttgctctgtcacccaggctggagtgcagtggcgcgatctcagctcactgcaatctccacctcctgggttgaagtgattctcctgcctcagtctcccgagtagctgggattacaggcacccgccaccacgcctggctaatttttgtatttttagtagagatggggtttcaccttgttggccaggttggtctcaaactcctgacctcaggtgatccacccaccttggcctcccaaagtcctaggattacaggcgtgagccaccacgccaggcctaaacccttatttaactaaaacttgttttcagaaaaaaataaatctgaggatgtgttacatgtcccccttttacttagtgacagtcccaggcacacacgagcttgtcattaacaatattcatcaatttaagagttgatcagagaaggtcatacaagaatccaatctcagtggaattaaaggaaaaatttttgctaagcagaaaataaatgagaactgtacatttaaaataaataaatgaacagaaagcctttcaaatcgtactaaactaacttatatctgtggctactacattgttgttctttaatgcttaaataggtaaaagcactgatgttttagttgaaactaccagcagtaggaatgcttgctcagtaagagcaagaccccactaacacagtcatatttataaagtcaaggtttaggtgtctgccagggtctgttttccctaaatctattacaaacaaatgaaagcaaatcagtaaatactgttttaatgtacctataccgagtcataaaattattttcctcccaagtcaggaagaaacataaagttggttaactgaaaaagagaaagtttaatcattctgattttcattctgatgctcttctttagactatctattgctgctttcttttgtagcagaacagctgattttccgcctaggttttcatgatctgataaaccttcaccatagacagtttcttggaaagaaactctggaagtgtcagttatctttaaatgttcaggaagctgcgtgggtctcagacccagctggagcagagccagcacgggattctgaaagcatttgcaggctctgagatggttttaacctgttccttggcagtgcagcccttgtgtacactcttggaaagatactgatgtttactttcatgatgtagaatggatgagcagtgaaggtttctaggaaggttgaacacactcatgcccactttgggacacaaggaggcagatgctctcatgggaactcttcaaataaggtcgtatggtttggctgtatcctcacccagatctcatcttgaattgtagttcccataatctcgtgtgttgtgggagggactcgatgggaggtaattgaatcatgggggcagttaccctgattctgttcttgtaatagtgagttttcatgagatctttacacttgattaatgttaactgtagttgtcctactgatctatcgaacaccaagtcttatttcttctaagtgtatttgtacccattaatctactgctcttcattccccatccccactacccttcccagcctccggtaaccactagtctactctctatcctcatgagattcagttttgtagctcccacatatgagtgagaacatgcgacattgtctttctgtgctttgcttgtttcactgaacataatgacccccagtttcatccatcttgctccaaatgacaggatttaattctttttatggctggataatattctattgtgtatttttaccacactttctttttaaatatttattattattttgtagagacagagtcctgctatgttgtccaggctggtctcaaactcctggactcaagcgatccacctgccttggcctccacattttctttattcatccattgatggacacttaggttgattccatattttgtctattatggatagtgctgcaataaacatgcaagtacagatctctcttcaatatattggttttctttcttttagagaaatactcagtagtggaattgctggatcatatagtattctacttttacatttttgaggaacctctgaagtgttttctatagtggctgtactaatttacattcccaccaacaatgtgtgaggatttttctttctctgcatcctcaccagcatgttattccctgtcttttttgataaaagctattctaattggggtgagattatacctcatcgtggttttgatttgcattttctggataattactgatgttgagcacttcttataccctttgttcatttgtcctctgttgagaaatacctgttcaggccttttgccctttttaaaatcagattaatgactttttgctattgagttgtttgagctccttatatattctggttatttatcttgtcagatgggtagtttgcaaatactttctctcattctatgggttgtttcttcaccttgtttgagtgtttcctttgctgtgcagaagcttttcagcttgatgtaatcccatttgtccattttcgtttttgttgcctatgcttttgagaacttaaacaaaaaatttttgcccagaccaatgtcctggagcatttccccaatgttttcttttattagttttataatttcaggtgttagatttaagtctaaatccatttgtatttgatatttgtacatggtgagagatagaggtctagtttcattcttctacatacagttgtccagttttcccagtgccatttattgaagagactgtcctttccctgttgcatattgttggcacctctgtcaaaaattagttggctgcaaatggcatggatttatatctgggttcactattctgttcagtcggtgtttgtgtctgttttttatgccagtaccgtgctgatctggctactatagccttgtagtatatttttaagtcaagtagtgtgaggcctccagctttgctctttttgctcaagattgctttggttatttgtggttccatataaaatttaggattgtctgctctgtttctatggggaatattgttggtattttgatagggattacattgaatcagtaaactgctttgggtaggattgtcattttaacaatattctttcaatccatgagcatggaataatatcttctccattttttgattcatcttctatttatttaatcagttttttatagtgatccttgtaaagatctttcacagctttggttaaattgattctcaggggccaggcacagtggctgacacctgcaatcccaacacttcgagaggccaaagcgggagaattgcttgagcccaggagtttgaggccagcctgggcagcatagtgtgacctcatctctaaaaaaaaatcaaaatattagccagacgtggtggcatgtgcctgtggttgcagctacttgggaggctgaagtcagaggatcgcttgagaccaagaaatcaagactgcagtgctcactgcattggtgacagagtgcaaacctgggtgacagagcaaaaccctgtctcaaaaaaaaaaacaaaatattcctgggtattttacattctgtgtagatacaataaattagattactttctttctttttcagattgttcactattggtatatataaatgctactgaattttgtatgttggctttgtatcctgcagctttactgaattcacttattacttctaatagttttttggtttttaaaaatagaagatcctgtcgtttacattcaaagcgaatttgacttctttctttccaatatgaacacctttatttttttttcttgactaactggccaggacttccgctttatgttgaatgaaagtagtgaaagtgcacccccttgtcttgttccagatcttagtggaaagccttttaggttttccctgtttggtatgatgttggctgtggatttatcatatatggcctttattattttgaggtatgtttcctctgtacccggtttgttgagggtttttatcaaaagggatattgaattttattgaatacttttcagcacttattgaaatgatcatatggtttttgttcttggttctgttaatgtgtatcacatttactgatttgcatatgctgaaccatctttgcatccctggggtgaatcccacttgataatgttgaatgatctttttaatatcttgctgaattcagtttgttaatattttttgttgaggatttttctatctgtgttcatcagtgaaattagcctattgttgtcttttttttttttttttttttttttggtggccttatctggttttggtatcagggtaatgcccgccttgccggatgagtttgagcattccttcctcttcaatttttttttttttgaagactttgagtagaattattatagttcttcttgaaatgtttaatagaattaatcagatcctcgacttttctttgataggagagttttaattatagctttgatcttattacttgctattggtttgtcgaggttttctctttcttcgtggttcaattttggttgtatatgtccaggaatgtatctttgtcttctagatttttcaatttgttggcaattgtctctaatgattctttgtactcctatggtctctgttgttttgtatcttttttgtttctgattttatttatttgggtcctctctttttagttagtcttgctaaagttttgtcagtttttttttaactaaacttttgttttgttgatcttcagtaatgttttaatctcaatttcatttatttttgctctgatctttattatttcctttctcctagtaaatttgggtttggcttggtcttgcttttctagttccttgagatgctccattattagtccattattaggttgtcttttggtagtctttcaacttttttgatgtagatgtttattgctataaacctccctcttagtactgtgtttactgtatcccatagatttggatatgttgtgtttctatttttatttgttttgagaaatttttaaatgttcttatttcttcatcaactcattgtttattcaggagcatgttgtttaatttccatgtttttgtttaatttccaaaggtttttttgttttgtttttttttttgagatggagtctccctctgtcatccaggctggagtgcagtggtgcaatctgcaacctccacctcctgggttcaagtgattctcctgcctcagcctcccaagtagctgggattacaggtgtacaccaccacacccagctaatttttgtatttttaatgagacagggttttgccatgttagtcaggctggtcccgaactcctgacatcagatgatccacccacctcagcctcccaaagtactgggattacaggcatgagccaccacacctagcccaaaattcctcttgttattgatatctagttttattccattgtggtcagaaaggatacttgatatgatttctacttttaaaaatttgttgagacttgttttgtggcctaaaatatggtttattctggggaatgttccatgtactgatgaaacgtgtattctgaatagttgagtgaagtgtgttttataaatatcagttggacctatttggtctgatgtgtagtttgatacaatggtttctttgttaattttctgtctagatgatctgttcattggtgaaaatggggtatttgacgtcctccactattattgtattataatctctctctctctttgtatctattaatgtttgctttatatacttgggagctgaatttcagtccatcaaatgtattaatcagttctaagatttctgtttgattttttgaataatgtctctttgttaaatttctctgataaatttctgaatggagaattaccgttttgtttcttgttttctggttgttttgtaactcttctcctcctttcttcctgtcatcctttatggttaagtgactttctctggtactatgttttaatttgttggggttttttttagtgtgtttatcataggtttttacattgtggttaccatgaggcttatagaaaacatcttatagataaaacaagttattttaaagagatgacagcttatcttagataagcagtccccagtctgttttggcgccagggaccagtttcatggaagacattttttccatagatcaggcagtggggatggttttgggatgaaactgttctacctcagatcatcaggcattagatcctcataaggaacgctcaacctagatccttcgcacttgcagttcacaatagggtttgcactcttatgagaatctatgctgctaatgatctgacaggaggtggagcaggcagtgctgtgtgacctggttcctaacatgcgacggaccagtactggtccatggctcaggagttggagatccctgtcttagatcacaaaaaaaagaataaataaaaaactttaaaacaaccctccatctttaattccatcccctgacattttgacttttgtgggcctgaatttacgtattttgatattgcctatctcttaacagattgctgtagctgttagggtttttgatagatttgtcttctaggtgtcatactagaattatgggtaacttatgggtggactgcacatgacaattagagtatttgaatattctgggggtttctatacttgatgttacctgtaggttttataccttcaaatgttttctttttgcacattaatgttttttcatttcagattgaagaaccatctttaacatttcttgtaagacagatctagtagtggtaaattctcttagcttttgtttgtcagaaaaagactatctctccttcatacttgaaggatatttctgctgtttgctggataaagtatttgaggatagcagggttttttggggttttttctttcagcactttgaaaatatcattccacttcctcctgacttacggtttccattgagaagtgtgttgccaactgaagtggagtttctttgtatgttatatcctccttttttcttgctgcttttagtatcctctttttgtccttgacctttgagagttttattattatatgccttgggtgtagttttatttgggtcaaatctgtttagtgttttctgaccttcctctacctggatatttttctcatattttggaaagttttctgttattatttattgagtaagcttttttctacccctcactcttgctcaactttctcttgaacaccaataattcttagatttggtcttttaaggtaattttctatatcttgtaggcaatctttgtataatatatttccattcattttactttttctcctctatgtaatttcaaagagcctgtctttgggctgactgattctttcctctgcttgatgcattctgctgttgagagcctccaataaatttttcagttagcaaatatatttttcaatttcaagattcgtttgattttttatcacttcaatctctgttaaattcctctgataagtttctgaattgcttttctttgttgtcttggagatccctgagtttctgtgaaactgctattttgaattcttggtcagagagctcatgaatcaccatctcattagggtcagtcactggttccttgctttatacatttggggaggtcatggttccatgttcttatggatatatgtctgtgtctttgcattaaaggatttattatttattccaatcttctctgtctagtctgttttggtttttactggtatgtttgcttagagattatttgtaatttagctgttgaatttcttacacatttttcccgctaggtcactgcctctttttcagcactaaatggtacttaaaacccaggtttgcctctgttcttctagcaaaggatcagaggattgcctggctggaatgggggaggttgcaaaggagctatccctgtggtatggaaaggctggctaggagttcatgcccaagagacctgtggaatctacctcctacagcatagtgctgccgaacacccactctgatttggcgtctcctttggttgagttacagagcggagcttccagggctggagatggtaatcctgcctccttcctttgtgtccggctgtccacagggtggtatctcccttcaggcactcctgatgcttctcatgggttgaggcatggataggtctcctgccaaagaagccaagatggtaggcaagttgtgtgtccaacttaatctcactttttccagtgtagaatctgagttgggggaagttttacatgtgcttgataccaagcagattgggggaagggtgtcacagatatgaaaatctgattctcttactgtctgctggagtttttttttttttttttttttttttttttacttctcagtggccccaggaactgaccgattctctttcatgagttctgagagattgctggtgataatctcgatggtgtatatttattttggttattctgtggggagaagtgaagccagctttcatctacatttttaaagtataattcttattttgagtggcaagaatctgattccagtatcctgccttagtttttatgcatttttgaaattcctaccattgcatttagaaccttctacctggtggagttttttttttgtttgttttttgtttttcagttttggaagtatttgattttttgaaacagttgacattcatataaagaacaaggttgataatcaagcctgctctagtaattctgtgcagtctagaaaagagtgtactggggccgggcgcggtggctcacacctgtaatcccagccctttgggaggccgaggcatgcagatcacaaggtcaggagatcaagaccatcctggctaacacggtgaaaccgcatctctactgaaaatacaaaaattagctggacgtggtggaggctgaggcaggagaatggcgtgaacccgggaggcggagcttgcagcgtgccgagatggcgccactgtgctccagcctgggtgacagagcgaaactccgtctcaaaaaaaaaaaagagtgtactggttaagtactgagaagcatttcctgtgtgtctcatgtaagtacttcaggctcttaaatgtgttactccaaggaataaggttgcaaatacagttgctctaaaaacatattataccagcctggccaacatggtgaaaccccatctctactaaaaatgcaaaaattagctgggcatggtggtacacacctgtaatcccagctgcttgggaggctgaggcaggagaatcacctgaacctgggaggcggaggttgcagtgagctgagatcgcgccactgcactccagcctgggctacagagcaagactccgtctcaaaaaagaaaaaaaattacataaaattccgagatgcagctttcttatctaaaaaggatttgcgcaaagcctccttgcagtaagcatataggtaactaaggtgtctaccttacgtatatgcatcactcatttatgccctaagttctcatttgttaaaacaatagtgcccttactctaaatcacataatcacaagagccctagggctgaattgctcagctttaaatgtcagcactgtcatactagctgtgtgatgtgagcaagttctaaaactccctgtgcttgtttcttatgtatacaatggagagaaggggtagtactttgtagggttgttgtgaagtttaaacaaggtaataactgttaagtgtttttaaaagtcccttgaatgtaacaattgcatcagtggtaaggtatgcatttttctcatatggcctctgaaatgaggatgtgtcttataatgaatgtaatttcttaataagcattttatcatttagtgacatcttttttattagtagtacttaatgttacactttgggtgacattttatatttcaataactaatagtaagaggtctattaacattagctgccatcaacattaccatcaatattatcatcagcattatcttgtttctaactgagatagtggcatttgatagtttagcagtgctagagtatatatcaaatctcaattttatctaactacttgtttgcattggtgtatttttatcaaagttctagtgtgctgtttttcatatttgtatcattttagctaatgtaaagtatttatggggtcagctcatgcaatgtttccgtcattcattgtaccttacttggcgatctactaaaacatgcatcagcatccttcagtctcccgaaataaatagacacaaagacaaattctttattttctctgttgatgtattttcctaaatcgtttcgcaggagtggtttctttcttagctaggagaactaagccaccattgtaccacttaagatttactggtttgcactgtcctctgagggagaaaagaagcaatttattgatctgtaacacaggaatggactgtggccaaaccttttctggtttatacaatgcaccgacataagaatctgcatagcattaagaagaatgagcactcacaatttgaggccgcctgtcagcatgaataataactgagaaaaatcaatacacaatatacaactgttctctttgcacagacactgccaggattcacacccagtgacagtgtcttcttttttttttttttttttttttttttgagacagggtctctcactctgctgtgcaggctggaatgcagtggcgtgatctcggctcaccgcaacctctgcctccctgttcaagtgattcttgtgcctcagcctcccaagtagctgggatcacaggcgtgtaccaccctacccagctaatttttgtagttgtagtagagatgggattttgccatgttggccagcctggtcttgaactcctggcctcaagtgatccacccacctcggcctcccaaagtgctgggattataggcgtgagccaccgtgcccggccaacagtgtcttgttattttaccagtgatatgcttacagttcctaattttaggcttcctccttattttggttttattgttcagtttggggaagggtgggaggcaccaatttggatctgagaaaaagatcttctgccagatgaaagagtttcaataacaggagaggaccttgggccaaagtttattaagcttgactaggaagattctgggcacatctccatccaaataccttgacacatacttcattcacccctagcacatgcagcttgtcccttcttgtcttctgtttgccttcaaggttttacatggtggtatttacaagccgttatggagcaagagtgcaaacacacaaggctagcaaggggccagtaaacagggtttggcttagggttttgtggttgttagcttttaaaagcatacttagttgaataattccagaaactgggcttctttcctttgccccttcatttgcccctccctctctggtcttcccagtctccacttttttttttgtttaaataaaactgcgtttgtcagaaatgtatagacattcactcctattcttaaaagacagtgtttatccctaatgcctgccttttgattcagccagcagtgactgtgcacacagaggttattgctctccaagttcaatgttgtggacctgaaccagtgcctctgtttccaagagaaagtcaggtgattaccccttcatcagggagattggagccatcctatccttctggtgtgtcaccagccagaaactaaggatcagcagggagtggatggtttagaatctcctctctccaggtgaacacaatgctagtcagtgtagctggaaaagccacgcagcgggcaggcttgtcagaagcaatctgtttaaaaaaaaaaaaaaagagagagagaaaaaagggtccttttgaatttacactgagttgctttcacagtagttagctttgaactgtggtgcaaacccatttaaacaatgagggaaatttcactaagtggcaagaaattctcaccctgtgtgatcaaagcaatcagccatttccttttctttcctttttatttacttatatttctgaccccttataatcttcatgattgtagcctgatagtttccttttttgaatagcatttaaaaaaataccttttcttttccctgagggttttaaagcaaataagacagaaggggtctaaatttttagttttgttttttgagacagtctcgttctgtcgcccaggctggggtgcagtggtgcaatctcagctcactgcaatctccgtctcccaggttcaagtggttctggtgcctcagcctcccgagtagctgggattacaggcgtgcaccaccagccttggctaatttttgtattttttagtagagaagaggttttgccatgttggccaggctggtctcaaactcctgacctcaggtgatctgcctgcgtcagcctcccacagtgctgggattacaggtgtgagccaccgcacctggcctaaatatttatttttaataatgattattattacaaaagtaagaaaagagctaaaatccatgatttcatcacccagaggcaaccaccacagtgaacattttggtacaattacttctcatcgtttaaatgtgtacatatacacatacatatttttaataaaattaggtttaggatagtatacagttttgtttttcttttaaccaacatactttgaatattttgccttattaaaaacttatatgatttcaatggctgcattagaattagtgtatacagatattattttggcattctgttgttaagaggtcatgtgggtttctgaattgacactttaattctcaacttagaatttatttctcccaacttcttctgatttcatgggtctagagtcagagtttgggcacaatggaaatgggatttctatatgtactgttgtttactgtttgctagtatttttcgaaaggtatttgcaaaaaccaaaggggaaacagtatacttttttgtatttttttttctttttttgttttaaattttgtgattgaaatataagtcttattatggtaatctcaggtaacttttaaatagaaatatcaatgcaaaatgaatatattgcccaatgtggaccccggtgtttcagaactatgtgccatgctctatcattttgttactggaaaggggtcttaatccagaccccaagatcttggatctctcacaagaaggaattagaggtgaatccatagagtaaagtaaaagcaagtttattaagaaaataaaggaataaagaatggctactccataggcagagcaggagcgtaggctgctcaactgattatacacacagttacttcttgatgctaaacaagaggtggattattcttgtgttttgcaggaaaggggtgggtagttcctggaagtgaggggtcctcccctttttagaccatataggataacttcctgacattgccatggcatttgtaaactgtcctgctgctggtgggaatgttttttagcatgctaatgcattataattagcatataatgagcagtgagaatgaccagagatcactttcatctccatcttggttttggtgggttttggacggcttctttaccacaacctgttttatcagcaaggtctttgtgacctgtatcttgtgctgacctgtctcatcctgtgactaagaatgcctaacctcctgggaatttagacttaaaataaaggtctcagccttattttatctagcccctactcaagatggagttgctctggtccgaatgcctctaataatttgaagtttatccaacggcacagtgggagataatgaatttttgtttaagaggaggaggactgactggatcagatttgtgctttagaaaggtggttgcatgtaagaaagaggcgttggtagaaagacttcggatatctcaaaagaatttccatgaagttaatctttttaaaaatgtaaacatttggtgcaataattgctttgaaattgcagttgaataaatgaactttttgaaccagaatttggaaaggaagatatgcttaaaaaccaaaaatatttcgtagagtgctacacattaggaagtcatttgtatttggtgaccactttcctaaaatagtctcatttctagagaaccaattttgtttcccatagattattatgtgtagagaccccctttcagtatgtagccactggtacatccgtgggtgttatctccatactgccaggtccaatgcagtcacctcctggatctatagtctttctccccccattccgatttcctttctctgttagcagtcatctttgtaaacagaagtctaagatttagtttgtacattttttaaatgatccattttgatggggctctctttattgtttcaggttgaatgcctttgagaacttgatgcataaaatttgcatgactcctcactcctttctggatctctcattggactcaagccagcatggctcacaccacaaaggttaacggcagtgcctcaggtaaccctgtgctctggagtttgtgtgttaaatgtatgtcttttctcaaactaattttttattctctttaataatgaacggataatagcaagttgcctagataactaggatttcaaagcaattttctgtccattgaagtttgggtttgttttgttttactctcagaaaatttgcttttatcttagagtcttgcactgaaatcaattgagtaaattattacctaagtcaattctgttgaagtgttgaaagacaaatgtaaatactgaatgctgatgcaaatgtaatgtatactcctcttgcacttctttctgagggattgaatgaggagagaggaaattagtttggatgcttaaaaccaattcctagtagccactcccaagcagcttttgtttgatgttgctaaacaaagagaaaggagggaagagaagtatatattctgtaaaatgattctcttaggaatatgcaacaagccatattatgaatcataaagacctgtatttgaattcttattttggttatattagagacttacatagtttcactttctgttccaatattgcttctgtgagattcgggagaaatctgtacacgaaatgcagagaagatcctcctaagagacacatcaccatagggacaacctgcccaaaatggcgtgccaagtgttcatttcttttttgagttatgtgccaaatagctgaatgagtaagaatagtaattgtctatgcagaaattttttctgagcgtctgagtccagactcctacgtctgctggctctgaacaccttcaaatgacaacattatatactggagcaagtgtagaattggagccaggaaacctgaatttgagtcctagttccagcactaaccgtgaaatattgggcagggctatttctccacatgtaaaccatcggtaagtatatccacctgccggtttaggaccagtgagcgcaccagaaacatacttagaggagctatgtaagccgtaaagcacttttgaagacaacagcaggaagtgacctctaaagtgggcattcccagcccatgaatgtgactttttattctagcggtctcagctgcaattatctcctctgggtagaacactataacccaaacccagataaactcagttatttgttctgggatgactgatctttccctgtccattccatttttgaccttttttactgcccagcttcttgagacttttatagattctgctgtgggactgctatcaataataaagacatgaatgataatatctaacattcattgaacacttaaatgcaccatggtgcctaaaatgctttgcctgcattttcatacttaatcctcacaataatctaatgagattaagctattattttactgtcatcatcatccctatgtaatgtcacagagaagttcagggacttactgtaaatgaagtaagaaaaatcagaattatgggcagtggctcacacctgtaatcccagcattttgggaggccgagggggatggatcacccaaggtcggtagttcaagaccagcctggccaacatgacgaaaccccatctctacaaaaatacaaaaattagccaggcatggtggcgcatgcctgtaatcccagctacttaggaggctaagacaggaatggctggaacctgggaggcagaggttgcagtgggcccagattgcactactgccctccagcctgagtgacagagtgagactccatatcaaaaaataaaataaatcagaattatgatgactttctccagtaaaatatttggtgagagaggagattgaaacattatgaaatttcaagtgtagtgggtgggttttaattccctctgatgatgtggtttcctcccttgccctccatttgcttccattcacatgctcaggggaaggggtgtttaagattgttggtgcctcaagacctcaaccttcttctggtgccttgggcaaaatcctttcttcatgggtttagatacctaccccactaattcctttccaacttggtttgttctgtacttaccttttttctttgttcctgagatctaataagcaagctgtaacttttccttcccacctggtatcctgcctaacaggtctgggcattgaggttgaaggcaaaagaaagctctccgatttgtgactttcagggtgtcagagtatgaattgttactgcagacagttatctggactgtgcaggggaagattttttacttattctagtcaccatgacccatgtacatctataagcaaatctaattagagactcaaccataaacagtaatatatatgcaaacatacatatatgtgtgtatgtgtctgtatatgtatatacacacatagtaatatatacatacatatatgtatatacaaacacaaatgtgtgtacaccatatatatgacactcatagaaaaaaaaaatttttttttgagatggagtcttgctctgtcacccaggctggagtgcagtggcacgatatcggctcactgcaacctctgcctcctgggttcaagtgattcttgtgcctcagcctcccacgcagctgggattacaggcccatgccatcacgcctggccaatttttgtatttttagtagagatgaggtttcaccatgttaaccaggctggggttgaactcatgacttcaggtgatctgcctacctcggcactttgggattacaggcatgagccaccgcacccagctgaaaatttaaaagtatagatgtgtgttgtattgtctgaaaaccaaaacaaaagcaagaattactggtgataataccacctagaaataaatgtcttcctattttttatatagttgtcaaatgttatatatttcacatggttgagaatatgttaataaaaatcattcctttaccttttcccactttgtattacaaaggaaacacctctccaatgtttaaaaaaatactcaatgtaagagatgcgggttataaatacacttctgtgcatgtaaataacatttagagaacctagatgaagatgagataaagagggcttcatggcagctagtgagggccaattactggtctcctatgagaaaaggataagctatttgggtttagtaggagtttcagatgtggagtaaattatatgtttcttcaatttccaaaaattgctgcttgggcttcatagagcatgaggggaaatttcatgtgacgatggagtcagggcagtggcaaaagaagcactttccatagtgttagtaataaaacaagcaaaagaggagcctctgggaaagggcaaaccatgcccttggcacaaaatacatccgacgactgatcatctcaagttgacatccccatgtaacatttaaatgggataaggggtgattcacaaccttttatactctgacttccccttggagtccctcacggaggctgggtaaaagaaactgcttttaaaacgagctattcattaatgctgtaatttgtaaaatgtattatgccacacttcagacatacaaaatgtgtgaaagttatataacaagcacctttgtacacactacttagcttaagaaataaaccttattaatataggccagatatacatgagcacctactacgtgctgttttaggtactggggatacagcagtgaaccaaagaggcaaaaatttctgccctcaaggattgtacattctagggacagttaaagtctcctgtgtacacggttgccagaagaaaaaatactaagcacgtgttcatcgtttatctaaaattcggtttaatggtgctccactttcgtgcgcggccctacctgtgtaccccttgcagattgcacccctgcccttcctcaccgccagcccatcaaaatcaatcttccctcgtagtgttacctctttttcaccagatcctccatcctacttctcttgattggtacagtactgttttcattaattcaaaacattttaggccagatggggtggcgcagacgtgtaatcccaacactttggaaggccgaggagggaggattgcttgaggccaggagttcaagaccggtgtggggaacatagccagactccatctctacaaaaaaaaatttttttaaattagccaggcatagtggtatgcacctgtagtcccagctactcaggaggctgaggtgggaggattgcttgagcccagtagtctgaggctgcagtgagttatgatggtaccactgcactccagcctgggtgacagagccagaccctatctctaaagcaaaaaacaaaaaacattttattatggtactgctaacagtactgcagcgtcttttgttaaggaggtaagagcatcataaattgctcttgactgttctctcatagccagctaggaagtaaatggtgattgttggttaggaaaatagctgtgtttctttggggtgtagggatgaggcagtctgctttttccccaagtttctgaatcatgttgtaaactgaatgcactgattgatacctctctaaacactaatgttgtgaaactttaattagagcttagatatgctttagaagccaaataacaagtggcttatttgtgaaagaaagataataatagctatcctaccttcttcacaaggtggttgtgcagggaaaaaaagaatagctgtaaaaacactttttaaaacacaaagtgctggtcatatgtcaggggatagcaccattccccttgttctcttgtccttgtcatgagccgctgatcaggaaacatcccaggtaccctcatgtcaggccctgctggacgccatgatattggggccagagttgtattaacatcctcattaaacccagttaaatgacataaatggatgagcactgggaggtgactttttatgcctgctcttatcatctttatttttgctactagttgccttccccaattgattatagcttttccctcatgctctttctttttttgcagcctggatatatattttttcagacagatacatatttatttattaaagatgcttattgaattgcattaaaatgttatttaggctgggcacggtggcttacgcctgtaattccagcactttgggaggccgatgcaggtggatcacctgaggtcaggagctcgagaccagcctggccaacatggtgaaaacccgtctctactaaaaatataaaaactagctgggtgtggtggtgggcgcctgtaattccagctactcgggaggctgaggcaggagaattgcttgaacccgggagacgaaggttgcagtgtcccgacacagtgctactgcactccagcctccatgacaaagtgagactccgtctcaaaaaaaaaaaaagaaaagttatttaaattaatgataacataaaatttgacaggaaaccagaagagaagaattactcaaaattccacactaggtcttatttttagtatttatttttcatgcttttcaggctaacaaacttaaacacagtttcaataagcttttataatttggatatcagctcttgactttaacattctttgcatttttccaagtcttcatggaaaatagttttcaaattattattttcaatgactgtataatattccttatggtgtttctaccagttgaagtattctttttttgtttggatgtttggactgcttccacattttccctatggtagatgatgttgcagagaacatcttccctggtcatttttctcctccttttttattatttcccaacaatttcaaagaagcaggatgactgggttaaagggcacaatgttttcatggctttagtaactgttgtggggcttgaatctcgttatcttggtcagttatttggctccagcttttgtctctatgctgatcttaaatgagtacaaaggccactgataagaccgggtcagccagacagagccaggctcatggcagggtaggcagaatgctgcagtgcggtgcaccccactctcgcttgtgtaaatatttttctgggcaggagcgtttctcaaacagaactctgagcccactgcggtgaacctgatagcaggaattacgtgctatttgtcaagtataagactagtttgcagtgactggtctggctagaacccacctggtgttttctgagatcatctgtaaggaaacacacagcacagcagaggcagtgtgcgcccgtggtggtgagtcttagacctgtcatctgtgttagcattaccccgaaggcagagagtttgctgattagaaactatggctgctttaattcatgggtaccctccgtgacttttcagggtctcctggttgaatgaatttgcagaaggattaaaatgtgtgttcttatttgtgctttgtattctcccataagtagtgtgttggaggctattagaatagctgagagggtaaaacataaacacataggtaggagcctgacataaacacataggtaggagcctgccataagcacgtaggtaagaactaaaagggtgtgtttccatttcagttgtccagccttccttccatactctcagatgacaaaacacaagttgctgagctcacacagctaatgactaagccagaagttggacatggagaacatttttcctttgttcaaggttatttattatgttgacatttaaaatcagaagtgtgatatctgtgaagttctgattaaacagatcaagtgaaaaggatgtagttcagaaaactgcataaaaccctaaagtacagtgtttaaaaataaaacgtcctccctgatagggattatgttggtaagttactttttttcttagtatggattatttcaaattaataaacatattgttattcctttatttattgcatcatacagcttcatcctagtattagtgtgtttaataattgcatttaattagattatgcatttcaactttcaatgaaactgtagctgttagtcttttgaaggctaatttcacgctgaaatttatagatgaaataattttcttatagtggtggtgtttgagaagataatgtaactacttcttagatttcaatttcataacccttaaaatgttgggaccacctacaaatgggggacaccctgggttttgaagtcttgcctgtgtggttaatcagaacctcagaattcacccagcccccggagaggttttgaaaagcccctggctcatcagagcttgcttgtttcataaactcttaaggctttgttttaacctgtagccagcttcgccttataagctttcttgccccaagccttgagccagtcataatggcttaagcatcagatttcagacaggcgattagctctccagctaagccaagaaaggatgatttatcttccagtgagtaccagcctatttgagtgtaggaaggagaaaaatctgtgctcctgctcctgggtactgggcaaagaaaccctttggttggggatttttgcctggtaccaactttataggtgccaacaagaaagaaagaaaaaaacacatacaaaataaacacccaacagggagattcgctgtgttaagaactcgagctgttgctattattctaagagactgggtagccagtcaaagggttaaaacagcccttcctacaaggatttgaaaactctgtgctctgctcttcctcagcagacttctcgttgtgagtattggcatttatttctgattatgcacttcccctctttcttgaatgagttgggtgggctagctgagcccatcaaaggtatagctcatttgcttccttttccagggtttgccttcttcctgtgtctgggataatttcagttcatctcctttgtgcagtttctgagaaaggtttgtatgggcttagaggaaaatgatcgtgactaaagctcacagtcaccgctttggctccttttctataaaaggtggtttgatttgatctggcatgaaaaatattatcataattctcaaattcacagaaacgataagttcttgctctttcctgaccaaaaaaaaaaattaattgcattgggtagacttctctaataaaacctttaaggagacccatccaggaaatcagattttataagattcattcaaacagttgtagaaattctaagttcaaaaaccaaaagcagactcttttctttttccttccttggcttctctgttggatatttttggagtgagccttaactgagttactcatttccacatgctttaggaaaagtatgctcatgttttacaggctaagcctggttctgcttttgagctgcagttcattatgaatccggaaaacacaggtttttgaaatgcggcccatttgtacatatagcattagtcatctcagctggtagttctatacgatgagttatctcaccacttaaaaataagtacgctgctattttgagatttaaaaatatatatagtgaccagatttcttaccctagttaaagcaagccatggctgaaactcagattaaacaatattctataaaaatgagagaaggccactctaatcaacagatagaaaaacagaactatagacataagggagagctgtgctaagggacaaattgttggatttgtaggatttgttcgtatcctgaaagttaaatctttgtactcttaccttgtttatggccagatttgcctgatccctgatttccctcccaactggatcagaggttgtggaattggaatttcaccatacaaacctttacttaaaggaggtagtactagagtaaccatttatgggaacagtttgctactaatagttactagtactgagtttattttagttcctttttcatgattttattccattggaaaagttttctctcagggatcttttctactttggacatgatctctgttaggcagaatcaaaagatagctgtgtggctttctgaatttagtctcacaatatttggtttagttgataaatcccatccatcagctttgcaaataattttgtgaaaacattgattcagcttgtcctgcccaattttcccatccctgcccagtttactgagtgccttttccatttgcatccactgtccattaggccaaggcgtttgaagtgtttctgtacagcaggtacatttaagactctccaggaagaaagggggaagaatattccaaactgaaaacatcaaagagagagatggggtatttccagtaacttatatgcccagtgcttaatatcttaaaaaccctactcatgtgcatcagctcttacttttttctaactaaaaccagaaaaaagttctctcttcctctgttctcagtatccccctcatgtaagtctgtctacccaacacggtgcagccgatttatttatttttccctcagcatttttaggtggattgactgggatgctttattcaactcagggacgcaccacgaatatgttttttggggcaacccgtttggcatgttccccctcagctgtgaggacaaagactggtttgtcttcttgtgacctggcagaggaggcagaagtacctgctgagcttatgcagcatgtaccccaaccggtgccccacctcttcaagtggtgaatcagcctgatgatacactgatttttagaacacgctagggtggagacctggaagtctgtacactggtcggggagggagggatggtttgcatgtcaaaccatttcaacaatgcagcttacaggaaaaaaaaattaattgcaaaacactgtgatgccctttgccaccagatttttccattagcaccacactttatacagcttccaagtctgccccagggacaactgtttggcagtgtgaggggaaatggcagcatcacgtcataagtgcaatgattgttacctatgagcctatccggtaagggatctgagtgggcccaagcatcacacacgtgctggagctgagtgttctctgaggaacatgctaggatgttacttgggtgctagaaaacagcagctggaattcacaacacctcaggacactgattgtaaatgaagaatcctgagactaaacatcttctagaaaggtaaagggggcttagggctgggggcttttcctctgggctcttatcctttggtatgttgtccctggatgctttgagatgagactttgcagatactgctgaatttcttttcttttctttttttttaatactgctgcatttcaattggggtgttgtttggggactactggaaggaatgttatgaaactccatagaaatacttcaattcagtgagttcattcattcagtggctcacttttaaatgaccatacagatgtatttggcagaatacatctttgccattttccttctttgtgtaatggaccagccccgaggctgcgagcattggtccttctttgcctttttctccctgctttgtggttttgtgtatgtaaggatggctggcaagattaaggatcattgagctttgtattttctgttatttttctgtctccccaaacattttcactttcacaaactttaatctctaactattattcccttatcttaactctgaacttttgttttggacttattttgtctgaaatcatggtctatttccgtttcttcagttcttgtgtctgtaaaaatcacagtaggccttaccggaggtccatgactacaggtactcagagaccagctgtatccaaagagttgtgtaagataggggcatctgctccctcccagtgctgttgcccagccccaccctgccctgttccccagttagtgtctttgctttcttgacctggatatctttcccatatctattaatataagcccttcttatccttcaagtcttgctgcctctcttacctctcccaacaggcattctcagatactcccaatgggagttcctctcttcctcttctttattccttttattctgttattattctattattatttctattaaataattgccatcagttgcttttaattaagagttacggttgtgtgcgtcactaatcttataaacttgagtgttttaagaggcaagaatcatgtcatcttcttcgtatgcccaacaatgccttgcttagtagtccttgtagagtcaacagattcaatgttcaaccagcaaatatttgcagagcacctactttgtgctggcatgatgctgggcatataatacaggtcaaaaatcaggcccagcacctgcctaagaatttgtgggcctgagccctgccagttgccaatctgatgtgctatattctttgcagttttcttccagccttttcccgtaagttcccagttggtcgctctgtgaattcatgtgtgacacttcacctgggtgtgtttcctgggtgaacagatggcttttactgtgtcacacacacactcttgcgttctgcctcctctcgtgaaagttgtagttatctgctttctctccctcacttgctctaaggcaggcttaagatggtgttgttgctgggtgtggtggctcatgcttgtaatcccaacactttgggaggccaaggcaggcagatcagttgaagtcaggagtttgagatctgcctggccaacggggtgaaaccccgtctctactaaaaatacaaaaattagctgggcgtcgcagcgggcacctgtaatcccaactacttgggaggctgaggcaggagaatagcttgaacccgagaggtggaggtcgcagtgagccgagatctgcacttcagcctgagcgacagagcgagactctgtctcaaaaaaaaaaaaaaagagtgagaaagaaagatggtattgtctgttaagtgccttgggttccagagagaggtgaccaggtatgttgtggctgtcttaaggggaagattattgtcaggggccatttggaaagttcttcctggctgccatggcctttcattgctttttgtggcatgttagcagcacaaccagatagggaggaggtggtactccagttggttccttttgtctcaggcttattctctggtgcagcttggtgggctggttgcaaccgtaggtaagaacctgagctggtagcccctgggggtatggctggctggcctgctttccttctttcccactgttttcttgggaaggtctctacagacctcacctcttttaggtgtgaggagataaatagtccttattatcccttatttacagccttcatagagtctttgtagtaatctaagttaaggtcttaatgttcttatttagttctgtgtccccccaattcatttggtattggcttttcttaatgctgatttcaaatcttggatgaaaatatattatgagaccatctcttctttagatgtgacaaaggtaataaccatggggcaatccagactgtgaagaaagcctaaggtgtagaaagcccatgcgacactagttttaagccttcacatgtgtttggggaaatgcgtttgttgaataaaggataagaagacagaagactttttatttttcttgtcttttaaggtaggaccatcagatagcatcgtcttcctaaagtcactctcctgacaagaatcagacccctctgccggggcacaccctcctcatgtggaaggcagggtggcctctccttggaaaatctcccctcatgttaagtcttctgagcggatcctgctaatccaggcatgtaaaggaggagtcctcatccaagacccaacatggtgcacacctcacaggaggaggaatggaaaagcaggcacctttgctggactttccttttaatcccctaaatcctgtcacaccctaagactatgaaagagatgggtggagaagagccttggtgctgtggaaagggccatacccactttctccctcattgcagctcacagtgtaggtctcacacccatcccaagcacctaaggggaggggtcggttaaagcagcacaatacagtatttgaactcttcaggggtttggggaagtccaatataacagaaataacccaggccctcagcgtggggtagcagagcatcctcctttcactctgtctctttctaaggcaaatactcataggtagagtttttgcaaggtaagcttacctgagccagaaagggtgggaggaatgtgagattgttttgattgttgtccttgggttttgttgttgctgttgttattgttgtttataagaactacaagaggctgggcacggtggctcatgcctgtaatcccagcactttgggaggctgaggtgggtggatcacctgaggtcaggagtttgagaccaggctggccaacatggtgaaaccccatctcttctaaaaatacaaaaaaaaaaaaaaaaaaaaaaactagctgggtgtgttggcaggcccctgtaatcccagctatttaggagactgaggcaggagaattggttgaacccgggaggcagaggttgcagtgagccgagatcccgccattgtactccagcctgggtgacggagcgagactctgtctcaaaaaaaagaaaaaaaaaaaaaaggctacaagagagaatgtccctagtttatggcttttcagtaccaaaatagtatgcattcagcagtagagtaagcagtagcagtagaatagcaccatgcttatgcatgacataagcttcatctgtaaaaggctgaagtaatcataccttgctgtagggttgttgtgaggattaaatgagttcgtgtatgtataaggcacctgcagcagtggagtccagaagaattgtgcacagtgggtggtggggaaagatgagggcagggaacattgggggaggaaagtaaattcaatggatgtcaggaaataggcatcttgacctgtccacagtgtaattcaggccaccactcactacttaatttaactttgttcttatctctagactaatggagcaggctctctgggggaaaagtgttgctgcagtaatcctgttaagtgtaagaactgaaggttcaggttgaagtctcaaagttccaaagccaccatcccagggataaagactgtgctggtatacgctcagccagcctggtaccacagaaggcttttgtctccagcaggttccttttctcactgggcgtcaccttttctggctactctccgcctgtcagaggccaagccttgagtatatcttcatcttcccacatcttacttggcttctttctttgtatgtatattgaaagagtaaaggcagataggtgtgtgtttctctcttcagtgggaacctttgtgactgatggtttccaggcagaagaggttcaaatttttaattgtttcccttcccaacccttgtcatcgtctgataaaggactaggcatttatttgcatacaatgactttttctggtggacctcaccttcacagaagcacagaggcaaacacccatagggtcagatacaagctactttagcaaaatgattgactttgactgctttatgtaatctaaactcttaccagaacacaatatttatgaatgtagcagatttttttttttgcaggatcaagaaacactacattcagtactttattcgtttaacttttaagaacaagtcttttgatagttttaaaattgtatgtgtgtgtgtgtatatatatatatatttatttattattattttttttaatagagacaaggtctcactattttgcttaggctggtctcaaactcctgagctcaagtgatcctcctgccttggcctcccaaagtgctaggattgcgggcatgagccactgcacccagccgatattaaatcttagtttggaatataataatgtaactaaataataccagaatttttttttttttttttttgagaccagagtctcactctgtcacccaggctggagtacagtagcatgatcatagctcactgcagcctcaacctcccaggctcaagtaatcctcccagtctcagctcccgagaaactgagactacaggggcaagccagcacacctagctaattttttttttttttttggtagagacagagtgtcactgtgtcatccaggctggtctcaaactcctgggctcaagtaatcctccttcctcagcttgccaaagaattgggattacacgcatgagccaccatgccccccaaaaagggttcttttaaatgccttcttcacctttgtctaagtacattgggtaaatgtggcactagttgaacaagatttactgaattttatcacagggcaggcaggcaaagccagttctaaacaataaaacagagatcaacaaagatgacggatgactctaaatagcctgttttgtaaaattcaaaacgggacagctgtgtagagagaggcacagttttataagaattcactggacctgcctagtttggctcatcttggtgcctgcacatgccctgccttattccatttactttccttctgtctcatctcctactggtgaccacagttactgatgggagaccttaaaggtgattatctttgagacacatactttcctgtgtgaagacacaaagattaaactctataagaccatggcacttatttgggcttggggcttggtttataccaaataaaccaacagattaaaaaataacaaactaaaaacaaagtttcaagtgccaggtattttgaaatagcagatccaaataatttcatattactttacacaacaagacctccattagtaagagatttgggttagattttttcttccttttttttttttttactttaaactttattgagctgttttacataccatagaattcacccattttaagtgtatggtttgataagttttagtatatgtggacagttgtatatccacaatccagttttagaacatacccataacactaaaaattctcttgaggtttatgttatcatttacttttgacagaaatgttttcttctgcttttgaaaaaaaaaaaaattctgggccatgtgtggtggttcatgcctgtaatcccagcactttgggaagccaaagctggaggacttcttgagctcaggcattcgagcccaacctgggcaacatagtaagaccccatcactacaagaaaaatacagaaattagctgagcatggtgtcgtgctactctggaggctgaggtgggaggatcacatgagcccaggaggttgaggctacagtgagctgtgattgcaccgctgtactccagcctaagtgacagagtgatacactatctcaaaaaagaactttttttttttttaggtaatgaatttaaatcattaggggaacataccattcttactaactttttgaaacaaaaacaaaggttgctcgaagatgttatgaataaaatgtttaagagtatgagggtacagagcaagggaaggaggcttgggcctatggtttacgaatggtgattgtttttagccttctaattatatgttgcattaaataagaagaaaccaaaaaggaaccacttgcctccattccagcctcggttcagcataaaactcaatcatttccttcacaagccagctgctgtgctatagctcaaattgtaacagagagcctttctctgcagtggagggttagggaaagagggagtaagtcagcacaaacaatgaggaaacatttgctgcctttctgatttcttcctagaattaacaggcttacagctgcatttctaggtcagcatttcatatgcctgaagagtatgaggatagtttgaaaaatcagaaggaagatgagagagggctttgcctcttttttaagatcttgctagcagttttgtttgttggtaatttttgctgtctcactgacgccaagagtcctggaattaaaccccgtggccagcaggctgttagttcgtcaggaaattccaaatgggtataaataaattctctgcaacagctcctgggctctttgcctgctaatgtgtggagtccctttaatgctgagggaagtttgcctgagacctggcttcctgctcgctgaaaatcacagttattttgtttctgggtgggtaagtaagaatgcccacaaaagaaagagaggaggagagcatgatgtttgggtgggggttggtgaaatataaactcgagctctgtgtgttgtgaaaaagatttgcttttacttcaagctagaaagaataacccagtacttgatttttggtccagtgaaaatttcagctttacctatggctttaacataaagatgtcattgttgcaggagtgaatggttgtacatatatatatgctaagatttgagtttttgagtttaaggtttagttcaattcaataatttccttttttgttgctaaatccatctttgggtatttgttttcagctctgtttttccaatagggagttgctcaatattcattaaagctggcttcttgtataaacactataaaacaaaataaggacagggattcatacaaatactagctttccactaccaccccacctccccctggccaaaaaactgtaatgttttgttagaaaagcctgttttatccctaagttagccagtgctccttttctgcttttcacagaattactctctgaactggcacatttcttttttacgcttagaacagcatgttacttttgaagaaagtttggaaaataacagtccaagctcattctcttctgtgcatgcatgattgatttgggctgtatttcagcaacaacttttaaaatgagacagtggacattagagagcagcatagttggggttgcacttaggagcccatggcattttggctgttttgagacagatttggggtaaagagttgctgcatcttgtagttggcactgaacactggagaagagggccactgtataaaccgcaaggcccctgttaccatcacatgcctccctagcacaatgtgccctttattaagacaggccgttccactactgagaatagtaaccctttccgctgtcttcccctcactcttacgtgcagcctggcttctggcctcttaacccatgcccagagtagaattggcaatacccaggagggacactgcactggggattgttaggtcatgccagttaggatgcagctggaaaggtgctgctgagtgggacgtgcagaggggaagactgcaggctctgtctgcctgagctcatctggtctgacacctgccgtgattcatttttcttcatgccatgttaagaaattttgtatcaagtctagtcgacagttactcatagcctggaagcaactttggaaatcagagttccactgacccccctcattttaagggtatgaatcacatcactgcattgtatgattccagggctctcttgcccatggctcgtgcatgaactaggaagtgatcatagttcctgttcttgttttatgaaaacaatagtataccttcccccaacctaggcaggccattcaggacgactaccctggaggtgctctgggtggcttaaagcaccgtctttgcacagtgtgttagagagcactgtgccctgaggacttcgggagagctgcagaatgagtgttcagaataatcggcactcacctttgccctcatgttgtgagatggagatattttaacctggccataatatgctttaaaagttggggggtgtttgtctgcttttgcttttatttccttcctgtgctggactgggactcccccttatctaactggtacataccactctgcccaagcagtgcgtgtgcacacacacatcccctacagctccctgctggcatctccttcatacactcttaagaagaagaaaccaatgtagaactcaagattttagcagacttacttggtcttgaacaagtatcacaaataccttaaaccctgacttcgtgggggggggggcaaggtatagaggaggaagggttctggatcctctctggggggccagggttgtgttcttctccagacaacagagggtgatccagtaccactagtagtgacaatagaacccacccattgttctaagtgacaacacactgatgcaggtactattattttctcaaacaattggaatatagtctaatttgccgacagctgcaaagcagcagagccaggattcaaacccaggcagtctggccccagagtgcctgcttcaaatcactacatctcttcctctgttatacttattcatcagtagatgcctagatgtggggctttacacttcagcagatactaagagggccatgtaccaagcgccaagtactgaggaatacaaacataaatactgcttgagggccaggcgcggtggctcatgcctgtaatcccagcactttgggaagcccggctcacgaggccaggagatcgagaccatcctggctaacatggtgaaacgccgtctctactaaaaatacaaaaaattagccgggcgtggtggcgggcgcctgtagtcccagctactcgggaggctgaggcaggagaatggcgtgaacccgggaggcggagtttgcagggagccgagatcacgccactgcactccagcctgggtgacagagcgagactccgtctcaaaaaaaaaaaaaaaactgcttgacttctgcctcccctagacacttagagtctggtagagaaacacaggcatgtgcttgctaactgtaacacagttccgcgtatataggcaaagtgacttaggaaacaagagggaagaaggggaccagttattcccaggacagagcagttgagggtaagtagggctttacaaaaatgaggtatctgggttgggccctttaggacaatgcagctgattttgacagatgggagagtgtggggaagggtgtgctgggtagaggggatagaatgagcaaagatagataagcttgaaaatttctcagtacgttgaggtttggggtggggaggaacctgggaggtgctggattggggctaaattgttgacatttcgtgccacagaaaagagcttttaggctttcttctttaaagtggagctcctggcacatcactttgcaaggatagtgattgagaagttgtagacgtttccaggaatacctgaaacaaatgtaaaatttctcaaataatatgtaatacaggaaagcaaagccatctgcccctgaaaacaggctgcatatttgcagtatgagtaacagcagagtctgggctgtgctccctagtggcaggctgactgcactcgtgcaccctaaggacattgatgcacagatgaagaaaggaaagacagaaataaaatttatttttaaataattttaatcgtacataaaaagagctctcatgtcttcctcacccagactcagatttcccagtggttaacattttaccgtatttgttccatctgtgtgtgtgtgtgtgtgtgtgtgtgtgtctgtgtgtagaaatgcagttgtcatgtctttttggcctccttccatctgaaaagttctcgtttttacctttttttcatggccatgatggttttaaaaagagaggcctgacattctgtagaatgtgtttcaggcagggtccaggccatgccttcttggcaggacagtgcaaaagtgatgctctgctcttccccatgcagatacatgatgtcaactttgatcacctggtcgaggtggttatttgtcagctttctcatcatagagtcaccatttttttttatgattgacatttcatgccacagaaaagagcttttaggctttattctttaaaatggagctcctggcacatgactttgcaaggatagtaattgagaagttgtagacgtttccaggaatattttctggtgagatattctgagacgacatcagtatcttagtctttagtaggaaatctctacccactagccttagctagtgattcctacctgaatccgccactgttctaataattggtccatggtgattttctgttgacataattccttgtatatattagttggtattcctacatatttattatagcatgatggactcacaagtagatacctattctctggattgtaacttgttactatcattaatcatattattttcatgctcaaattatcctagatttggctagtgggggttcaaaagagtttgaatcaaatatacccttgacactggcattaaatagccaatctgatgtgtgctgacgattgagactaataactggtaggcggagggtgttatctgagttctagatatgtatttatctcagacagtatgggttacctgcaacaagatctgtggtaggcaggccaacagtaacactcgggaccctagaggcaagccaacctgaaattcagcttgtcagagaccatctggtgggtggaagttttgcgttttcagagtatattgtttaagttccccaggcctatcgtctacctttagctttccctgttggccaattcaggccctggtcagatgcgggtggataggtacacaaagctggaaacagcgtgctgcccgcctttctctcctgcctccagagacacttgttggctgtcagggtcggtgttgtcttagcctcacaggcattttcagtccttgctcttcccatcctagagtttcaaacacagagcgagtctgtgttctgcatctcaacatgctaaatcagaacctggattccctaaaatgttgtctcctgtttcttcctgccctcactcatgccatatccgtccttcccaggttagatttctcatacttcagtgaccttcagaaaaggaatcccatcacttttctctgcggtgagtcatccattggtttaaagaaaaaattttcttttttaatagcagaatgaggtaacagagccctagaagacaagcccagagaccggatcctggtctccagctcagcccagagtagctggaatttgtcagaccttctcagtttcctccgaagtattaggggcagacagagtcaaggctacaggctggctagcccagatgcagacagtgtcaaagttctcattgtggaataccaccagaacttatcttactattaccacttaccatctaattgggtaggtaaaattcatatggtgcaaaggagtttgttatacctagacaaaaattcatggggacttgaataatccatggaaaccctaatggagaatgctgaggagaattttaatctccagcatctagccagagcaatcttattaaaatgcaaatctgatcatttcactcccttgtttaaaacccttcaatagcttaccaatgcatctatgatgcaaaaacttgatccccagggtcctgtggaattagggctctgtctgtcccctttctgcctcactgcagtctttgcaaagtcctcttcccagttcttaaaagtggcaggttttgcatatgctctttcctctgcctagaatttctgccatccctccacacatccccaccacactgcccggtggactccttagctaccgctcccttgaagaaccctccctacccgtagcctaggcagggtccctgctgtgttccaacataacgcctgcattgtgctttcacaacacttaatacagttgttatttatgtgatcacttgtctgtctcctcctatacttcgtaagttctacccagacaggctctgtgtctgttttgcttagcacctagccgtgtttggcctattgcaggcacttaataaatatttgctgaatgaaagaatacatccatctttcagtgtaacaactgcatcttccttacatcagcaggaacaggtagatgtggaagatggagctggtatggagaagggtagtgatgggagacagtggaagatgtaggagtagtgtgcaggttaatgtctgttaaaaaagtccagataagattatctgtgagaggaaatccaaagatttgtggggagaagccaaaaggagttaggaagggttaggagtacacgaagcaagaccacattctaacttaatcatataaacaaaccaagcctgtaaaattgcagttatgctacatatgtgtcaactgacctgatatttcttaggaacttctggcatatacttttgctttctttaatgttacaattttatttgcatgaagtgtttaggtagctttttaaaacagctatactagcctgggcaacatagtgggacccccatctctataaaaaatttaaaaattagccgggtttggtcacacacatctgtagtcctagctactagagaggctgaggcaggaggatcgcttgagctggggagttcaaggctgcagtgagctgtgatcgtgccgctacactccagcctgagtgacagagcaagaccctgtctctaaaagaatgaatgaatacatacttacctacctacctacgtataacctgaagaggtattggtgaattgcagtaggcagtataaactctgtgaggagaagcatttcaggcttcttagaaaaagcctagcacgtggcaggtgcccatcatttgaatgcctgaatgaacgggttttatctgggagggaaaagagcaggcttaaaaacaactctttggtaaatgcaagagcaaaagaaaatctcatctgttatacatttcctttaaaccagaaggaggaacactcatattgctaccctttttattgtgtgttctctaacaaatggtgttcctcacacaaatttgatacaggtagcgaagctgctgggtctcaaagagcttagtgctaacagtgtcatcaggagataccacctgctaaacccgttcagaaggacgctgttgtacttcgctgtcttcttagaacactttccactcctggaaaagttgatgtgctaacttaattactctcatactctgagtaattagcttcatgagaacttgcctctcttcctgagttcatcctactggtttgctttcctgctgacgtgggatctttttgactgctttgaacagcaggatgcttacactctggggcttttaaatgtggaaatctgtgataattatgtacttctctaggactgactcagctcttcaagcaaaatcttcatgcttcatgtgagaggggacaataacattaatgggaattagcaaagttcttcagtttcaacagtcaggtgtggtatctggcgaagaaaaacacataaatagtgtgtgaaagttgtggcacaggggtgtaattatttttcacagcaccgtcagtcagtaactgggcctagagtgtgcagcagtgaaatcagaacaaagaagtcagtgtgtcctaattaatagataaagtaataatatcaaagtctcctccgttttaaagtccacaggacacattatttcaccccagtgctttttgctcatattaaagaatggctcattgtggtagagtatgtagaaagtattgaatgcttttctttactcaaaagtggcattttttatcacttgagcacttgagcgtagtgttattggccccaataggaaatgaaagacttgaagactacagatttttttttgaaatggagtttcactcttgcccaggctggagtgcaatgtcatgatcttggctcaccacaacctctgcctcacaggttcaagcaattttcctgcctcagcctcgcaagtacctgggattacaggcatgcaccaccatgctgggctaattttgtatttttagtagaggtggggtttctccatgttggtctcgaactccccacctcaggtgatccagccgccttggcctcccaaagtgctgggattacaggcatgagcctccgcgcccaatggaagaatacagattatatggccaaaatttcagttgctatctgtgaatttttattcttctcgctgtccccagcacaggctttctcagcctcagcgctactgacattatgagctagataattctttgttgggggaaggagggcctgtcttgtgcatggcaaaatgtgtgcagcagctctggcctctacacactagattcgggtagcaccccaagcagcgacaacaataaatatcttcaggcattgccaaatgtcccttcgcgggggcaaaatcacctccatgcctcgtttggttggtttaaaagaaaaattacctccagttgagaatcactgcaagcaggttagtactcgactagtttcctgcgatctaatcttcttcctggtgagtacgttaatttttatgtctttcaaaaccatgtattatttggacagcaagtttagtttcattaaaagttaaaatcatatagtactttatgaatctagatgaaatgatttttgaaatatccataactccatttcactttgttaatgcagaagaattgcaagcaaatttctcactgttcttgaggcagtaaattgggcccctctcacagagcactaagttttataggagatgaatatataaataaggagcagacttgccatcagtttgttgatttcaccttttctctgaacacagaggaatttggtctgaacttggagagttttctttaatcgatgccgttgcattggtgtttggttaccccaaattgcagagtgtgcaaacttagttgggagcgagagggaggaaatggactctgtgacccttggtgtctaggagtgagttggctcagagatgatgccaacctaagacaacatggagcccagtgttagttagcaggccatccacttaccttgagacgctggtataaattctggcaatgccagctgtcatgtagctgtttgcttcacttctgcctttaattacttttctatgcaccccatccccactagactgtgagccttgtgagaacagagactttgtccattttgttcggtgcccccagctccgagaacagtgcatggtaaatagtaagtgaagatccatagaaaactagagagatagagaaagagagacagagacagaaagcagaaattaattcatgtgcctttattatcaatatcaattataaatgtaagtcgaatgtgtgaataaatgttttattcggtctgcacttcccactgggtattataacattttaactggtcctattgaatgtagcctctttccctacgtcagtctcacgcacgcacaattgtcaagacgatctttgttgatgccttttagcccctagtttcagtggaaaaacttgccctgctccaggatgtgagattggtggcctctcctgtactcatcttcttccccttgtctaaccttggcattccttcagcagcaccaacaggttctgtcctggctcttcacctttttactctggtcatttaccttgtcttcagaactcatctctcgttaactcggttctgttttgatcactagtttacatactttcatactgcattgtgttttggttttttggagtgggggcggggttgttgttttttggggttttttcagacggagtctctctctgttgcccaggctggaatgcggtggtgcaatctcggttcactgtagcctccgcctcccaggttcaagcgattctcctgcctcagcctcccaagtagctgggtttacaggcatgtgccaccacacccagctaatttttgtattttcagtagagacagggtttcaccatgttggccaggctggtctcgaactcctgatctcaagtgaactgcccaccctggcctcccaaagtgctgggattacaggcatgagtctccactcatggcctgcattgttgatatatgcctttgtcactgatctcaattagtgttaagggtgtttggtagtcatctctcagctagactatatctgattttatttcttaaaaatttttcctcttactccttccactgaataggaccattttctgtagccaattaagctttcaataaatgtttatataatgaaagtagaggtggtgccaggagcagtctccaccactggatttccagacattcaaaaaatttttgtaaacaccagggacagccctccaattccagaatatttagttggaagctattactctcaggatttcagttgcagatatagccagtggaattttgactgtgcaaaagcaggcatagttctgttagtccaaaaaggcttagttaagagtctctttataacccaggtagatttttttttttaaactgctcttttttttttgagacggagtcttgctctgtcacccaggctggaatgcagtggcgtgatcttgacacactgcaacctccacctctctggttcaagcaattcccctgcctcagcctcctgaatagctgggattacaggtgcacaccaccatgcccagctaaattttttgcatttttagtagagacctggtttcaccatgttggacagactggtcttgaactcctgacctcaggcaatctgcccacctcggcctcccaaagtgctgggattacaggcgtgagccactgtgcccggccaaaactgttgtttttatacttcctcttgatcctgaattaataatttaagttttattgtaacacttttccagttaataatttagcgtctttctcctttttaagatctagtcttaatttttgagagggaaagggggaagaactgtagtacctgttagaattcagtgtaactccaagtaaacaagacccaaaacaaacgatagctaaaacaaaatagacctttatatctttttcacttaaaagtatagaggtaggctttttagaaatgttatagtagctctgatccacaaagtcctttgaggcccaagttccttctagtacatcgttcctccacccctagatatgaactcatgtttcaaagttacactagtgttctagtcatcacatctgcattccaggcagcaggatggaggaaggcacaaagaagaacataggtgaaaggattatttctgtgtttcttaatggaggttcctggggtatactacatgacacttctgcttacagacttttatttgcccctattagtgtggaaggaggggataatgcatactaaagaacatcaagctgtctttgccatggccacccctattcattcacctcccaagtgaactttctcattttattgcagtcaattccatttgccttccaaacagagacttcttgtaatatattttaagacaaatgcccaggccaggtatagtggcttacacctgtaattccagcatgttgagaggctgaggtgggaggattgcttgaggccaggagttcaagaccagcctgagcaaaatagcaagaactcatctctattaaaaataattttaaaaaattaaaattagccaggcgtggtgctacatacctatagttcccagctactcaggaagctgaggcgggaggatcacttgagcccaggagatagagactatagtgagccatgatcgcaccacgtcactccagcctgggcaacagagtcggaccctgtctcaaaaaaaaaaaaaaaaaaaaaaaaagagcaatacccacgtgttgtaaaaattataaaatataaagaataaaaatcatctataattccacaacctaaagataacaactgaaacaatatcatggaagaaatgtccttaacactaatatttaacgaacaacttctgtcttcagagcatcaagatgtttttcaaagtttattatcttattctgttggccaggcacagtggctcacagctgtaatcccagcactttgggaggccgaggcaggcagattacctgaggtcaggagtttgagaccagcctggccaacatagtgaaaccccatctctactaaaaatacaaaaagtagctgggcgtggtggcacacgcctgtaatcccagctcctcgggaggacgaggcaggagaatcccttgaaccagggaggtggaggttgcagtgagccaagatggcgccactgcactctagcaagtttattatgttatactatatattcagttatttattccttcagtaaacgttgtcagacatctcctttcttcccagcatgttgataattggtgtgtggttgggagaggaagcaatgaaaaaaaaaatgtatattttttttgggggggtgggggcggagatgaagttttgctcttgttgcccaggctggagtgcaatgtgtgtgatcttggctcactgcaaccttcacctcccaggttcaagcgattctcctgcctcagcctcccaagtagctgggattacaggtgcccgccactatgcttgggtaattttttatatttttagtggagatggggtttcaccatgttggccaggttggtctcgagctcctgaccttcaagtgatccaccctcctcggtctcccaaagtgctgggattacaggcatgagccagcgtgctctccaaaaaaaattttttttaattaagttttttgctctctgggtgcttatagtctggtacaaaagacaaaaaagtgttttcgtcttgttaaagttgggaaataaatcagggactcataagtgcctaatttatgttgatgtatgtaaacatacactagaaaacaggatattaaaaaaataatgacaccgggtagttttattgtagaataatttttaccatggacaattgtttgtgaaaatgacaccttgaaaacacatcttacttttttacttgctggagaatgaaacttgaattacaagtcctttgggtagcctggtttgagcagtattaggaaataagcaagcctaacttagttaaattctaacctcttctgattcccagaagtccaaagttcatttgggggtaatacaacgtgatacatgctttttgtgatttctacaaggtgaactaaagaaataactaaagatggaccagttaggttttggtaaaaactgtgataagttttgttgtgttttaaatactgatgttgagtcagttcatctttcctactgaaaatccttaagtgggaaaagtatagaaaaagtaggagttacaccaaaatattaacgcttgccacttgatggtaggatctgagtgccctttttttacgttctttaaattatctgtatgtggcttttttttttttttaatgttttacaagcatgtactactttcgtatctggaaaaaggtttgtttttctttcattttttaagaagaacttttcatcagtggcaaaggctcagttgaaattaatgataaaggataactacttgccacgtgtcataagcccagggctgagaagagtcaggcagtgctctggaaccagtgagtgctgcccggatcctgagaacccgcagagaacagtggggctgattgtgcctctgcacctcctcaggtgaccgagggctgggcaggaggacacagactctttcatgaagcagtgactagtataggaaaaacagagcctctctgtagagatgcttaaagtgctagctttatttaaaaatcagctggcaaagcgggagtgaagaacacacattttcagaagataccggtttcctgttttcattaagaaaacagggaatgcggaacagctgagtgcggcgggggtggtgtcactgcagccggagggagacctcgccggtgaaagctcagcctatggcatccgagcgtggccggccaagtttacacgaatgttgaaacttctcctcacggggtgaggatcgagggcgcccgaggccgggtccggctgagctggagcgagctgtgcggggcagcgcgggctggcggggagcgcggcgggcgccacgtggtaggtgagctgcgagcggcgtggggcggccaccgctggccgaattccggggggcctgggcgaggggggccggccgggaaggtgcgcactgctgggccgcttcactccaccgcaggcctacgggagtccagcttagacccgccggctcccacacacacatcccgggaggcccggatcagcctgcctgacagccaagctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggagtttcagacattcctggagacaggtctggctgctgcagcttctctcctgttaatggagtttcagacagtcctggagacaggtctggctgctgcagcttctctcctgttaatggagtttcagacagtcctggagacaggtctggctgctgcagcttctctcctgttaatggaatttcagacagtcctggagacaggtctggctgctgcagcttctctcctgttaatggaatttcagacagtcctggagacaggtctggctgctgcagcttctctcctgttaatggaatttcagacagtactggagacaggtctggctgcatattttgagtgatcaccttctccatgtggagatgaaagttaaaagggaaagagagaaggacagctacgttcttttaacacgagcacaagtttccaggcacagccctcccgaccagccctcccattcttaggctagagcatgactgctgctgggcacttctttcacatagaattcacttcccacacgtgttagaatcgaacagctagagcaatttaatattgttttaaattgggacgtaaggaatatacgtcctttttattcctctgcttggcaatcttatttttgtactttctttccaacatttgggaagaaagcgggcagatggaagcagaagtgttcttcacagcattcacactgtcgggtgtaaatgttcggcagtgctgggggttgggagggcagacagcaaccaggtttgctggaagttacttcaaactggacagcagtcaagtgggtttgtatactcaggagagggcagggagactgatggcttacattttcactcattgcttttgagttctttccatagctctaaaaatgcgcagcttattagcgtggctctgggaaaacaacacatgacctgatcctacaatttaaaaaaataaaaatgaccttgcttttaagtttgaaatgcatagcccaggtcagcgacaaggtctgcgctttgaaaggttcttgtgtttcctcttttaaatgtctggtttagccttaagtagtatttactgagtgccacatgatccagtggttggagtatgtaggttttgcccttatcttcattctttgcatctgtttgaactcatgacaatacaaaacaaggtgttcctgggatagggaatgttttgtccaaaaggagtcaacacggagaaaactcttcctacagttaagacagggtttggttttgtttttaaatgaggagagaaactgagaagtggaaaacacaaaatagagttgaagtctttcctctgtgtgcttctactcatgctgccagagttaatcactaaatatcccatgccccagctttctcagccggggaggtgccaaggcaaattgtaagcccatggaggtagtcaggagctgagtgcccttgacctccatttagaaaggcagcccagtctgcaaaagacagcagcagggacatctcatcccaggcctcctggttatgctgctgactttgtctgtctgctactgacttttagtttttttgtgtgcctcagataacactttgaaaaacaggaatcttaatgtctgctgtctatattccaagagactgtagatgaccaatgaaattatctactggacaatgctttcatgtcttttttttttttttttttaattgagacggagtttttgctctgttgcccaggctagaatgcaatggtgtgacctcgcctcactgcaacctccacctcctggattcaagcaattctcctgcctcagcctcccaagtaactgggattacaggcgcctgccaccatgcccagccaattttttatttttagtagggacgaggttttaccacgtgttggccaggctggtctcaaactcttgacctcaggtgatccacccgccttggcctcccaaagtgctgggattacaggagtgagcaccgtgcccagcctttcgtgtcttttataatgaattcttttaaaaatatttagtaaggacttactatgtgcttgtctcttaatcattatctctgagtactgatggacataaagatggaaaaagatggaaatagtagacattttagactacaaaagtggggaaagaggggagtgagggttgaaaaattacctattgagtacggtgtgcactatttgggtgatgtgtacactagaagctcaaagctcatcattacacaatatatccttgtaacaagcctgcacatgtactccctgaatctaacatacagttttaaaaaataatacaatcattatctcattacattgtttttaagcctgtgagttaaatatttgcatctccatttttactcagggagaaactgaagttaagagaggtttattaacttgcttacccaagccgggcgcagtggctcacgcctgtaatcccagcactttgggaggccaggttgggtggatcacctaaggtcaggagttcgagaccagcctggccaacatggtgaaaccctgtctctactaaaagtgtaaaaattagccaggcgtggtggtgcacccctgtaatcccagcaactcaggaggctgaggtaggagaattgcttgatcccaggagacggaggctgcagtgaaccgagatcatgccattgcagctccagcctgggtgacagaatgacctgtctcaaaaaaaaaaaaaacaaaaaaaaacaaaaaaaacttgcttacccagctgttgtagatccaggttcaaaacataggtgtgtcaactcttaaaatcataccagcttgctgtactgcaacaaacacaaatattagtttttaccattaggtgtattgcatgtcattataatattcttttctccctcttctaggaaaagcaggtgatattctcagtggagaccaggacaaggaacagaaagacccttactttgtggagaccccctatggttatcaactagacttagatttcctcaaatatgtggatgacatacagaagggaaataccatcaaaagactgaacatccagaagaggcggaagccgtccgtgccatgcccagaacccaggaccacatctggtcagcaaggtatatggacttccactgaatccctctcatcctccaacagtgatgacaacaagcagtgccccaacttcctcatagccagaagtcaagttacatcaactccaatctcaaagccacctccccctctggagacctcactcccttttcttaccatcccagaaaatcgacagctgccacctccctcaccacaactcccaaagcataaccttcatgtcaccaagacactgatggagacccggagaagactggaacaggagagagccaccatgcagatgacaccgggtgagttcagaaggcccaggctggccagttttggaggcatgggcaccacaagctccctcccttcttttgtgggttctggaaaccacaatcctgccaagcaccagcttcagaatggataccaaggtaatggggattatggtagctatgccccagctgctcccaccacttcctccatggggagctccatccgccacagccccctgagctcagggatctccaccccagtgaccaacgtgagccccatgcacctgcagcacatccgcgagcagatggccattgctctgaaacgcctgaaggagctggaggagcaggtgcgaaccatccctgtgctccaggtaaagatctctgtcttgcaagaagagaaaaggcagttggtctcacagctgaaaaaccaaagggctgcatcccagatcaatgtctgtggtgtgaggaagcggtcctatagtgcggggaacgcctcccagctggaacagctctcccgggcccgaagaagtggcggggaattatacattgactatgaggaggaagaaatggagaccgtagaacagagcacgcagaggataaaggagttccggcaacttacagcagacatgcaagccctggagcagaagatccaggacagcagctgtgaggcctcctcagagctcagggagaatggagagtgccggtctgtggctgtgggtgccgaggagaacatgaacgacatcgtcgtgtaccacagaggctccaggtcctgtaaggatgcagctgtagggacacttgttgagatgagaaattgtggggtcagcgtgacagaggccatgcttggagtgatgactgaagctgacaaagaaattgagctgcaacagcagaccatagaatccttgaaggaaaagatctatcgcctagaagtacagcttagagaaaccacccatgaccgggagatgactaaactgaaacaagagctgcaggctgctggatcgaggaaaaaggttgacaaagccacgatggcccagccgcttgttttcagtaaggtggtggaggcagtggtgcagaccagagaccaaatggtcggcagtcacatggacctggtggacacgtgtgttgggacctccgtggaaacaaacagtgtaggcatctcctgccagcctgaatgtaagaataaagtcgtagggcctgagctgcctatgaattggtggattgttaaggagagggtggaaatgcatgaccgatgtgctgggaggtctgtggaaatgtgtgacaagagtgtgagtgtggaagtcagcgtctgcgaaacaggcagcaacacagaggagtctgtgaacgacctcacactcctcaagacaaacttgaatctcaaagaagtgcggtctatcggttgtggagattgttctgttgacgtgaccgtctgctctccaaaggagtgcgcctcccggggcgtgaacactgaggctgttagccaggtggaagctgccgtcatggcagtgcctcgtactgcagaccaggacactagcacagatttggaacaggtgcaccagttcaccaacaccgagacggccaccctcatagagtcctgcaccaacacttgtctaagcactttggacaagcagaccagcacccagactgtggagacgcggacagtagctgtaggagaaggccgtgtcaaggacatcaactcctccaccaagacgcggtccattggtgttggaacgttgctttctggccattctgggtttgacaggccatcagctgtgaagaccaaagagtcaggtgtggggcagataaatattaacgacaactatctggttggtctcaaaatgaggactatagcttgtgggccaccacagttgactgtggggctgacagccagcagaaggagcgtgggggttggggatgaccctgtaggggaatctctggagaacccccagcctcaagctccacttggaatgatgactggcctggatcactacattgagcgtatccagaagctgctggcagaacagcagacactgctggctgagaactacagtgaactggcagaagctttcggggaacctcactcacagatgggctccctcaactctcagctcatcagcaccctgtcgtctatcaactctgtcatgaaatctgcaagcactgaagagctgaggaaccctgacttccagaaaaccagtctgggtaaaatcacaggtaggtggtaccctgaggacctgggaatgaggaaggatgggggaaaatgtctttccagaagctaaggattattttttaactgctggaaccatttttggaggagaaatggagaaagttttagagtggtaatctgtagaatgaaaactaagaatcaaaatccataagcacctctgctgatgcttattatctggtagcctcactggcctctggctgaggactaacgctggaagaaaagtaaactggtgttggctggcctagaggttgtcttctggggctgctagtttggtaagatgctttattctttgtctttcagttatttacttgctcattatttatagaactgcctttaaaaaatcctaccctgtttgtacccactattaccagtatattagcaattgaaatactggcataaaatgttttcagttaaaacgtttatgagaggagagactccattaattcattctttaattcagcaaataattattgaatttgagccaggtgcaatggtacacatccgtagtcccagctactctagaggctgaggcgggaggattgctagagcccagaaatttgagaccagcctgggcaacatagtaagacctccatttctaaaaaaatatgaagtaaaaatcattattacttggattcctactctgtctcaagctataggctgtgaagatagtgtgaacaaaacagaacagagcccctgtccctgcggtgcttacattctaggtggggtgcaggatatagacagtagacctataacatgtcaggaggcgataaatactgtgaagaaattaactccggttatgggaacagcgagtggtagtggtcagggtgagggctgtttgagatgaggtggtcaaacttggagagaagggagtcttttcccactcattttttttttttttttttgagacagagtcgctctgtcacccaggctggagggtggtggtgccatctcggctcactgcaacctctgcctctcaggtacaagcgattcttgtgtctcaacctcctgagtagctgggactacaggtgcccaccactatgcccagccacttttgtattttagtagagatagggtttcaccacattggtcaggctgatcttgaactcctgacctcaggtgatctacccacctcggcctcccaaagtgctgggattacagacatgagccaccacacctggcccgataggcgcttacatttttgtctgtcttattctttctcgtattcattgggattcctgctcactcttccttcttgaaattgaagctaataatcagaaagccaccctggatgattttatggcttacagtaattccctgtgagccttaccaacctgattttgcttgtgaccatgtgcactgcctctcacagtgtataacatcatcctcagcttaggaccacactgcctggcttccgtttctggctctccaattctcatgaatcagtgtgacctgggaaagagtgtgcattagattaattttacatgaaaatgtgtgatacagacttaagccatccacagaaattccagtctttctattagtgtctgatggggcaatgattaaaatagactgaaatatattatttttatatcttcctaggtttccactttcaaacctgaattattgttagttttcagtatctgtgctataggacagttagtttgttgtggaagaaaaaaatgaatatgacagctcatgtgtggggtttttgccttttagaatccaaagagtctaataaacatacagggaagtcattttagaataaacaggattaaaaatgatctgtagactcaaacagagtctgcaagaactcatgccatgtctgctttgacatccttttaaaaatcatgatgtcagatgaagtcaaaataaaattcttaaatacctccagacagatggcacagtggatcatccattataaaagcattttgttcccagccttcctccctcctccccaaactggggtttctatttcacattcttgccagaaatattcagctgtaaccctgaagtaatttgctgaccctctgagcacggagaccagggagcaagttcggtctggctgtgtgacagtgttttttggtctatttccagtcacactgacatgccacacatcactggttagatccaaccctgctaacaaacacctaattaatcagctaaaatacagaagacctacagcacttgtgaacaaaacaataaatatttttaacagcacttatttagtcacaatggcagcccctctcagagcacacaagaacaaattttaagtatttctgtaatgcacatcatatttgtgttttcaccattttgtttaacgttctaatgaggaattaattaggttaggaaatgaacgcagagtattccatttttgttatctggcatttgtcatgtggactgaaaattaaagcaacttgatatagtaaagtggagatgctcaacacttagaagctttgagaatccaggtggcccagggtgcactgtgcattcctgtgcacaccataccatagagaatagcactcaccacagtctagaatgtatttctgaaccaaaagatatactggagtatagaagggtattcatctcaatgtttgttttccccaaataaaacagtagggaatttgggtctgacacctaccaaaaagagcatataaatgatcacttatatgaacctaacacagtattctaatttaaggaagttgttcagtttgggctctgaagctagacagtgtgggttcacattctttctctgtcactagaacagattgtctttgttccttcacagggttgtaatgaagattcagtgagtcaataggagtaaagcacagagtataaatgctcaatgaaagttggctgacgttgttgttatggttagagtatttccagaaatagaaatgtagatctagaacaaatgatgccacacagaaattgtacaagtggtcttttgttttcagcctaaatttttatcttcattattctgggtgatgcccctacccaattattatacctctccaactaaccattgtatcaatataaagaagtacatagataacaatgggaaacacaaaattgataaatgttcagtccagagtcattcagaatccgtgtcaaagctcaaaacgaagtatattagcggccaatccatagaattctgttcatttctcctagagttgaagatttgatgatggtgtcacttttcagtatgcaaaaaagtgttatttttagcagcatcataatgcttaacactatatttaatttcttaaaattacaactagagcatgcatcataagaaattaatagttcaagcataggcaacgtagtgagaccttgtctctacaaaaaaattttttttaattatctggtcatgttatcctgtgcctgtagcctcagctactcaggaaactgaggtaggatgatctcttgagcccaggaggttgatttgaggctgcagtgagctgtgatcacaccactacactccagcctgggtgacagaatgagaccttgtctgtgggtgggggtggtggggggagattgtgcacggtggctcacacctgtaattctagcattctgagagctgaggctggcagagtgcttgagcccaggagttcgagaccatcctgggcaatatggtaaaaccccgtctttactaaaaatacaaaaatttgccaggcgtgatggcagatgcccgtagtcccagctactcaggaggctgaggtgggaagatcaccggcgccctagaggtggaggctgcagtgagccatgattgtcacccactctagcctgggtgacagagtgagaccctgtctcaaaaaaagaaaagaaaaaggaaaaagaaattaaaagttcagaagagcatataataaaagagttaaagcctccctggcacactcctgtggtagcccgcgtgtgtttggtatttacagatgtccatgcttgcacgtctgtattttagaaacatatatttttgtaataaaatttgaatcatacatagtccgcctctttgttttttcacctaaaaggtcacgaacatttttctaggatttgagagacaatgtcttggttttgatggaattggaacctgatagtgaccagaggtgttctgtattttttaattcctgatagtatgagtttaatgcatttaatattttcttttataaaataaaaaagttaagaggaaatgagtttctgttataacaaaaatgttggtaaaaaaaagtttattcttcctgtaaatcagttggattgttttcgtttgaggcatagattagtgttttctttttttaattactattttcttctagagagggaagaggagagagaaaattccagataaatgacttacagatactctaaaaatatataactgtctctgagcaaatacaaacaaaactataacagtggaatttaactgcctgccccatgatttatagaacattcatctctcatactgaaaagacctgctttttaaaatcagcttccgtatttatactcttagttatcttagttcatcaaaagttaatgaactcgaagtcattcccataactatgaaagtaagttgtagacaagagatctgagccaaagcaaaagtagtcattacaaaatacgtttctaggtagttttctcctcgttcaaataatatatcatttacctgtcttagcacttggcttcttaatcactttcttttaatgctcaaaagcaccaaaacaatgcaatccaagtgtttctgggaccctgcagatataaaaatatgatgtaggtagtggaaggcctagaagtcagaagagctgacctctcatactggctgtgtaggtaacttgctgtgtcttttttttttttttttttttttttttactcttaagacagggtctcactctgtcacccaggctagagtgcagtggcatgatcacagcttgctgtagcctgaacttcccgagctctaaccatcctccctcttcagcttcccaagttgctgggactacaggtgcatgccaccatacctggctaatttttgtatttttagagacaaggtctccccatgttgcccaggctggtcttgaacttttgggctcaagcaattcgcctgcctcagcctcccaaattattgggattacaggtgtgagccaccatgccaggccactgtatcattttagaaagggagattgtggacttccatggcctcctgtgtcaaataaatagggtgagattagtttttctcctacagtcccttcagcaggattattctgtacaagtgtgagttaactgtttatgttggtgaccacacatgtattagcattcaggctgaggtctgagaggagagcgtagaaacaacatatttgtcctttctcctctatcaaagctacatgcttttcctcacaaagtagtatgtaccaaaaaagaagatggtccttcatgaataatctctactgcctgttccccaaaccatcatttgggcttaaagagtgaattcatgctcgagcccttttttttttttttttttttttttgagacacagtcacactctgtcacccaggctggagtgcagtggtgcaatctcagctcatcgcaaccttcacctcctgggttcaagtgattgtcctgcctcagcctcctgaatagctgggactacaggcacacgccaccaggcccggctaaatttttttttattattatttttagtagagacggggtttaaccttgttggccaggctggtctcgatcttctaacctcatgatccacccacctcggcctcccaaagtgctgggattacaggcgtgagccagcgcgcccggcctcaagccctttttcttaaaaacaaacattatttcagatccctttgaatttttagtcatactttgggaaagtaacctaaatatttgaaaggactccataatgaattggaaatttcagtcctacctgttctcaatgagtaagtttagatgttctttaaaaattaaatcagaatgtcaagctgaaaatgtggcacagctacatggttagttagctggctacactcttcttttttgtgttttcagaaagttcttggcactatcaatacaaatgtagatcagcataccagaacagttggaataggtgaacagagcaacttttaaaatccattttaatatatttttttaaattgattttctaacaaatttggaaacccatggctatataccaataactaatacccattctggacagataaatgttacacagaagactggagaattgatctctttaaaacccattcagctctagttttgggtgattttttttttctttttttaagagatggggtcttgctttgtcacccagactagagtgcagtggcatgatccgggctcacgccactgcagcccccaacttctgggctcagggctcaagtgatcctcccaccttccagctctagtttcactgaattatttttcttgtaaaacagtttgcttttaacattcctttatgtcaaggacataaagttttcattttaagtggcttgtttttcattatagtcatctcatttgccttagaatttaatatatggataattataaaagctaagtgcacttcggaatgataattaatgcatcaaaggtgttcctcttattttccaggacactgagatttctgtcacttgttgtcctttagtgatcactaatctgaccaagtcgtaaaatgaggctcatgctttattggtgtttatggctgttataagtttgagttaatgatagaagacttcacagttgcccactctgctgtccattaacttcccagttgtgcctgtgaaaaccgttgccacctggtgagaattttgagcatctagaccagagtgccagaattctgaaggtgttttgtaattactccacatgttgctgtcgttttgttttgttgagacaaggtctcactctgtcttccaggctggagtgcagtggtgcaatcatagctcaccatagcccctaactgccaagctcaagctgtcctcacacgtgaacctcccaatagctaggactacagacacttaccaccatgcccagctgttttttgttttgttgtgttctgtttgttagagaggggggtctcactatgttgctcaggctgatctgcaactcccaggctcaagcaattaacctacctcagcctcactaagtgctgggattacaggcgtaagccaatgcacccagcctgttttttgtttttcctcagagacggggtttcattctgtcacccaggttggaatgcagtctcaatctcccagcctcaaaccatcctccagcctcagcccctcaaagtactgggattacaggtgtgagccactcccagcctgtaattactcctgtttttatccctattgttcagggagcatttactttctgtttagtatgaacatctaccattagtggcccagggctgttaattaaaccaccagcagttcctaaaaattcacatggatccaagttgatgggttgaaactagaggggagtctaaattcttaatttcagtagtcagcttttatattggttaatttaattcagtggatctcaatcctggcagcacaatagaatcacctagggagaagtttgaaaatactgatgcctgcaattggagacactagttgtattaccaaggctttgactggaatggcatgtttacagagtgctttggggaactgaagttgatctttagagccaatggaagccccttggaaaaactgacctccctcataccttgtcctttacagggttcctaacctgtggtaagtaaagaatgtcactttctgacaagctcaggagccccacgttattttgggacctcgggaaaagaggaagtcacctaatttatataggtatctgcaggcacaaataaattcttggctgggctcaagaggtttgtaaaaggtctaatttgagattccttatgaaaaatgtcagcaaagtcaatgtaaaagaaaaagggggggccatatggcaaatacttactcttgctgcactttatgcaaataattagcccaagcataataagactaaaacttattttggaaataaattggtcccactatgattggtctttggtagaaatagaaaaccagagagagaaaaattatgtttcagaaaaactatagtaccccttttattgactccagctttgtccacttttttggataaggtcatctgctgataactcaataattgattggttctcagggtcatttacctgggtccctcaaggcttcaggttggttctacagggactcctgaagctaggactttcacttcttgtggtagggcttactattaatcttacagtctgctgttcacttatgtgctgtactaaaactgtggataagaatgaccccaaccagacaccagtgaaggcatacggtcaacttgaagacggtttcactcctcttaccttgggggcaaccccttccccaacaatgttccataagcaagaagaaattagagctgtcattagcctttcccatctccatagctcacacctcaggattgaggtgtaccgaaacccaagggggtggggacattgaaactgcctttccaaaatcatgacagtaaaagaaacctgacatagctgactccgtcttacttctgacctccaagctgtccttgttcattcctaggcacaggccaagctaactgtgggtagaatttggtttataatttaaccttaaagcaaggatgataatagcccttcccaagactaaactgcctttgtaaaactaatgaaagcacacaaggttagaattatggacgggccctgaattctattttatttattttatttttttgagatggagtttcacttcaactgcaaataagtgttcattctctctctctctctctgtctctctgtctgtctgcctctcttgctctctctctctcatatctggacccatccagatcattgtatctacattttttaaagtctcaccctcgattcaggtgattctaaagggtagctagggttgaaacgactgaattttgtttgttggcctctttgttctttggctttcctggctgcacgttttcttcgttttgctcaaacacagcagtcatttgtcagtcttacattggtgcatgcggtgcctacaactacaagtgggtccttatcaagttcagagaattgtttataggccactcaagaccagccagagtttcaacaccatccaaagaacattttctggcaatataggtgaccaattccctctgacttgacaaaggagagccagtttggaatttaatgaggttcttttccttaccagttaagcctcagtagaatcctcatgacctttggttgaattacatggacacttattaaaggctctcaatggtcccgcactgttctaagcactggacaggacaccaaataagaatgtagcagggaggaactcaagatgctgaccatctcattgaggagacagggcatatttgaatctggaccgtaagtgctacaggacaatgatggggaaaaaagacatctctgtggaatggttggaatggtatcatagaaaaaagactagagaagatagaatttgggccaagccttgaaaagagtatgggtcgaattcagctggtgaaggatggcgaatttccagacctgtaggatgatctaattactccctactcacagagttggagtaattaagtcacaggaccactctgaacagaatggacagagtggaggagtagctgagaggtaaagttcccgcaggcaagatgaaaccttccaccttgacccttggatgcctgcaggaggaggtggaccttgattggagaagctttaaaaagccctagtttacaaaagtaagctgtggtgagaaaaattatagcacctggtattcctgggtgacactatctggaaggggtgggaggaaaggcttaccaggttgttagaaatgttctgtatctctgttacagaggtggttacacaggcgtatacatctaccaaattccatccgacttacacttaaaatcagtgcattttcgtggggcatgatcacaagcacctgggtcctgtgtcctagctactccaaaggccaaggtgggaggattgcttgagcccaggagttcaaggctacagttagctatgatcacattccattgcactctagcctgggtgacagtgtgagaccctgtctgtaattcattctgtgcattttattgtctataaattgtgtttgaattttttaaaaattttaagttgtatttaaacaaagagaacctatggattaaaagactttaaaataatagcaaccaatggaaatacatgactggaattctgatgcaaacaccctattaaagaaattttttagagactattggagattgggcacagtagctcatgcctgtaattccagtactttcagaggccaaggtgggtggatagcttgaacccagcagttcgagactagcctgggcaacatagtgaaacccatctctattaaaaatacgaaaaaaaaaaaaaaagaagccaggcgtggttttgtacgtctgtggtcccagctatttggggggctgaggtgggaggattgattaagcctgggagacaggttgcggtgagcagagatcacgccactgcactccagcctgggtgacagagtgagatgccatatcaaaaaaaaagactattggagaaatttgaatactgactggattatgtgataatcatacttatctttttttaagatttgatagttttagcctcaatggtttgcattttttagagttcttttagggacatatactgaaatatttatggatgaaaatgattgaatctctagctgttgcttcaaaataatccagtgtgagtgggcagagggagttatcagggaaaccagatgttttctaatcattgttgaagctagtaatgggaagacaggagtttattaaactattatctacttttgtatctgttttatggtttcaataatagtcaaaactatcatgtatttgcatttaaaaagtcattgttggttattgaagaggaaaatgcttcgtacaagcatttctctacaaagagtgttctggcggccaggcacggtggctcacacctgtaatcccagaactttgggaggccgaggtaggtaggtggatcacttgaggtcaggagttcgtgaccagcctagccaacatagtaaaatcccgtctctactaaaaatacaaaaaacagctgggcgtggtggcgggcacttgtaatcccagctactcaggaggctgaagcaggagaatcacttgaacccgggaggtggaggttgcagtgagcagagatcgcgccactgcattccaggctgggcgacagagcgagactcaatctcaaaaaaaacaagagtgttctggcattcagtgattaactagtgagactttttggaggccgctgcaatattttctaagtaatgatgaatggacttggagaaggaaaaatgaagataaatgccctgctttatctactttgcttaaaataagtcaaaggcacattaggcatttcatatttgcagttaggggacatcaagtcacatagtgtgaaacgttgtttggaccgctgaattcagtattgtgtgtatgtgtgttgaggaggaagttggagttgtaaaggaatcgtccaggtagcccccatgtcccacagctaaaggagaaagcattgtgctgttgatttggggacaggggactgttcaccgaattaggaaatgtgagttctcgttcagctctgtggcctggggcaagtcctgaacctagctggccttcagaatccttagctggaagtctggaattaaaaattaggtgatatcccttgaggtcaggagtttgaggccaggctaaccaacatggtaaaactcagtctctactaaaaatacaaaaattagccaggcatggttgtgcacacctgtagccccagctacttgggaggctgaggcaggagaatcgcttgaacccgggaggcggaggttgcagtgaactgagatcacgccacagccctcactccagcctgggtgacagagcaagactctgtctcaaaaaaaaaaaaaaaaaaatttagatgatctctaatgccttacattgaattttttgccagctctcactcttttactatagcgtcattgttttaaaccagtcaaagtagaccacctgcatcagtgattcttgtaggtggtggggaatgtcagaaatgccatcacttggcccccatcccagaactgcagaatgatctcctggcagcatgttcctgggaatctgcattttagccaatgtcacaggtgattcttatgaagaatagaactcagagcagttttagggcttgttattcgttctttttcttcatattgcctcaaaatacaatcaacacttaagctgcttttcttctaagaatctaagagatttcagagctttactttgaaagggataaagttgtgatcacctgacattgtgagtagatttaaatgtttaatttttgttagtaatttataaagtataatttaggaaatactagagacaaaaagaaaaaagttatagtagcctgtgactctttagccttagcaaagcagtgttaaatgggtttcctgtatatccttccatgatttttctaatacatacatatgtaaatataattatttactaatgccagtaggcagcaatgagaacaaaacctcttttgtatttttttttcccatgagtcaaacaaaagacttcagattcagatcaattctggtgtgctagggcaggcctttcctacaaggggtggagaggccagcctttcttctcttggtgggaatggcctgagctgtgttgtggggcaggccgctgatttgtgtgatgtatcattagagggaataagcccattgatcttttctagtttccgttaaacttgaactgagaggccaggcacggttgctcacgcctctaaccccagcactttgggaggctgaggcgggtggatcacctgaggtcaggagttcgagtccaacctggccaacatggtgaaaccgagtctctactaaaaatacaaaaattagctaggcatggtggcacttgcctgtagccccagctactcgggaggctgaggcaggagaatcgcttaaaccgggaaggcgcaggttgcagtgagccaagatcgcaccactgcactgtagcctagcaacagagtaagactctgtctcgaaagaagaaaacttgaacggagacaaaaattaaaaataaggccaggcgtggtggctcatgcctataatcccaacgctttgggaggtcaaggcgggcagatttcctgaggtcacaagttcaagaccagcctggccaacatggtaaaaccccgtctctactaacaatacaaaaattagccaggcatggtggcaggtgcccataatcccagctactcgggaggctgaggcacaagaatctcttgaaccaagaaggcagaggttgcagtgagccaggattgctccactgcactccagcctgggcaacagcacaagacaagacactctctcaattaaaataaaaaattatttaccaaagtaggtttattttctccgtattattgtatgacctatttttaatacacatcatgctcatctatgttaatattctcctatatcaagatttgtaatggccatatagaattcctctgtataaatataccagtgcttatatggttgtttcttacaagcagactgtctgcctctttttactgttttaaacatggaaacaatagccttctgtgtctttttgtacatccttaggataaaacttttagacaattaagtgaaataatttttcatttttaaaagtgattttgaacacagttaacccatattcactatagaaaaaatggcaaatccaaggaaatttttttttttttattagagtctcgctctgccgcccaggctggagtgcagtgggacgatcttggctcactgcaacctctgcctcccgggttcaagtgattctcctacctcagcctcccgagcagctctggattacaggcactcaccaccatgcccagctaatttttgtatttttgtagagatggagtttcaccatgttggccaggctggtctcaaactcctgacctcaagtaatctacctgcctcagcctcccaaagtgctggaattacaggcatgagccaccacgcccaggctaatccagggaaaaattaaaactaccatagctgtttcatttagcacagagtcagataacttttcatgtgtgtgtgtgtgtgtgtgtgtgtgtgtgtgtgtgtatgtgtgtgtgtggtaatgtattttaataggatcacacaatacatggaattttattatctgcttttttcaattaaccatatattacaaacatttttccacatcacccacattgaaaattctacaatatatctgtaaaccaaaaataaaattctaagccccctaaccaacggaatagatccctcctgtcagccaggggattccatagtaaacctgaaaaactagttcaggccatgatgggaaggaagtgtcaaacatgcctcattataccctcctccctttggaattcaggcacaactgaccagcattaacattaaaacagagatcttaggagtgacaaacagactctttataccaataagataacaaattccaacctgactctcctatagcatcacatgacagcagaccctaaaagaaaatgaagtattttaccctaaaatatatttcttcgatgtattttgtctttttttgttttgtttcttttgttttcttgagatggagtctccctctgtcactctgtcacccaggctggagtgcaatggcacgatctaggcactacaacctccacctccgggttcgagccattctcctgcctcagcctcccaagtagctgggactacaggcaccccccaccatgcgtggctaatttttgtatttttagtagagacggggtttcaccgtgttgaccaggctggtctcggactcttgacctcaggtgatccacctgccttggcctcccaaagtgctggggttaacaggcatgagccactgctcccggcctcttcgatgtatattgaaatggccctgcaaggctgtctcttgtggggaatatctacattatgtagtgaatccccttacctgtccaggccttttcctgatccaggagagattcagagtctggtacctatttaggtctgaaaagagacatttaccatctatatagaggtctgaaaagtgacgtttaccatctatgtagatgaagcctgctacctggaggcttcatctacataataagaaccttggtcttcacaaccccttatcttaacccagacactcctttctgttgattgcaggcctttagataataagttaactttttcaaccatttgccaatcagagtatctttgaatctaccgaagacctggaagcccacccttatttgagttcttccacctttctaaactagtgtataccttacatgcattgatttgtgtttgcctgtaacttctagtccactaaaatgtataaaattaagctgtaacccagccaccttgggcacatgttgtcaggacctcgtgagattgtgcttttggccttggtcattcatacttggctcagagtaaacctcttttttacagagtttgactcttttcattgacatatctgtatacattaattacaaaatattatttaatccaaattgcttcggtcagtatacagattttaagtggctaacatatacaaaagcactctagtagatttgttaagagaaagttgatcagaactgtttgatgccctcaaaatatttaccatctacaagggagtctaaaaccatcatacaagtcatcttgtacattgtatcacagatccccaggagaaggtacaaaagatgggctgtgagagttcagggcaagaacattgttagtgaaggagatcagggaagggtctgaagaggcagtgatgggagggtgcggctgtgtgaagatgggggaagaaaggtattccaggtagtagaagggcataagctgaggcatgctgccaggaaacaagagacccgcatctctatacagcgagtcctggcacttaatgggatgcagtccctgtcccagtaaggacgacaggaggagtgggaaatgaagttgcgggggtcagccagtaccaggttatggatagtttagaatctctggctctgcagtgtggactacatttcctgagcagtgggtgctttttaggcgttgtcacattttgttttagctggaataatgatggcattggagctggctgggagtaatgctctgaagcattgtgccagagtggaagtagtaatggaagaggggcagtaaaatgctacttccatgactagaaaccaaggctatgacggtagcagccaaaacagagaaaagaagaggtgctgtggagttagaatgacgaggcccggcagtctgcctacgctaatgaaatcaggaaagctggagcgtcaaaggggcttctgagttttggtggctgggataatagtcccattttaaattatgagtggcaagaattgtttttgttgaagcctgctttttcagtcctagcatcacacactctgtacctttctttttcctgataggcaattatttgggatatacctgtaagtgtgggggccttcagtcaggaagtcccttaagctcccagacatcccagcctgagcaagaagtggggacctcagaaggaaagccaatcagcagcctggatgccttccccactcaggaaggtacgctgtctccagtgaacctgacagacgaccagatcgccgctggcctctatggtaacttttctcactcacagtcattggcatcaggattctagggccagcattgccagcattccaatttaatgtcaatgtaccttttaaattgacctggaagaaagttaatatcgttatttggaaggtaggcccagaatatctttaaataaggttaccaaagaggccgggcatggtggctcacacctgtgatcccagcactttgggaggccaaggcaggcagatcatttgaggccaggagttcgagaccagcctggccaacatggtgaaaccccatctctactaaaaaatacaaaaattagccaggcatggtggtgcacacctgtagtcccagctactccggcggctgaggtgggagaatcacttgaacctgggaggtggaggttgcagtgagctgagatcacgccactgcactccagcctgggtgacagaaagaggccctgtctcaaaattacgaaagaaagctgtacaagaaagcttacctgatattacaaattatgaaatattttaaatagcattttattcacgttctggcaggcataagttttttcaggttatctcagctgaagaagaataataatccctgtttagtacgtaaatggtccttgaggctcgtgagacacgacatcactttataagcagtaaagccggatacaaatgtcagttttcactggctttgttatgtctggaaggactaattgatttttttcccatgtgaagaatgttattaatggaactttgaattattttctttgcatgcacacactttcccattgaattttgtggaaacttctcacatatatatgccaagatctacatttacatgcatgagaaaagaactgtacaggaaaaaagatcatttaacatgtatgggtgtgagttttcatttttattgccttgactttttcacagcatgtacaaacaatgaaagtacactgaagtccatcatgaagaagaaagatggtaacaaagattcaaatggcgcaaaaaagaatcttcagtttgttggcattaatggagggtaaggaaagatggtggttctagaggctaatgctgtcagtctcctttacctcctgcctaagtcacatttcaaggcgcctagtcggggaagcggccacagcgcagtgatgaaagattccctcctcagaaaggcagaaaggtgcatttgggctttgctttcctcctctggtgctgtctttaaggatttgtcactctcttaaggatacctgatgaagctgagcggtttacatctcctcacctctgatctgaaagaaatagtcttcagcgaacgcagcagggttcctgcactgtgttggacaacttgtacttacctatacgagaactcacaattgagcagaaaaagactgagagcatcactctctgggccaacgatcgtcatcttttccttcaaaatgggtccttttgcttagctctccatgtttacgacccaaattgtagggcctttcacaattgataaccacatcaccagtttgctttctaaatagaatggttattgtttgttccttctctttgcattggcccacgtacatagttaagcccctttgttgtcctacaattgaatcaaatcaatgaattgatacatggcccccacaagaaagaaataatacaaagtgtaccattagggtttaaccttatggtgcctgttttccaaatctagaagttttattcagtgataatggccaggagattttggagggcatacaccagaaaaactatcgattgcctatgtaatctattccccttgatactgggagaattaataggatgaaataggaagacatggggtgggggggggacaaaaagcacctaccgatctgttttccataaagtatgttttctcatgatttatgctaagccggagatgccattattttctttaacaagtgttacatgataccaattggttatatgataccgataaccagtttaagttagagtccattcaaaaccaccaggcatttaaatagaccttactttgaacttctaagtgcaggatctaaaaccactagtgaaatttctggagtcaattagcaaatcccttcatagaaatttctatcactgggtcttcgtgagcacaccttgcatctcctgaaatcccaattgccacctaggtatgaaacaacttcaagtgatgattccagctcagatgaaagctcttcttccgagtcagatgacgagtgtgatgtcattgagtatcctcttgaagaagaggaggaggaggaggatgaagacactcggggaatggcagaagggcaccatgcagttaatattgaaggtttgaagtctgccagggtggaagatgaaatgcaggttcaagaatgtgaacctgagaaggtggaaatcagagagaggtgtggtacattccccttccctcccttgcccctcccacatttaatgtactttggcaatagagttggccagttcagagcttttgtaattaaatgtttgcttttatctgttcctcagaggtatacacatcttgagatactaatatatacaagtgcagagtattacaactcttagatctcttatggtagaatggcctggtacctaatcacccttgttttctgaaaccttaactctgctatataatttaacatatggaaccacaatccactaaaacttgcattgtttgaacaccttaccttatatttaaagacattttaattttttggtggccagcctactttaagatttcagattttatgtttagccatttatcttgatacaggtgtatcattattacaggatcattgtgtggatgaggcctcagccaaagatcacatatactgtaaagatgatgcatatcacttacatgtttgtattttgttacacattgaatgatcaggaataccacaagaatggatttgggtatatcataaatagtagctgaaaaacactctggttggctgaaatatgtgcctcagaatgtaagttttcaagaccattagataaggatttgatgctcataaaatagagagtagaaaaggtggaaacttcagtatggtttttcagtatgtgaaatataaatagaacatttcagaaaacttacctctatttaatttggcaaatgaaagtttaactgcattaaaacaaggtaagtgtttttagtttatatttccaagtgtttcacatggctttttaacagctttgagatgtaatttatataccatatgtcatttttttacttttcatatgggttaaacacttgagtcaccaaatgtgggttcagatgtgtggtttactggtcagcacgatggatatatggtaatttgtggaaagtcaaggcaagaggatcgcttgagcacaggagtttgagactagcctggacaatatagtaagacctcatccctacaaaaatatcaattacctgggcatggtgtcacatgccagctgctctggaggataaggtgggaggatcacttgaaccctggaggttgaggctgcagtgagccagtgcactccagtctgggtgacagagcaagaccctgtctcagaaaaaaagtaatttgggtctccttcaacccccttaaaattaaaaatattttttaaaaacttagaacaggttgggcacagtggctcacacccataatgccaatactttgggaggctgaggcaggcaggcagatagcttgagcccaagagttcgagaccagcctgggcaacatggtgaaaccctgtctctacaaatacaaagccgggtgtggtggcacacacgtgtaatcccagttacttgggaagctgaggtaggaagattgcttgagcctgggacagcaaaactacagtgagccgtgattgcaccactgcactccagcctgggcaacagagtgagaccttgtctcaaaaaaaaaaaaaaaaaaaaaaaaacttaaaaatggcaaaaaaaaatctctaaatgttattccagaatgtcataaaggccaattggtgaagccgaatgtcaccctcccaaacaaggcctcaatctctggctggaggtgttggctctgcacagtggacgtaacccttagacccctaaggatttctgtgctgcctctgcccaagcaccttgtgccataatgacctgcctgggctggcttggggccacttgccttttaaaaatatatttttaaaagttgaagctgcgcagtgtcccacccctgtaatcccagcactgtgggaggccgaggcaggtggatcacctgaggtcaggagttcaaaaccagcctggccaacatagtgaaaccccgtctccactaaaaatacaaaaattagctgggcctggtggtgcacacctgtagtcccagctactagggaggctgaggcaggaggattgcttgaatccaggaggcggaggttgcagtgagccaagatcatgccactgcactccagcctgggcgacagagcatgaccctgtctcaaaaaaaaaattagatatttgggttgaaataaaaatgattttcttcttgtgaccaatcgtaacttgttttttctcctttcaggtatgaattaagtgaaaagatgttgtctgcatgcaacttactgaaaaatactataaatgaccccaaagctttgaccagcaaagatatggtgagtctgacctgcaaacaccatccccagtgtgtacaaagtgcatgagtgggttcattgtcaaggccagctgtaggctgcccgagctgttgcttgcatgcttttctcctgaactgtttccagcatgagtgggctgggtaaacatcatgtggtcttgctccctggatcacactgccagcgtttccttgaggcccaacttcggacatcctttacccaccctggacttttcctggggtggaggcatctgtgaggcgtacacttgcagacagaaagcagggctaattgcagtcagtcgtcatctttctacatatttcatttctatttatagaacagtaagatccagggagcagcatccaagaattttttttttaagttagcatatgtttttaaaagaaacctatctgagccaaggtcagcattcctttcagttatgaaactgtatgttatgctctgatgtggaatgcaggcggccactatttttaaacataaaaataaccgcacttgtcatctcgcagtctaagaaattcagagcaaacagcaaagagtttgtggttgccttagtgatcatgaatggtacaacataggacacaagtatttctatggcaatggttaatgtgacaccatggccaagaatgacatattctcatgtgtcgaagttatgtgcacattctttcataggccagactaaccccctggttgacagctgtcttttttattagtgcattgagaaaatgtaggatcccctaaggataccgaaatgcacagatactcaagtcccttatgtaaaatggtgtagtatttgcatataaactatgcatctactttaaattctgccatatattttaaatcatttctatatcataatacctaatacagggccaggtgcagtggctgacacctatgatcccaacacttcgggaggccgatgcaggtggatcacatgaggtctggagttcgagacgagcttagccaacatggtgaaaccctttctctactaaaaatacaaaaagttagccaggcatggtggtacacccgtgtaatcccagttactcgggagtctgaggctggagaattgcttgcacccgggaggtggtggttgcagtgagccaagattgcacctctgcactcaagcctgggtgacagagtgagactccatctgaaaaaaagcctggagtgcagtggcgtgatctcggctcactgcaagctccgcctcccgggttcgggccattctcctgcctcaccctccccagtagctgggactaccggcgtccaccacaacgcccggctaatttttttgtatttttagtagagaccgggtttcaccgtgttagtcaggatggtctcgatctcctgacctcgtggtccgcccatcttggcctcccaaagtgctgggatttacaggcatgacccaccgcgcctggcctcaaaaacttaacacaatgtaaatgctatataaatagttgttatactgtattgttttgtattacatattttttaaatattttcactctgccagtggttgaatctatggaaatggaacctgtagatacagagggccagctgtactaaataaaattgctggtcaagtccaggcacagtggctcacacctgtaatcccagcactttgagaggccaaggcagtggatcacttgagcccaggagttcagtttgagaccagcctgggcaacatggcaaaaccctgtctctacaaaaattagccaggtatgatggcatgtacccatggtcctagctacttgggaggctgaggcaagaagatagctggaggcccaggaagttcaggctgcagtgctccatcatcatgccactgcactccagcctgggagacagagtgacaccctctcaaaaaaaaaaaaaattcctagtcaaggggaaacatagaactacatattgaaattcttggatttgtattcatgaaaatacctggctataccctggtcactagtaaaaccataaaatctcactgcagggtcagtatttcccatcaggtttaacctaaacttaaaactggtgccttacaaccccagattttatagccatagtacacttttctttcactgttctcaaaatactaggttacgtggcctttgggaaggattctgttttcctgcatcctccaaattgccgagcatggtgtcatccacacacactgtgatgggtacatctttttaactgaattttcatttggtgtgaaagtgtttaaagtattgtgttgtgaaaagtagtggacgagtaaacacaatgccagggctagataatcatgtcaggacaccagttatttagcagtaatagaattagaatgaccagaagacataatttcccttctttcagtgtgacaactccagagaaacaggaatgtgaatatatacagaaaaaaaaggacactcttcaagtgacccaaaatgtgattgaaatggttaaaactaaataatcagtagcaggatgataaagagatggaagctctataatcccaactctaccttttctacagaaagaggacttcttgggttctggtgcttctgacataggctgtctttctttgatatatttttaaacttttaaagagtaagcacagcagaaatgaatattaaactcatatgaaggcccattgaaaagacactgtagtcatcctcatcaccagtactgactgctcagtctccactgagcttcatgtgacccagggttgagttgatcatccacaaagcaagtgccttcttcatgtgtccacagcctaaggaagtcagagtggagctgatgagagaatgaaattagttccagacggggttcccttttattttccctttccgtggttgaacagttgtatttgggattggggtgggaattgggttggctatacacgtacggtctcccaacctagtgctgtgctgaggagttgaaggaggtgagtttggtctggataggaaggaagcagcataattcagtgtaggctagttaatttcttcctaatttctatgaaaattgtttgcaaggccagtatgattacatcatattaatagcttaataaatggagccaagcctgagtgtttattctcatcacagaaactatgaaagcatggtattatccagtttttcagatgaggaaacggaagcagaataacttccctcgggtcataaagcttttaggtagcagagcctgcatttgaaactcagtggtctggctccagagcctctgcttctgcatggtgctgtctggtctcctttatagacattagaatctacacgtcatttaaaatcaggagaaatgtcccagtttggtgtttgaagcttctcttagggctgttggtttttgagagcagattctaactgcatatatatactttgactataaaaggacaggttacttgtgctttcaactaggtctcagaaagtctataaatagaagaactaacgaccacttggtgttttggcagaggttctgtctgaacaccctccagcacgagtggttccgcgtgtccagtcagaagtcagccattccagccatggtgggggactacatagctgcttttgaggccatttccccagatgtcctccgctatgtcatcaacttggcagacggcaacggcaacacagccctccattacagcgtgtcccactccaacttcgagattgtgaagctgctgttagatgccggtatgttggctgcccttccaccctctcttctctaacagtacttgggttgtgactcatctcagagaacctggttgagccactcctgaattctctgaccatgctaaaatcctttttattgcttttccacatgacatggcaagaattttcttgagtcattcataagaggcttgaagtttaaacaaaactgggtgacacagattctagatctgtttttgaaaggaggttttgaggatcttcttgctgcagttcagctgcattcaaaagtgagaggtgtatgcctggtaagaagcatgtctcacgttccctcctgagctgaatcatgcgggcttggccggtttgcactcaggaggcagagtgctgcttacaggcccagggtcacagccttggtgcgtgtggaccacttgatttgaccttactccatgactgctgtccttgcagaagtgtgtggttagtcaagatggggactaagcaaagccaccttaacagatggtcaaatgatcaccattctcaccaaaatatactgttattggggaaacagcatagagcaaagggcatgttattcttgtctctcaaccataatagaatagtagaaacttgttatcccagaatagagccagtggacatcttagacatgaagtgagggaggggcacatacacagatggtaccctcaagaaactgtgagctttcaacttcttgttcaaatggagcagcctgatgccacatagaccccaagtcttttaatttttgtaatacatatttttatttctagtatgtgacagagaagtcagagtatctcagtctgattaatgaggatgtagtgtgaaccttagaatatgcaatcatactgtccaattttctgaaattctgtcttcatccactgtccaatctcttctgctctgttttgggaacttggaattgatgcagagaagaaagccaagcagatttatccttcctttctcttataagtgtgtttgttccctctttttggagccatgttagggtataactgcttccatcttacaggaaggaatttcaagcccctcctcttcaggctttctagactataaacagagctggtgatacagtcagccagagtgattgtttaaacagaagtagataatatccagggaagctgaaaacaagatttcactatcactcctgacaggaacagcttagtatacccttagaagttgataaaacatcttggcaaattaaataattttaattccattgctggatggtttgggttaatcacttatcttaatggttactgctcccccttctaggctgagattctggctccataaggtgtagatctaggatgcttcagcatctatgcagagcagagtccgcaaagtccgaggtgctaaggagccccgaagcgcacacgaattcacctgcttctcctccacagggccttttattttctgcattaaaaacacccacttttaaaaacatgtccttagtatggagttgtttgggatcttaaggtaaatgttcatggtaccttttattttcctttatgatagaaacattctgaacattttaacttcatatttggtcccacataaaagctgctttctaacactcaccattccggtcatttcagagaaagtgccgaaggaacttttaaatgcccgaaggataattttatccctgaagactccttaagaattacaagaatagaaaaggtctggttcatcgattctgttaaggggacttaactgcatttgttctcgaccataaattctggagctggatgttatatgattggaattctgcttttcaggacccccgacaggccagagtagtaaattcagagtctcagaatgagtaatgtttggataagtaggtaccaccctgtccaacgttccatacgtaagcgtttgcaaacacttcgttcatgaatagctcactacctgcttcactttcctaaacacagctgagtgcctagattccaaaaatcgtttattctcaagagcaaccagtagaacaaccaccctgacttccaagccattgcatttcagccaccagttgcaaacaagatacgctgtggaagcttaccgttgtttctcttgcttcaggtgtcgtgaaatagggggaaaaaaagtttttggtttagtatgaaaacatctctcacatttccttctaagtcactcttggtctccagccacctggtaccatttcactgggctcctgtaaacaccatcccttcagtggcttcgtaagcggctgctattagaaggggctgcttcctaagagacttttttttttttttttttacagatgtgtgtaatgtggatcaccagaacaaggcaggctacacccccatcatgttggcggccctcgccgctgtggaagcagagaaggacatgcggattgtggaagaactcttcggctgtggggatgtgaatgccaaagctagtcaggttagtgcgcctggttcctgtgctcaggaatgcacccgtaaccagcagacaggactgcggtggccattctggcagagcaggcatagatgccacgcttccaccacagtgcacttgtttgcaggcctgccctgagtccatacactgcctggcactccttgctgaccaaacataccagggaaatatgggcttaaatttcacactggaaacttctccctcctttgccttgccttttgtccatttgcatagtttgcatggaaatactgttagttcccctacatataaatgattgcgcatccccatcagatgctcagtgactgttgcttcctgtctctgtgttgtactgtcttcatagcaaacagtgtcccaggtccagatgtgttcacagcttgacttttttttttttaagagacggtcttgctctgtcccccaggctggagtgcagtggcgggatcttggctcactgcaaccacccccggctccctggttgcagtgattctcctgccttagcctcccgagtagcagggactaacaggcacacaccaccacacctggcttttttttttttttttttgagactaagtctcattctgtcacccaggctggagtgcagtggtgcgatcttggctcactggaagctctgcctcccgggttcacaccattctcctgcctcagcctcccaagtagctgggactacaggcgcccacccccacgtccggcttattttttgtatttttagtagagacaaggtttcaccgtgttagccaggatggtcttgatctcctgacctcatgatccacctgactcagcctcctgaagtgctgggattacaggcgtgagctactgcgccagcccctggcttttttttaagtagagatggggtttcagtgttgcccaagctgctcttgaactcctgagctcagacaatctgcctgcctcagcctcccaaagtgctagggttacaggcgtgacccaccactccaggcccacagcttgacttttaaccaccacctgaacttccagccccttactctactgagacatcctccacgctaaaatgaagttggctccttactttatgcccttcctttgctcatagctcatgggaagctggtttctccctgcttgccaccacctgccccaagtagttccatcgccagttctttcccttctgtcaccacactcttccccctttccctagcacagccccactagaggccaccactgccagctcagtacgtacttctgaagtccttgtcatctcttcccataggcgggacagacggccctcatgctggcggtcagtcacggacggatagacatggtgaagggccttctggcctgtggggctgatgtcaacatccaggatgacgagggctccacggccctcatgtgtgccagcgagcacggacacgtggagattgtcaagctgctgctggcccagcccggctgcaacggtcacctagaggacaacgtaagctgtctccattgggcctcctggccaggggtctgggggactctggacgggagctctgggagtgccttttggccaggagcgaccaaatcctcctctattctcctctgggatttgtgtcgccatctaggtgcctcccttcacagccaagcttggctacacttactgtgtgtgtgcaaactaacacgctcataaactagtacccaaagcagaataaataggccctaccccaaaaattcatgaaatgaaaaagtgatttaacgggcatgtccaagagcccctctactaaagggaaatcaatggatttgcactgcagaatcaaattcagtgtaggtgacttctgacaggtgcacttggaaatctggattatcattagaggctggggttacacggtgactaaaaccagttcctactatagtgaaccttttccacccaaagtgaacacactgacccatcaaagtgagtagcttgtgacacaacatatgccagagcctgcagagtagcttgacttcttgaagcgttttcccatttctgcttagtctgtcccatcaacaccactctgctctcttctcccagttcccaggctgtccacatttccagataactccttgaccgggaaactcaaccaaagggggtacttttgcgtgtctctaggccaaaggacaggagtggtgataggtagaaggtaggaactggcatgtaggcagtgagatggtgtaaaggtcacagaggtcgggttggcttggttccgtttttgaaagtttatctctgtggatcacaggtttggatcagagcttctttagctcaaaacaccaaaaagttaggaaaatatcctttgtaggtcagattcttctgggcccaagccagtagggagaaaaaccagcggagtttttcactggtatgagggactgactagcttcacactcagccatctccacaggagcacatggaagctgcagctgtagcagattcccttcttcccctctgtgggagggagagcttctgaccgacttctttcttccagaagagtttgttagctgtgctgtggtttttgtttgattttacttctattatctttcaaagcttttgaggggaaggatcataagattaaaccaaagagaactgtgtcctgctgctgctgctgaccagagggaaatccgtatttcaagactagataggctgggcacagtgggtcactcctgtaattccagcaccttgggaggctgagacaggaggatcgctcgagcccaggagttcaagaccagcctgggcaacatagtgagactcccatctctacaaaaaaaaaattatctaggtgtggtggtatgcacctgtagtctcagataccgtggtggttgaggcaggagaatcacttgagccctggaggtcaaggctaccgtgatctgtgatcgtgccactgcactgcagcctgggagacaaaccctgtctcaaaaaacacactagacagaagacaagttgtgttgttctttcccttgatactcctttatatccatttaaatccctgaaatttaatggaaatcaagcagttaagtgaagcttttttcacccatatgtagtgtttcccctcttatttccagaagttggatctgtgcaacccactgggattgcgtgcttacacacagatgttacttgtagccttaaaccgaggtggtttagggttttaggatcacagtgccctctctaagaggaaaggtaaaagatctttggcaaattgcagagtctctaaacacacactactgctgcttgcctggtcattcataattaattagaagaaaaaaaaactttctatccccatcttctgcttccccctcctggtgggcagaatggttgagtaagataatcctcttaactgggacctctggagggtggaggcttgcctcattcatcttcacatcctcaggccttcacccttagaggtcccaaaaaagtttcccagaagaccgaacgagtagggatatttggggaaccttgccaattattggagggtgttttgttctgttacctttcggttgtctggaggtttgagaaacccaacatggcttgttctttccatcttatcttaaggatggcagcactgcgctctcaatcgccctggaagcaggacacaaggacatcgctgttcttctgtatgcccatgtcaactttgcaaaagcccagtctccggtcagtgttgtgcatttggcatttgtaaataggctgaaatccaccagactggtggacccccttcctccaggaattgacgggagacagattttatgttgattcagaaaatggaagttttagtctggagcttaagagttcatcctttccgcctccaccccgcaaaaagcaggagaactaatgttttagcagaggctggaccttgcttgtccttgcaagacatatgctcacagcttcccatagaggttttgattctgtgcagaattatccagatagcagcccctgagcccatggggatatttcgccatggttctggcattgttcctgaagcagatggcaggcagcctgtagtccacagttcactctgagtgggaaggtgacttcccaggacagccggacatagcactgctgagcccagctggccttggagctgtggacacctgttccctgttctcagccagagctctcctggctcgggctcacagctgcttgttgcctgtggtgggccaagatcctatgtcacagggtacacatctgcctgaggtcacttattaacccccagtttttttcctttcctggtctctagggcacccctaggcttggaaggaagacgtctcctggccccacccaccgaggttcatttgattgattgtatgcaaatagccctttatttacatgccactattaagctgctaattgttcctgttggggtgacagatactgaatgtatacgtattgtgcctgagctcaccagcaaacagaagcatcaagcccaggggtaaaggctgaagctttcacagtgcagagactgctagcctgggcacacacacctcctttctggccgtcttctgtgtagggcacactttaacccagtctctgttgctgttgagtctctgctccgttttgtacagtcacagggaattctgatctgaaggggcaccttctgttcactcccacaaagtggtgtctggttctcactgagacgttttaagatttttccacaaatatttatatgtactaaatgtggaaccattagaaagttcttccaaaatctcattccagcatagttttggatttttcttttgtcttattttaaaataaggaagtcgagatgactttgatcattggtaacttgggcctgggccagacaaagtataaaacttacaaaagaatattctcatttggtcttaactaggtagatgtaatatatgactttttataaaaagggtatctatatgaacttgacacagtattttcagcttttgtattccatactaaagccatgaagaactacacgtaacatcatcatttgtattaattgcacaactccaatgctaaaggttggattgtgttagaggaatcggctctgtatttgcctctagagaaacacagtgttctctttgtatttatggattcctttttaccgtgtcacatttactttggtcctctatgtatttaaatgtttgaagtgccttagactcttgccatattttcaaaataaaattccattaagctct

SEQ ID NO: 37834 - DNA, 1565 bp, Homo sapiens
gttgcaggcagacggagcagagcggtcagggatcatgagggagagtgcgttggagcgggggcctgtgcccgaggcgccggcggggggtcccgtgcacgccgtgacggtggtgaccctgctggagaagctggcctccatgctggagactctgcgggagcggcagggaggcctggctcgaaggcagggaggcctggcagggtccgtgcgccgcatccagagcggcctgggcgctctgagtcgcagccacgacaccaccagcaacaccttggcgcagctgctggccaaggcggagcgcgtgagctcgcacgccaacgccgcccaagagcgcgcggtgcgccgcgcagcccaggtgcagcggctggaggccaaccacgggctgctggtggcgcgcgggaagctccacgttctgctcttcaaggtcagtgacctcaaacggtccccaatccgaggcctttgccggcctgtgggccaccagctgggggctccccgcttccatccacctaccacacccacattcctgacccctcccgccgtctgttgctgtggaacagactcacagagccgcacccacttcccaagacccagccccatccctccctctcacgcctgagccccgcctggccaatccaagcccgcccagctctagctcaggccacgtccgcagaatttggtctgagtcccagccaatccctaaaataacggtggttgaaagggcattccgtgactgcgggcactatcctcttctcgcccctcaccaggcctcacctactttacagcgttttgcagttcgcacgcagctttccctccccttaccttcccacgcctgcctttccccccagactctggctgcggaggtaaaaggtttcccttgtgtaattaaggagtgagtttcgggctgctgggggtaaggagctgccaggatcagtgctgtgtccgtcacatgcaggaggagggtgaagtcccagccagcgctttccagaaggcaccagagcccttgggcccggcggaccagtccgagctgggcccagagcagctggaggccgaagttggagagagctcggacgaggagccggtggagtccagggcccagcggctgcggcgcaccggattgcagaaggtacagagcctccgaagggccctttcgggccggaaaggccctgcagcgccaccgcccaccccggtcaagccgcctcgccttgggcctggccggagcgctgaagcccagccggaagcccagcctgcgctggagcccacgctggagccagagcctccgcaggacaccgaggaagatcccgggagacctggggctgccgaagaagctctgctccaaatggagagtgtagcctgagggctggtgttgcctgcctcccctgtgcttgtgccttgtcccaaaataaatcctttcagaatgtagcactcacgccctaataaggagcgaatcctacatccaccaaggcgggcgctctggccctcccttccttaagcccagtcctgtgtcctctgaaagaggtgcagtcactcacacctgcttgcgctcaccatcaataaaagtaatttcacccgaa

SEQ ID NO: 37835 - DNA, 3300 bp, Homo sapiens; identical to SEQ ID NO: 35683

SEQ ID NO: 37836 - DNA, 11685 bp, Homo sapiens
cgaccgagcacagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaagtaactgaatttatttccgggcagagaggcgggaggttcagattgcatccgagtaggggtggcggccagtaaagaagcaaaatttagaggagcgcctgtcctagacctgcattttgaccagtcatcagaagaaaagaagtgtactttttgatttttaaggcctttaagttgagtgttaaaataccatctctgtctatcggtgtagggcctgatacttggctgccacacttatttttatactgtatttttttgagttggccagactgcgagctctttgaaggagggagggagctgagtggggcggggggaggggggtctcggtaattccaggtacttaacacaggagctaattatttgagtaatgttttatggtggtaggggtggtcattggcaaagcctggattagaattcatgccttccaacttaactcgcttttgcttttttccccctcccagttggttgtgaattcactccttaaaccaaaaaccaaattcttatgcagaatgaagactgctaagggaaagctaaaggcatagatgttacctttttaagaaacacattttggaacctttgtgagttatttcattgcttgagtcagctatcctcaaccctttattgcttgagaatgtttccctttgtaaaagagattgctaaaattacgtgttctaaagcactctgtttagagttagagttgcctatgggaaaagcagcatataagcatcctcgattcagagaggctgatttcgtccttagacgttttccccgttctgtcttaagatgacagtggtctctggccgggcgcggtggctcactcctgtaatcccagcactttggtaggctgaggcgggtggatcacctgaggtcaagagttcgagaccagcctggccaacatggtaagactccatctctactaaaaatataaaagttagatgggtgtggtggcgcgcgcctgtaatcccagctactcgggaggctgaggcaggagaatcgcttgaacccgcgaggcggaggtggcagtgggcggaggtctcgccattgcactccagcctggacaacaagagcgaaactccgcctcaaaaaaaaaaaaaaaaaagacattggtctcattgctttttcttcaacttctgctactgtggaggataattctctcccaagactgccccccttcccactttaaatcagactcccatttccacctgatgcactataagtatttccatggatagccactggaatctttcttcaaaagaattccgcaggttttacagtgttttgttgcattttttcttccaatttactataggcaagagcggacgttcggagattcgttttaaggtctaacagtcttagtcaaaacttgttacttgactctgatgatagctgtgcaaaacaaaagctaaaaaaaatggcttacaatctaaatattgcccgagggcatattttcttggtctggacagtatttttttgcaaattgaactgtcatttaaggatgagatttttattttctggctcttgttagcatttgagtttgcctctccaatataaaacttagtttctaactattcctaccttgtgcttgtcattatttgttgaggataatatgatgaaagcagcttaactgttttgtatcctcagcctttgttaatctacagaagaaagattgttgaaacagaccaaggttttggcactggaggtatgttaggtttcctggggagtaagtgtttccctagttgattctaatgtgtatccgggttcagaactacaagcaaatcacctttaaaattaaaaagagagggcagctataattaaattattttccttctctggtttctcactgtcttacacttcatccttggtagcataactcatgatatttcctgcttcactttctggaaatgtttaattgaattaatcgatttattgatagccccaggggatttgagggagcagtgaaaggaggtatgaaagataggctaactaaaatcccacgttatctccaaattcattcctattcctaagataactggacctaggataattaagtagttctttagtaggaagataaagatcatgtgttctagatgcgttcattccaggagtaaacttgaataaaatgacctctgatcttttggccccaatatttaatacctaaagaatggagcaagaagggtgtaatagaatagagttaactttagggggcagcaatacactgttttgctttcaatgtgtcttgctttttgactgtagatttttttttttttttttttgagaggatgtctcagtctgtcacccaggctggagtgcagtggcttaatctcggttcactgcaacctccgcgtcccgggttcaagctattcccctgtctcagcctcccaagtagctgagattacgggcatgcaccaccacgcctggctaagtttttgtatttttagtagagatggggtttcaccatgttggccaggctggtcgtgaacaagaagttggaaggggactgggccctcttgaactcctgacctcaagtgatcctcctgcctcagcctcccaaagtgtggagattactggcgtgagccaccgcgcccagccagatgtatgtttgttttgttttagcaaataactttatgtctgagagacagattcatagggtttgggtttgcatatctgtgttttggatcgttgaaaccttaagatttctctttctgcaacttctttttggctttggttgttctattgttaataacttattgctttcctttattaaaaagtttattacagaaaatttggtagttacaaacagcataagtaaatccaagtaatcattgcctacaatgtcactactgagaaatatcattttgttgcatattcttccatatttatgtgaatgtgtttgtgatggtttttaatgaatttaagatattatacatgctgttggagagattaaatatccacatatatacccagcaagtggcagagccaggattcgaaccccaggcagttaaaagtgtatgcggtttactacattctatttaatcagtcacctccaaatatcctttttgggtatttaggtttaccagtgtttcatataaaaataaatgcttaaatggaggtgaaatctttttaagtgaattttcacacatctcatattttcttacactggattcctagaagtattattgaatcaaagtatacctttattaggatctgtattaccatactgcattccacaaagggtataccattttacattctcaaaagtagtatcatctacactggtaattactctaattttaactagtttggtgggtgaaaagggacatgacattattttactttgctttttgtgaacttaaatattgtttgtgtattgatcatttgtatttcctctctttggaactgcctgttaagataaaaggcattttaaaaattagtcctgttgggagaactttgtaggatcaagaaaaaaatgatggaaaagaatctaacatttttacatctctcacatatcttcagtatcataaatacgtaagatggatgtagattaaatatttctgatttctaagtcttttatattccattctctttagatgtttcagtgtaattgtcagtaaattttattcttcttttacagttgacattttgctaaaggctgtgggagacactcctattatgaaaacaaagaagtgggcagtagagcgaacacgaaccatccaaggactcattgacttcatcaaaaagtttcttaaacttgtggcctcagaacagttggtatgaaaccaatggtgatgttttcctacaaaaatttgcagtagttcctaggcaacagtgaattaactgttgtttatagaaatgcatatggagccacatatgtcgcttttgttatgcccttttatccctttatttttatttattcattttttttttttgagacagtctcgctctgttgcccaggctggagtgcagtgacacactgcaaccttctcctcctggttcaagcgattctcctgcctcagccaccctagtagccaggattattacaggagtgcaccaccaagcctggctaatttttgtgtttttagtagagacggggccgcctcagaagtgctagaattacatgagtgtgccactgtgccctgccttatctcttgttagtggagtttatgtactttatcaaaggattctctggggaattctgaaatgaaatgttttagatttgttttacaatgtgaaccagtttatgtatttattttttgcctcctgtattgttttcctcagaaagtcacatgaaagtatgcatgaatacccatgcataaaaatctatcatagagcattgcaatatctgtacattactacagaagttttggattttttcagtttgttttgatagcagttacttttttcctatttttcttgaggtaagcaatgtatctttgccatatattgtgaaagaactaggaaatacttcatgttaacagtacacgttaagcacttcacagtggcagttgtagtaaaggttaattctttaaatgccactgcattttaatttggcatttgactacagaaatttaaatgtctacatgtatttggcacattaagtgttttttatatatacataattatatgtatgagacacctttatctgcaaatagatcacaatcttggatagtattaactcagatagcatgagtggataggtaattgaagaattgctaagtattttttaaataaaatcaggaatttttgggggcactgggggaaatatttgcttctgaacacaggcgtgtgcatgggtaaaacaagtgaactatcattaaagcaggacatgttggaatttctttttgtcagggaggagcaaaaaactgactctgatctaagagtttggctgcaagtgctctcacaaaagtgaagctaaatggaaaagtcaggggaatgaggacatacacttgagagaaatgagcagaggctgcatctttgctaaagatgcaacatgaagagttggtaaaataagagtactgagtaatttaatgcattagtttagaaatacatggagatttaagaaaaatgaaatgatactgtgttctgtgttaagagtcttgaaattttgtattgcctgtattcattcagtaacctgaaaggacttgattgataccaatacatagtaggttgaaccatataaaattgccatcattcagccattttaccctatgaaaacaatttcataagggttaaattaaatcctctgtagtgaatatgattatcctttcccatttaagcaataggaaacataagaattattttgtcattttcctagattaaactaaaactgatacctcctgaattttatctagcaaaatggatgttaaaggaaaaaaagtaatgctaggaattctgggaagatggtggaatcagaaggtacacgtgaatctctctgaaattctcacaaaacttagtcaactagatagcaaaaccaaaaacccctgattagtatttgtaacaaaactaggtgataaggtatccccatgagccccaaaacacatgttggtggggacaaaccaccagcaaccacaggacctgcatggtatcagcatctgtgctgaaagaagcagtaagaaacagggttggcatctgacggcactgagaaaagtagaacctcaaaaacgctaatagatcctgaccgggaagtaaagtgagccaatttaagaatagaagctgactaaggagttttgccctcttctgtagcacgtgatgacaatacatttgcactaaggacttgaagggctcaaacaatctcaaaatggacccaggagggctctgggaccccatactgaggagaaatttcaggaagtgaaatgaaaattgaaaagggtagggacatgagaaaggaaggaaagagaaagaccagatcaaaatggtggggaacagagcctggaaagctcaaagcaggcctccatcgttttgaatagtatacaaaaaacaacaaggggagctctgtgaagttagaaaaactaccctaattcacctcattctaaaagttgaggaaaactaatttcacataaaaacaataacaggaataacaaggtcaaatcccgtacagtgttacaagaaaaacgagatgcggaaaagaacagcatccctagagacgatgaaatcaagccagaaatatacacctataagacaagtcgaaaattgtaaccttgtatttcaaaatgagctaaaaacaataagatggtataagacatgaaagaaaaacgatcagcattagtaaaactaagaaatgaagctcaggaaaagaattagaaataaaagaaaattatttcagaaatggagactaaagtaggaggaacataaacaacggataatatgttaagaaaaatagaagatgaaaaaaatttaaaaagtgagtcaacctttggacaagagtctgtgaagaaaaccagagcaagggaacagaaaaaatactgtaaaaatgtcatttaaggtaagagatttgaaactacatattgaaaaaacatctgaagtacctgagagtatcaacccagaataatgaacatcaggatgcattctgttaaaattactggacttgaaatcatttggaaatgtaggggacgggaaagagggcatgacttagaaagttaggctgtcgtcaaactttgacagcaaagatgcttaaggaaaaagtgtgaaataaggctttcatatcctgcataactgacttaatcggggcacagactattagcagaaaatgctattccagtgaaccatgaggaatccactagacagagagctttataaccagaataactagagacatcaatttaaagactgctgatttaaaagcagaaagaaaaaaaagctgatttaaaggcaaagtaattaataaaactaactaattttgtctgcccaagttcttgcagtttggaaataatacttccatggaattttactttcacaaacctggagtaactacatgtactttaaagtaacaaattatacgccacttagcgattctgcagtggaattgatgatgttaacctgttacttatatagagctttatagtatgcaaacagatttatgtctttctgtcttttgaactaactgaattgcttttttaaaatttccagttaacacctgttacaaaatcacattgaatgcctttggttggttctctgctccatcgagtctgctgttttctgtgaacacaacaccatcttactctttgtctcctttgcctgtgaagtcctgattactgctttcttcacctggttaaatcctgcttatttcttatttcccacaaagccatcactgacccttttgctaggctagagtagtgtacatttctgtacgctacatacttcattagatgtacttttctcacccgtatttattcatgtgtgtctctgcctctcctacagattataagctcattgagggaagagatcacattaatcttcatagttccatgtacaattctcagcacatcatagacactgataaactaagctgttattgagagcccttcccctcatttataatgtacaagagtaaaatctggatttgctcataaattgtcaggcactgaacacaaattatatctgtattacaaaaaattcacattataatgcacattgttttctgttacagttctgaaatttttgtgccagaactctactcagccataaccacaaattgatatttcagcatgaactatttaaagataatttaacaataacgtctattgagtacatataccaggcactgaaagttagtgtattatctcattttgtctttcctaacagacccaagaggtataggtcctattattttccatatcttacaaataaagaggatgagagattatttgtaaagccaggattcaaacccaggtgtgtctcagagcctatacacttaatcaccacactatattggctaagagagatgcaagcaatattgatggttcatggttggtgatcaaaatagtatctgtcaaccaactattctgatacttttttttttaaatactaagtttaatccaggacattttagtcccaaatttggatattaaaggaaaactaaatatgttacctgcaaataaagttttgttttccaaaaagaaaattattaaagggcacttcaacactgtgactttaagtactagaaatattttagtaaaaacagactaaactgaaacattgagcagtgaatcctttaaagagcaaggttataaggttttaattgttactttttttcctgcttcatttgcctgtaagtgactttattaaaaaacctaagtatatatgtcatacatttacccaaggaaagtgtacaaactaccttgaatattagacatattgatttttggctgtgtgcctgtgtaattatcttaggagaaattctttgtgggtaagtggggacatttttacgataatgtaatttcttgaatagccagctcttcaaaagctatttgtaaaaaatatttaaaagtttcttagttatacaaagttaggaaccactgttctaggaactggaattgtgttatttttattcctctggaggaaaaatgagatcttcgtaatgatctctttaaattgactatttagaaaagttaggagttcagagaagctttcttcaattgtgaaaacaatacaaaatagctagctgattggaatgcagaaaaatgcagattaatcaggataccattaaacatctctgtttttccttcctttcttgtagtttatttatgtgaatcagtcctttgctccttccccagaccaagaagttggaactctctatgaggtaaaaaaaaaaaaaaaaaaaaaaaaaaaagaaagaaattactgcttttttttcttaatcgagtatgcacatctgtataatatgtatattgtgtagtattgttaattcacatttttatttcaagagatggcatgccattcttaattttctggggtagaaaagatgactttcttgttctgttatctaacatcttgatcatagaaagatattaataaattatacaatgattgaagaaccaaggaataaattacatttcaaagtcatcttcatgattctcataaagtaaggctttttctttatctacatttgatttcttctacattgttcttataatctgttatccaaatctgcctacaagaaattgagaaaacagcataagaatgactgtttaacatcttacagagtcattgtaatagttattagagtacacatactagcaccactactagaaaacagctaaaattacatatattgtggttggacatgtagagaaaggacaagattaaaatacataagctcattcatgcctaagatgcttaaaggacagattttattaaacacttaggattattaatatgtgtctgatagaaacaggcatcctttgaaagagatagcctgtaacataggtaacttaatatacgtgtgtggatatttatgatacatgtggcatttatcttcttagtttcatctaagaataataaaagattgagtttgatttattgccttttttttttgtagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattagactgataatttcttgaagtgaaatttaacctttttttctctttagtattatgtttataatgccatatttttagaaagcattccagatcaggcatggtggcttacacctgtaatcccagcactttggaaggctgaggtgtggggattgcgtgaagccacaagtttgagaccagcctggttagcaaggcaagatccccaactctacaaaaaaataaaaattaaaaaaaaattattaggctgcagaggcaagaggatcccctgagcccagaagttcaagggtatagtgagtcgtgattgtaccactgcattcctgctgagcaacagagtgagaccccatctcaaaaaagaaaaaaaaaggcattctagtaaatcgaatgtaatgtgaatggaatttcaaaacaggatctaagatggtatgtagtagaattcaaagtaatatcattttaaagttaaatgagtatggaaaaggtctgttctctagttttgtccagttcagtttactgaaggaatatatttaattatattcatatatttaacaaataaaaatatgttgaattttcgtattgtttgccactgagggttcagatgatagacctcaaaaaatcgaaaatactggttgaaatttgtagcatccatttagttattctttttgacctaaataacttaatagtttattaaatctaaggttagctaaatatgtagctaaccttatttgttttctttcctaacaactctgaagaatacataggactttgcactttttttttttttttttttttttaaa

SEQ ID NO: 37837 - DNA, 216898 bp, Homo sapiens
gtggatttggtcgtctccctgattccgagctgcgggcagggagaggggcctcgcgccgccctcagcagccggcggcggccgaggtagaccgagcggggacggaaggacagaccgacgtcgccgagctgggtaagcggcggctgggccgggcgctcggagtcggcagcgccctccgccctctccccacaggcgcgcacacccgtggcggcttctcccgcgcccgcctctttggggtcccggccccagaagacccggcttggccgcggcgggcgagtccccgcgtgggctcggccactttcgcgggctggagcgcggcgtgcgcgcgatcgcaggctcactggagccgctgcctcccgccgagggcttcccggccggcagcccgccggcttcccgaatgcgggctgagggcggcagcagcgctccgcggcgcgcctccaccgcgcacctgccggcgctctgcggctttggggagctcggggcggcaaggctgtcctgagagctggagcccaaagagggcctcggtggcaccagcgagacagcccaaagccacactggccagcgatcgatttgggggcgttcactccagtgccggggtccctggtggccgccggctctcccttccgatcggggactggagatcaggggaatgggaaaacatcatttgcgcgggttccataaggctcagggagagattcctaggcactgaatgggtctaagtgtttcatctcccggggctccctttgcggtgtatcgcccagcaggggtccagccccttagtttgagcaccacaggagtgctgggggttgaaatgggagtttgcttagggtcccagaggctccttatgaaccatttgagaatgtttccttccatgtgctctttcttgccccaccccacaagtgaggtagggatcctagaaaattctagccctttttatccatcccacaggtagtctctataatgccaatcatggtctagatgcccagagagtcaccagaaactaccattttagatccccgaaaaaagtccacctgtttggaatgacccttgccctagtgggagctacctactcaaactcagctctgctcaggagggatagaaataatggtggggaggaagttggataaaagatttggggctctaggtcagtaagggtctagaaatgagagccccatgaagtgggcaatggaaatctgaacaggtcccctgtaggaatcttagagtgacagtggcacaccagtagaaagtgcacaagggacatgaaggcagcatcagtttgaggggactgggactgccagtcatagcttgaggcagtcacttgggggcccatcagtttggaagaacccacagaaatttgggggcacattcatttccttccattcacgcgcacagtggacaaggcttatgagcggcaggccaagatgagtatcttggctggcctgggctggaggctttgagagcaggagtcaggtttagctctcccctctccccacacaatagcagtctccctcctttgctgggcttctttcccagatcttgaaacttcactcttccctctgggttggctttggattctggggccttctactgattgacagagccccaggaagagataaccttggctggaggaattcagctattcctaactgaaatgcacaacttttatgcaataaccccagaaagctcccagagttgcttgcagccctctcccctctgacctccaggcaagaaaagagaagaattcattaacttccctctctcttcacggagcaccatttgaactaattacctgggatctctccttggtggtggcctggaggctgaaggggcagtgaagagaaagggtagggaaccaaggaaacagtggaatctgtcatagcgaggttgtttttcattccccttcttccacctggcatcaccaccaacccctcctcattccagaacttgcccctgctgccaccaaccagcattacctaaaggagctatttccctccactccgcagccgatcgtcttcagggacctgctgataaagggagggcaatgcagattaccctctctgctccctcactgtcctcagcaaattgcattaggatgggggcaaactggcttgcaaagcagttaaatggaaatgacatttggagcgatgtgcagggaagatgctgaggagcagcagtggtaaagtaccaggagatctctatccagggaccatgagtctgccaaggaaatcccagctggtccttctttttggcagggcataaggacaggggtccctcaaagcctggagcaggacaggggggctggctagcttttcagcccaagtctaaatgaagagtatggcagtgtcttatgtccatcgcccaaaaccatgtcattacaaggttggtggcccccctttcagagctagtctgaatacctatccctgtcttcagagcaccagggaacattcaccctgcaactctcttgaccatcaaaagctgcagatgcggtgaatgtaaaagttccttcaccatctgttttactgaagtctgcacttaaaatgaggttaaaaagaaagccctcaaagaacagctacctgtttcctaggtccctttcccatttaccaatacttctgcttactcagctaatctttatttcatgggcaggttacaagaaaacataggaacaggaggggaaaccagtgacatggttaaatatacaaggcagcagctgacagcagcctaaactcaccactttaggtgctatgaaatatttatggtgctggagttgtcactgtttgggggttttatagtttctatcctacctcattttctatgattgcctccctaagatatagggtttggtgtgggggaggcaattcctgtctccagcagcacctccccaccaccaccagctgtctccctgcattgccacacagctgtctccacacacacgaactgaggcacaatatacttctgtccatcatggcaaatggagaggcaaggagcgcctagccaagcccccaccccccacccccattctgatcataaagagactggagcattgtgttacagtctgttaactagaaataattcaggactgactgtccatagggaaactggtagaaacaggctttgaggtgctgggagttttacagctcgtgtgcgttcccccctcagccccaatcaccaccgccccacccaggggcagtctgttatcaattcattatatgtgaatattctatttctacccttcacatatgctcagttcaaacaatgatgaatggaaccagttccctgaacagttttttcacttcgttacaaagatttcatgcctgattagagtaaatgaggggtgggtgtgcatccacttctttttcggtcatttctaaaggtgagccctatggagacagagagaaaggcagttcttcccagggtcaaacagctggtctcaaggcacgagggagggatggctggtaagaagaggatatccccgtcctcctgggcttagccctcaggctctcctgggcctcattccctggcatttgggcatatggaacctctttatctagctccacactgctccatctggaattggagggcataaatagaggcgagaaagttctttgttggggagcagggtccttgcggggtaagagtgtaaggggagaggaggaaggaagggcacagagctgaaagaaatggctgaggcctgagcagtgcaaaagttctctgcttctacagttggttaaccattaaccgccttccctgctctggttctgtctctctcttgggtgaaagaatatctctgggaaactcagaggaccagcaggtgttcccccataccccccttcaccccagcttaacatttgctgtgtctccactgtcctgccacagccccaggctcagccactgacccccactcacctcttcctcaccttcttcccctaccccagcatactcttcccacgcactgccagttgtccctttacccaggcattgccagttgtttgcagggcagggcgtgtgtcagagactgggaagcaggcacagaggtggggagaatctattgaagggagcagccggcttcacacaggattcggagcaggagctctgagctcaggttatagacagctctataaccactaggattttcctagtgcttctcactgtggatctggcttgtgggtggctgttttggccgtttgaagtgagtccatgtggtccaaggcctgaccaaggcattcctaacaagtcagacctggaatcctgaacatcaaagaaaaccagcaggtggatggaagatgtagatcaagatgcaggagcaaaggcacacatggaaagacagaagtcaagatgtgggcacaggcacagataaatggagagagggaggaagacagcaagggaagataaagacagagagattaacagtgtgaatgggggtggacagagctcagagtgaacacaaagagaaaagtgggaaagagagccttgcaggcagaagggggttttctgaatcttcactggccagggaggctctgggctgaactgagaagccgaagtagcaggttatctccactagaggggactcttgaaagccaggcttggcccaaaacagtggcttttgtgcttttttttttttttagaagaaaaaaaatattaatagatgagatatattcgaaactcccagccgtcacttcccagagactacaactggtagggtcctattgccagtgggacctttgggcctctgtctgtttgcagaggatgagaaggcgcctgcagcattaagctgggatgcatgggttgtgagcaactccggagaggcctgccccaacaggtcacgtctagggctgggtggcagggagggagtgcattctcaacttaacagggagtccaatctgctggctggcccgccaaaaggcccttgccgttcttatcagcaacagaagtttctgacccaaccccgaggggccttcacatgcttcccatctcccaactccctaaatacagatttttgagactctcaggtagtagcaaaactgctcctgaggagacttttttttaaaagagctttcaggaactgaatgcatgtcaacattgtatcgctgatttaatctttttcttcatattctctgtgggaatctttctctgaattataattccccctttcatttcagcagaggacaatattgagagacagcagagtccagaggcttttcttatctaaggagataataactgcctaacaggggcatggaaaaatattgaagtattgggatgggcaggagaccagagagcttagccccgtctcttccaatctgatagcatcccttgatagttcatcttggtttgctttagctcagatgtacctggacgtcagggcagggggaagggaggatagagaaaagaaagaagaaaaacaagataaatgtatcgtgttatgaaagtttaattctgcttttctttggctaaaattactttgagggtgaaagataaaaggtagtagagttgcccttggaaagttcaacttgtctttcagagggaagaggaggagggatcccagggctccgagtgaagagctggtgaatgagcctgtctcctctgatccccgcaaaacacacatattctctccgacgctttgagaggacggaagcttctgacagaggaaccctagcacctcccagccctcttggaggagttgttctcccaggctttctcttgttctgtctaaacagcctccctctcaaccatagtatagagggatagaagaaggagagattcttaccctttgcactgaaccaaataggatgacactgaaagcgggaattggaattcatttaagtttaaataaatagggatcgatcacctgtgtggtgccaagaatgtggtagctccctcctaatacaaggatgaaaaagtaatagatcttaccttcagggcatttacagtacactcagggagtggaggaagaaattgcatagccaagtacccccaaatacctttagtaaaaggcagaatggcattaacagtgtgtactagggggtcagaggaagtgagagcagacagctcctcaaagcctttgctttaagtcatgggaggtgaagatttccaggagagactcagaggtgctggagaacttcacagtttcctgtgaagaaggatgactatttaatgctctcgcagtctccagcctctcacagctacccgtacctacccagttttcccctcgttcttctctgaggattttaaactggacagcgctggagttgttttctattagtcaatatcctacggcaaggactccagggtgcacactcccaaggattttcgtgttgtattctatgtaaattgcatccctttctggtacttctggagctggcgtgtagaggccagtgtggtgcctcaggaaatattattactcatccacattcacatttaagtgtccagaatcctgctattatgcatctactcttatctgaatgaagttattaaatggaaggacctgagagggaagatttggattttatccctacaccttggctgtccactcctcgggctgcctctgccatgtgcttgctacctggagaaggagccaatctctttaaagctttctgtccataaagagggtagagggatactaatagagaaaggttaggaggatgaagatttcaactcaaagagaaggtagccattctgctttaagctttctgtccataaagagggtaagggatgctaatggagaaaggttagaaggacgaagatttcaactcaaaggctgtctctaatcctataaaggaaggtcatgctctccctgcacctcgtctgaggctgggggagccacatcagtgatgctgtcagggaactgacccctgcactgggaagcacagagctagggccatacttgggcttcaagaggcctgtgaaaccttggagattctatatcttcaagaatgatgtgggtatgtgtagtcttgtatttccgaagagaaggagttcttgccccctccacaatgtaaagaaccactagattccagtctctagagcctttcctagccgtcatttccgcttctgctctggtggtggaacagggctttggatgaggagctgtaaccccagtgcttctgagagtggtagacaactcactgagtgaacgagaacacgccagggacagctcagaatgtcagcggagcctatggattgtgattgctctgtgactatgggcaggtctttttacctttgagcaggggttagagggagcagccggccaggcagtgtgctccaccctttaagggagagagggtggaaggttcaggagcagaggaaggggtgtgtagaaaagccctgccttgccttatagaggcagcaggaccagcgggcagacagaagtggcaagaggggatgttgctgctttgaagtggtttcctgcttcataaaagtgaaaggcctcggctaggctgggtaaatattacgttggcctctgacctcccacctcccctgactgctccccggtttcccatttttttctcctgaggaacaaaaatacctgaaggagaagagccaattttttgaatttcactgagaacagcgttcttagcgggagcccagcccaagccagacaggaagacccaggctccttccccgtccacaggcaggaggcccctcgtgagtcagcaaagctctcgttccaggtctccactccacgttttagggcagtggtgttttccaggagcagggccggctgggatttcacagtgccctgacaacactgatgccccaccctgactccagctgcttaaaactttctaacaagtcccttcactctctgtgacattaaaacccaggctacgaggttttctgtaaggcaaacaccccaccccctgaggtttatctgtaaatgaacaaaatttgagtctaccgccccactctgagtgacccacagggggtcaagttcttcaagttcttcagctttcttggcccacagacttagagagaaagatctgaactgcatggggagctggaagcccctcccagcacaatcctgcaggaggtttaggccccactgagatggttgagagcagatggtcaggaagagcctggtgtcaaagaatcaaacaggaactaagtgcctgccttcacacttgtagcccttcccacttcctaaagatttctcacctgttgaccggtgctcaccctccgtttgttccctggtcccaggagggagataagaggttagttacgctctggcagaattggctcctgccccttacccagcacctcggtttctccatctgtataatggaatgaatactcaagcaccttcacttgtctttgtttctggagccaggcccgggaagagggtgttaggaaagttggaaaaacgacaagtgctggaaacaaggaaaactattctaaattttgggacaggtataagaagcgaaactagggttattttccccctctctctccaaatttgtttggaattttctgagaaaagtaagattttatttaaagaaaatctctatgctaaagaataaagggctgaagacttggtggagatgggacatagagaagaaagccaatagtggccctgcaaggagaccacattcagggcttgtggtcagcatttagccagtgggattggaatttgaattctgcctttgccgcccttgggtttttggtgccttcagagctctgagagtgtacatgaatgacactgtcgtaggattggtaggttggcattgctgtgggagtcaacccttcatggaataagaaaacgcagagctcatgggtatctggctgcctggctgcaacagggcttgcatctctcctgcacagagtagcttttacccaggcccacatagtggatgtgaaacccaagtccaaattgggtaagtgcattgccgtgagtcacacagcaagctgccattcactgccctccaattgctaggaggtttgtttgccccagcgtcacccgccacactctcttgatctgcccacttagctaccttttctttccagtctcttgtcccctgcactgtgcccagtgacctcccccatctctctcttccttggttttgagcagacaggcatctcacgagagctcctgggggcagggacatggatggagcagacacatcacagagtgtgttagcaggagtggagtccaggagcccaagctggacgctggggctcagggatcagatccttggtagcactgatcatcggtcaaaacctagcaggatgtctggggagaagcattagctgtcttctagtaggccaagaagctccccaagcaacacaaggagctttgtccctgttggaaatgcagagtgcgggatggggcctgtgagaggagagtcctaaacatcccatagcactgtccaagagcctgctgcagaaaatggggtcagcaagagcccttgattttcctttctaaatattattttttaagaaagagtttgaactgcagaataaataggtgtttggtgtagaatacttgggaaatgtttttgagtgtttaatagtaccttttacccgggcccacacagtggatgtgaaacccaagtccaaactgggtaagtgtattgccctgagtcacacagcaagctgccattcactgccctccaattgctaggatatttgtttgccccagcctcactcaccacactctcttgatctgcccacttagctaccttttcttttcggtctcttgtcccctgcactgtgcccagtgacctcccccatctctctcttccttggtttagagcagacaggcatctcacgatgaagcagtattccctgtgagaactgacctctcctcttctcttcccatctgccggcccttagcacacaccacagcccttccatggtgctgcgcagtgtggtgtcaaaagacccccccttttaaatagctccaaccagctttcctccatccacagcaagccttgatatttgcacagtcaatggctctggcaaggccaagctgcccctccctccccgagaggcactgtgggcactgtttgtgtttcagtctctatagactcagcattcacagcttgaagaggctgagacaatgacccaagcagctgcctgcaaactgtgctggctgggaggcgcagagagctccagtctcacaaggctgcgagggaatgagaggcagggagggtcgccccagcttggatttgcacaccatgcacctgggagcattctcaggcagctgtggctgacctggaggaaatgaagagggctgggatccagagaacctggtctaggccacccgattgacttccactgcgggcccccagcttccttggccaaattttccaccaactgtgcagtccctgggggccaggaagaaaaagcagggccctggggaagcagccatgtctggcctggggatgggaagaggcaacatttgtctgcatagagaaaaatagaaagcttcacctgggagaagaaaaaaagatacgttccttgcaagaaattttaaagttggtgcagcataatttcatttgactgaacgagtgtttatagaatatccatataccgagtatgatagaggggagacaagtcattgtccaggctcttgaggaggtttcaacctggcaagagagggtatgcacgcaaatcatcgtcctacaagtcacaaataagtattgcaaaaagacagaaggagagagattagccagagctatcccagcctggaaaaggctacttagggagggaatgggctctacaacatttagggaattcaagcagaggctagaagatggccaggtctcaagaagagattcctgcatagagcagaaaggtatcgtagctgatagctgaggtctccacccaccctaaatcttctaagcttgagttccctctttgctgctaagtaaatccaaattcagtggaggaaaaggctgtgttatgaagtggagtgtcaggtccatacaattgaattccaaagtaagtaaagttggttctcacaccttcaggcccatggcagtctccaccgagcagggtgcgaggaaggctaggctgggattagccctggtctcctctggagccagaattctcctaatcatgttaaaattaacactccctctacaagcaggagcagacccctctgaactgagatttggtcaattctctgcttgcacagctctaacttcttctaatcattgtcataaacgggacggaagcagctgctcactccagtctattatcagcttggttggagacagagaaatttaaatgacagtaagatgcttagcaaagaaacgaaagtcagtgttaaaaataaagaaaacaagacagcttgtttcatcgaaatagaagggttattaaacaggcctgaattaatcagtgatctgccactgtcgggaattgaagagcagcagggccagggctgagagctgggaggagatgggtaaggagaggagtcaaggcagataggagccttctgcactcttgggctggctgcagggactgcagaggtgcttggtcttcagaggggttgctggcagctgcattctttcccacaataaagggccggctggggagagggagactggcacagtggtctctccttacagatttgtgcttttggatcctttccatctgccaccacctgtgcaagcccctggggccatgtccaggcctcagcccctccccagccctccttcccacccgccagaactgggcaagagccaaatggcattcagtggatggccagcagctcccagccccaggccttttcctctaaacattcacagggcccaagaattcaactctgagtcacagctccttagaccccatatccatttgcaaagagtagtaacaggatatccccaactatggtcagagtattgcttatgtgcaggcagagagtatcctcttgagtaagtgatctcttccaagatatatcagttggtggcatctgcaacgtcaggcagcagagaagccaagtgacatgtttaactccaggaccccccaagtccaagtcccactttcacatctggtgcctttgccaaaatattcaacctcaaatatacctaagtcctctcacctgtaaactggtgatgcgtatgctgctctcaacctcaccagcttgagtaaggggtacgttagcgggatgatgcatgtgaaatttttaggaaactataaaatcattgcacaaatacttgttcgtattacagtggggtcccttgcacactcagaaccaaacatcagaagaaaggtttttccgaagggcatggaatgcatctgggaggagagcagacagacgtgctcacaccttcgcaggcgtgtggaggggagggcgggtgaccaggcacatctgtgtgcacatgtgccttcatccggtgcggaacatgttggatcttgagtcaatcactccaggagcattttctttgctccttgacctccacattctttctcctcacccctccctcccgcttccctcctgggtccctcctggctgtttacccttttcccggcttctctctcacaccccattcatcatccagggccagattctcactcagggagcacttttcatctcctgccctaggtcctccctccccggcctgccattcccaccctgctccccatcagcacattcttccccctgtctcaacctctcagaaaactgcgcccgtcactctccctcacagtgggctgagggatccaagaggtccggggctgggctgatagcgcctcaagggtctcaaatgtctactaactgtgctccttcaccaagggactgatgccactccaggtgcttaagggtccttcaggccgagtgtctctacatcttggcacagaaaagacctttaagtggtcagacctctgcccagagttccagccacccctcagtttctgcatgcccctttaatccagctccatggcactccccttgcttggtgtgtgtaattgtgagcgtgcctgttacttaggagaggctgtctgacagctaaggatctctactgcaagagctgggagtctcagacaaagagagaaaaataatagaaactgcaggtaggaagatacagggtggggacatagcctgcttaagaagcttcctcctgaaaaggagttaaagcttttttattggaaggctggctgttggttcagaaaagcactagagagaaagaaaggcagggaaagacaaggaagggagaggaacttcagcctgtgtactgaggcagacctgtatgggaagggcccagagaatgcgaggccccagcctaaggagctggtatctcagcatcttctcctcctcctcaggaccggttttcctctttcctcctccacacccttctgtgctgccacaggtgcctggacaacccagcaagagcaacacaagtggtcctaaatcacccaagggccatgagaggagggtggcctgaaatcatgggaccactgatagaaatggtgggaatgacaactcaagacctcaggtcagcacggggagaaggtgggactagcagcaccctgtttgtttcttccgagaggactgggtctggggaggcaggtgctgggtcaccaggttctgctgcacaatgatcaccaatctctcgagctaaaacagaaccctcggagtttgtcaccatcatacaaggcagccaaggagatgatgtccttgtacagtgtttctccaaaagcagaaacaagaataactggtgtttacttagagctctagagtttacaaaacaatttcacatccattatctcattgattctcaccacaaccctgtgaggtgtcattttacagctgaggaaagcgaggctccaaaaggttaaataacatgttcaaggtcaccagactcgtaagtgatagaatgagacttgagcccaggtccgtctccaaaggccaaggtcttttctctgcgccatccagcgctgcgagtttgacctccttgttgaagaccctgttctggaaccttccaaggggacttccctcaccccactctgttcatcactttatattgtgaatttgtcattttttattattatgtgctttttatgtgatccatgatattatatggttaacggctctggagctgtcttgcaaagacttttcctgcacaagtctagattatacattcttcaaagacagagctggtatcttcccattcttctccatctttcttcccacctcacccatctagcctcacccagtgggttcaaggcaaataatagccaggatccttcctaaatcatttacctccttcttcactacctcctgaagatcagtcatgacagatccctgagccaagtgtattagttcaaatcatttcttgaggccaactagtagggacagtgtccactgagaaaaagcaaatgagcacacctgggcaccccctcgcgctgctcttgacaattcaggctgaacacaatactgagtgaaagttatcatgctagccctgcacggataccaagaagcacgagatattgttcctgccttcaaagagcctctaattcagtggggagataggaaatagtcacataaaaaagacagctcaatgctgcaatgtagtgtgtgctagaatcagtgtgtgattctagcctctccacctccaatctcctttctctcctccaaagtcaattaaaaactagcagtttttagagagaaagagaggcagggaaagacaaggaaggaagaggaaatttagcctgtgtactgaggcagacctgtatgggaagggcccagagaatgcggggctgagcctaaggagctggtatctcagcatcttctcctcctcctcaggaccggttttcccctttcctcctctacgcccttctgtgctgccacaggtgcctggacaaaccagcaagagcaacacaagtggtcctaaatcacccgagggccatgagaggaaaccattaaaaccagcagtttttaattgactttggaggagagaaaggagattggagatggagaggccctagagggtttatgaggctttgaaggatgggctgggtatggataggcaaagaagggagtggaaacaagcattccagggcagggcgttttggggactcaacagaccaaccagtttgttgggagaggagtcactctgggagaggtgggcagtgaggttagagaaagacagaagagccagctgggaaaggacttgaacttgggtgcttagcagtgctgagtctatctgggcaacagcccagatagaaacacagaaggtgtttccataggtgaatttcacacttcagccatgtgcctggcaaagtcagacaatgggtctgagacacaaggaatgaggcagcacaaggcacaacttgcagatctgtggctggatcttggctgccaatgggtttcaccagggtccatctcagaggaaggcctggatggtgacaatgtcactgtcttacaagcattattttcagggaggcagcacgaggattcctggtgaagagccccgccctttgaacttttgggaaccctagcttctggaaatgagcagtgctaaaaagtgcacatcatctggcactaatggccactctccctgagatagagatgaagcatcagggattgggagtgatccttgtccctagagcacttcagtggccagccatgtgaggtcactggaggtaacaaggaaggtctgcaaaagaaagcaggaagttctctcacctgggtctcctgggagccattaacatttttcttcaagaagaaaaagatgtggacagcttcaaaggagagtaagtgggattttagggtcagttcatggaccgagagttgagatgaatgcctactgctttgttttggctttttcttactccctcattgttcctccttttttctcccagtagtataaattagagcagtgtcattatttttgaaaacattatgtttaatggcagcacaatatgccattatatggagtaactgtaatttatttaaccttttagttgagtactttttaagcttgctctcctgccccatctcaacctcgaagagtccctggctctcccttgtacagtgaagactggatgagagacatttccaggctctttgaaaatatcatttggaattgctctgaaaggcggctgccaagctagcaaagctcctgccacaaaacacccctggattccacctggtgcttgataaccaggactcctgtgtgccctaccccagcactgcctggttaccaaaataaaggatcagctcagggtagacataaatggaactgtggagcctcaagttttgacctttaacataaagtacttgccaagtcttactaaacattctggtgagttctcccagaccagtgataagaaggtttggctgaaaaataagtcttaaaaatctaggcagtgtagaatagtagggaaagcatgggcctcgagaatcttggcttcttagctgatgctcgtcacgttaggcttcctgagattccatttcttcatctgtgaaatggggatagtcatgctcaccttgcaagctaatcacacaactatggatagcatatacagggcatgtagcatagcgtgtcatgtagcaggtggttaataaataataataatagtagctactcttcatagttttttttccagaaaataagtgagagttgctagtaatttgctactcatggtcattagagtatgaggtctcctaacatgaatcttgacttggcttggcaaagccatatgcctacttttatttccttttcctgcctttggaaggagcctgagaattcctttttttgtcctttaatcccataatgtctaccagaacagcaactcaattgataagatggtttaaatagggtcctgttagaatcagggaagaggtgggatgacctttctcggactccgtttgcacagaaggctggagtgctcccacagcctgcttctcatagcatcagagccctgctaatttggagaaattctttctgacccagcggggaggtggccatggcaaagcagggctccttcctgaccctcccccaaagggggttgaagagggcagagcctaaggaagggggagcaggggatggggtggcagggaaggcagctgcttgaaattgattgttcttgtattttagtttataccatgcggctctctcagctctgcccgggtggcgacctttagataataaagggaattctgggagatttctgacaggcccatgacatatggggcaggtctgcagggtcaggcggtgtatctccctgctcccggccccagggtaatgaatcttgttttgactttgcaaagccagctcagccagtgccccagaaagaaacagagcccccgccagcccctcagatgagtgcacatcttggaacccttcataattcagggatacaactccaaacttttatagcctgtgagtggagaggacaaacactacatgttttgctaaggccctgggagagctggtgtggtttccagggctcgatcagagcctactgggagacctgggaaaaaaaaaacaacagaaatctctccctgacgttaaaagcagtcccaggacagggcttgtgcctggaggaggagccggggtgggagtgagagagatctctccttggggtctggcaagtggcagattcactcttctgggcaggagaagcaaaaaaagggtagggtccactctgcaggaacagcagaaatcagcacatcctaattcgcatcccaaagctatcatgggcagagcaagtgagttctctgggctactgttttctgggctaggtgaaggcagcaggagtcagagatacccgcctatctctgcaaattttcgtgtgcctgcacacccagacccctctcctttaaaagaacaattcctgaaccatgaagtttgagtgcctttctcctccctgttgtattagtttgccagggttgctgtaacaaagtatcacagaccaggtggcttaaataacagaaatttattttctccaagttcagaaactgggaagtcccagatgaggatgtgggcagagttgattccttctgatggctgtgagggaaggagctgttccagacctctcttctgagcttgtagatggtcagatgaggatgtggatgtctctttacatcacctggcctctgtgagtgtctgtctcaggctccacatttccccctttttataaggacaccagatcacaccgcattagagcctaccctagtgacctcatcttaacctgattacctctgtagagaccctgtctcagggacgggtgccatggctcacgcctgtaatcccagcattttgggaggccgaggctagaggatcacttgagcccaggagttcaagaccagcctggctagcatcatgaaacctcatctctacaaaaataaaaataaaaattagccaggtgtagacaggtgcctgtggccccacagatccctgtggttcctagggctgatgtgggaggatggtttgagtccaggagatggaggctgcaaggagctgagatcgcgccactgcactccagactgggagacagagcgagaccccgtctcaaaaaaaccaaaccaaaacaacagtaacaaaagacaccgtctcaaataagaacacattctgaggtacttagggttaggcttcaacacaggaatttccaggggacacaattcagcctttaactcaatccctcgctttcttgctagtatccagcccctgcacttgtgccccattaccctgcctctgttcaccactgcagagatggagggtccctcactgtcacgcacatatgtaagatctaagggccttgtccaaagctgagagccgcacgcagctcccctctcacagcccctgctgcctcaccgcctggagtatgggttctttccttattactgatcgagattttgagagcctccccaaatttccatctcttactccttggttattggagcgtggatgtagtttatcccacctgtgaaacgaatcgcatatatgaagataagcaggagatccaccttctcatagtaagagagggtgactgggtagaaattgtcacccaaatttgtcttgacacctcctggaggggccacagtgtcatctgtgtcaccttctcagagaaggctgccaagggtacatgcaggcagagacctattttcctcccctctctcctctcaccttccttcttcactctggggcaaggtatagccacttcgcttcacataaccgcacagagtctagggaaaaaatgacattcgattaatgaagcaaacgcagctggtacagaagtgacatctaaattgttcctttggtcccgctattttccataggaaattctttctctcctcacccccctcccccttttccctttaaatcgcgtgcataaaatatactaataacaatcttcggtgtctgtgcatgagtgacagctgaaataagaaaaagactaatcgtacctcctgcagccctgtcacatggagattaaatgagtctctctccccaccctctccctgctccccaccccctcacccccactctctcctctctcttggttctcaatgagaatcatgggcatttgaataataatattatagacgccatcagagtgacagtggggaaaaaatcagctcaaacccatgattattccttcactctaataattatttaaataccagataactcctttcactctaattgaggactttcagccgtcggcattacccggggcttttgcgttcgccctcttgctcaccttgtgctacccaacgtgcctggactacctctaaggtcggtgttagacagagcgatgctcagaatgcttgcacgtacagctgcacaagggatatgaagacaggtccttcagtagcattccacccacggggaaaagatggggcctcagactctcacatttagacaattttattctcacagaaatcttaaaccaaaaggagccttctgagatcattgggaccaatcccctgcctctaggtaaactgattcctaggcagcttccaggaaaattcaatatcagaaaatttcagaatctccttggcaggatgctctgcagatcctctctaggcagaatgtcccccttaatatctaactttaatcccttctgctgtagctctaactctttgggaagaaggagctttctgtgcatagactaaatctgacctgtccgtggggttgtggcagaggacaccatagcccccaagttacagcataggtgacggtcctgagtgtgacatttgcctgggcctgcctgggcctagaagaggacagaagcaatcattctccccaagggggaaaggagccattcggacatgtgtctttctttcattctgccccttaatccgcccctctttgaatctgccctgagcaccacctcgttgtccaggcccaatgccacactcacttctgcgtatcatggggctattatcaaaggcatccactttcccgaaaacaggacagcctgaaggcaaaacgtaactaactcccaggacccttccacctacaatggaggaagcgcctgcctttttgtcatgaggtctgggttctgactgcagcctgtttctgactcactttgagtcgccctggtcaatttgtttcctttctgtgggctgtggtgtctttcatattaaaaaaaaaaaaaaacagtgggttggaataatcttataatctccctcagcattctcctgctttaaaggcactactcattagaaggaagagctgaaggagaagacggactcctctccatcatgggaaaggaaggaggctaagtgacttccaggaacagctgctaacttccctgatttcacagccctcattttcatgctcatcttttccctaccaccgtctggctcctcagagtgtgtgagctccctagtaggtgcagtagtaatagtaggcaccctttgctgttattgttatgaaaactgtcagctccaggatggtgctggaggtgacgatgatgttgatgacagggttgttaggaatggagttagtggcaagtggagctacagatgggcccacgggtatgagagctactaacaggaactttgactcaatttggcaaaatcgtatttcaaatctaaattctctttccaccagctccttttgctataagggaaagccaagtggaaacgtagaggcatgtgcacccagatctcctgaaaagggcaataggagagggtagcagggaggagacaatcctctactgagctgaactggaaacgcctgattgtcatttcttccctgctttgccactgacgcccgcagcagctgatcaggaaggtatcagatgccttcactagctgtcactaacacctgcctcctgaatcctgatcggggagatggtgtcatcgggccctccacataaaatatttagtggcacttgcttcccaaagaggcaagcgtggcctctccttggcatcaggaacgctccgagttacatgtgctgggagactctcttgttcaggcgagagtcctggagcagcatacctggtttgagacttggagtaggagagagggaaactggtagaacagagactaggcaagttttggctcttgagaatgcatgtgacaagtgacttcatgcactaaacagagagggatgtgacagaaagaagaaagcatcattattaagagaaaactcctgaggttgacactagcagaaaattggggataggaggaagtcacactgggtatgcaaagtcaaatgcatgtttgtttaccagtgtctaccaaactgaggatgggaaattcattctaagacagatgatgggatggatggaggtgaggagctggaaataatgacaaataaattgctaataacaaaggctaatgtatcttaaacacttaagatggccatgaactgttctaagtgcttttatatgtattaactgatttcattgtaataatcctatgacgtagctactagtactaaacctattttatatagatagttagataacatcatagaatggctaagtaccttgaccaagtgtacacagctataggctccatttgcgtccaggcacctaagttcagagctcatgcatttaattgttatatcgcactgcctctcaccagaggcacaaaggtgggctccatcctcccttactcagaatgtggataggagtcctgatctttgcccactgggctctgcttggaacagccacttagtcacatcaatttggcatagaaagatgaaggctctcaacgtgcccttgaagtcagctgtcttcatgaaggccacactcccaaggtggggtgcaaacctcccctcactgcaggagactgtgcctcctcttgactccagtgtccaatgacagctgctcccaggcgggcagtccctgagtcctgtgagatgaattcacttggctggttatcaggagtggcctgtcccaaagcaaatgctgcatgagggtgagaggaaaacagcccagctggagtggtctgtttagaactactggcctgaaaaaaaaaaaaaaaaaaaaaaaaaacagaaaaagaaaaaagctcctgacctaatcagcctctccaggttggagcaaaaaacctcagctgctattggaatcacagactccaggaactgaaggaactaagcttcgaggtagcattttatctgaaaaaggaaatcttataggttgactaattcaaataccttttgttttaagatcaagaaataggctcatggaaatgccagactggtctaaagtgagtgacactataattcatgagtcacacaggcagaatgtgaacccagggttcctgagtctcccacctttcttcctgccctgtgacctcatgccttctagacatcaggacgtttctcattctcagtctaactctcaggatcctgtgtttccaccagccttcctgcagtctgcggagaggctatattgggacttgtgcagtagtatgacaaagaagatcaccttggatctatttctttccccttgccacatgcttcccagactgagctctgtcactgggtcggggaggcctagggatcaaaggcacacccacagtgttcatctcattgtgggtgggaaaggaagaatataagcaaaaagagaagtcaagagctgtggcaggatttcagaagtgccatctcctgtggagtcttcaaagacaataacaggccaggtgcagtggctcacgcctgtaatcccagcactttgggaggccaaggcaggtggatcacgaggtcaggagattgagagcagtgtgaccaacatggtgaaaccctgtctttactaaaaatacaaaaaaaaaaaaaaaattaggcgggtgtggtggcacgtgcctgtagtcccatctactgtggaggctgaggcagcagaatcgcttgaaccagggaggcggaggtctcaatgagctgagatcataccactgcactccagcctgggcgacagagcaagactctgtctcaataataataataataacaaaaactaacataagttaagtgctcactgtgtgcctgcaaccatgctaagaggttggtctctatattgtctcatttactgtcatgacaacttgaaaggtacatactgtagttattcccattctaccagaaagggacatgagacttgacttgcctcaaatcccaaatttgttcccagattctgtctaacaacaacaaaagccactcactattcaaactgtgtcttgggaggataccaagcagggaggtgaggtggctgatcttaaccgcatactaagtccttccatgttatctctgctaccagaacccccttcctcccctcgcggctcctcaaggaggaaccactctccacctggaacccaaggagattttcttcccagcgacaggggcagagaatggcctcttgcaattccccatccagctggagaatttaaggattctgttatttcctttccacagctcctcttcaggaattcacgtcctgctaccggcctcaggacatagctaaaaataacctctggtttccaaactgaaagccctgtctgttgggaggctttgccggtgtgcgcctggggccggaagggctgtgtcggagtagctgaggtcagcctgagtctcatgccggtgttgccttcctctttccaaggaagcccagggcctcatgagtcaccccgaacaccctgggggagtcgggttggaggagggagttaggtgggacctactgtggcaccacggtggctgccaggccgaggatgcagaactgaacaagaggaagggtcgttcctaaagaaactctaggggattctctaagtggtgtctgttctaattataacccaatccagccagaatggggagttgagggagaaaggcctctcctaagctgccttggagcaaactctccatccttcgggtgtttccatccctgccaccttatgtgcccagagttctgtctggacttgcctgagaaggttgctggatgatcttccagctgagaaaagctttctctgccggacagctcgctgccttctcctggtgccgcagtcacttcccactgtccctctccataagtcaggacagtaccatgatagtgatggaacaggccctgctctctgacctccaggtcctgctctctgacctccaggctctgctctctgacttcctgcccctggcccagactgcccctggctacaggctgtcctcaggagccccaccttgcccctctgggcagcttccttggaacagggaagaataagcaccaaggctctggaagtggaggagccttaaagcctgggagtcaggaggcagggggaagagtaaaggagtcagggctagagactgggcttcgagcatggcccactgaggcccgctggtgatttcatggatgctgaaacagtcaggaggccccagcagtgcctgaaatgagactgaatctcacctcaccaccctttgctgctccccacattctcccaaatctggtacccctgccccaggtggctgaagctggactcagccagccagtaacccctagcaaggagactggttctctgtgtgtcctggcttcccatgtgctctgcctgcagagaggcagaggttgaagcaatttcccgaggacctggctacctggcagcagctgggcgtccaccttgagaaggatgggggaatctcaagagatctgcctgtctcccgagggcttttccggctccggaatggcacatgtgggaatcccagtcttgttggctacaacatttttccctttcctaacaagttctaacagctgttctaacagctagtgatcaggggttcttcttgctggagaagaaagggctgagggcagagcagggcactctcactcagggtgaccagctccttgcctctctgtggataacagagcatgagaaagtgaagagatgcagcggagtgaggtgatggaagtctaaaataggaaggaattttgtgtgcaatatcagactctgggagcagttgacctggagagcctgggggagggcctgcctaacaagctttcaaaaaacaggagcgacttccactgggctgggataagacgtgccggtaggatagggaagactgggtttagtcctaatatcaaattgactggctgggtgaacttcaacagccttttaacctctctgggagatgaaaacgatggcttaaggggccagaaatagagatgctttgtaaaataaaattttaaaaaaagcaagtattttatagcataaaggctagagaccaaaatagataacaggattccctgaacattcctaagagggagaaagtatgttaaaaatagaaaaaccaaaatgcagaaggaggagactcacagagctaaaccaggatggggaccctgggtcaggccagcctctttgctcctcccggaaattatttttggtctgaccactctgccttgtgttttgcagaatcatgtgagggccaaccggggaaggtggagcagatgagcacacacaggagccgtctcctcaccgccgcccctctcagcatggaacagaggcggccctggccccgggccctggaggtggacagccgctctgtggtcctgctctcagtggtctgggtgctgctggcccccccagcagccggcatgcctcagttcagcaccttccactctgagaatcgtgactggaccttcaaccacttgaccgtccaccaagggacgggggccgtctatgtgggggccatcaaccgggtctataagctgacaggcaacctgaccatccaggtggctcataagacagggccagaagaggacaacaagtcttgttacccgcccctcatcgtgcagccctgcagcgaagtgctcaccctcaccaacaatgtcaacaagctgctcatcattgactactctgagaaccgcctgctggcctgtgggagcctctaccagggggtctgcaagctgctgcggctggatgacctcttcatcctggtggagccatcccacaagaaggagcactacctgtccagtgtcaacaagacgggcaccatgtacggggtgattgtgcgctctgagggtgaggatggcaagctcttcatcggcacggctgtggatgggaagcaggattacttcccgaccctgtccagccggaagctgccccgagaccctgagtcctcagccatgctcgactatgagctacacagcgattttgtctcctctctcatcaagatcccttcagacaccctggccctggtctcccactttgacatcttctacatctacggctttgctagtgggggctttgtctactttctcactgtccagcccgagacccctgagggtgtggccatcaactccgctggagacctcttctacacctcacgcatcgtgcggctctgcaaggatgaccccaagttccactcatacgtgtccctgcccttcggctgcacccgggccggggtggaataccgcctcctgcaggctgcttacctggccaagcctggggactcactggcccaggccttcaatatcaccagccaggacgatgtactctttgccatcttctccaaagggcagaagcagtatcaccacccgcccgatgactctgccctgtgtgccttccctatccgggccatcaacttgcagatcaaggagcgcctgcagtcctgctaccagggcgagggcaacctggagctcaactggctgctggggaaggacgtccagtgcaccaaggcggtaaggaggcacacacctcgctctgctcctgctccatgacacaggttccaaccttcctgtccatgccctggggcacatctgctcccacaccaccatggacctgaaatgaaagaggttttcagactcaggttatcaggtggtaaccaataacgcagggtcttacgtacaccagatacttgagatatgtgtgttgatttgttgtcatttcaaatatatgtattgagtgcctacatcacatcaggtgctattgtaaatgctgcaggcttcagctgtgaaccatacaaccctacaaagctcactgccctcatggagattacacgctagttgggtgagacaaatgaacacataatacatgttagtttgccaaatggtgataatggctatagagaaaaataaacaggaaagggggagaggcagtagctgagaggactgactcattgagaaagtggtgtctaagcaaaaactgaggatgggaagaaagggagccacacaagtgtccagagaaagcattccagagagagaaagggtgaggagaatgtgcaaagaattcagggcatgcctggagtgtctgaggaacagtaaggaggcaactgcagccagatcagagtatgtgagagaaagagcagcaggtgatggggtccatcagaagtaatggggaccaggtcatgtacacacagagctgtaggccactgtggttcccagtgagggggtcaagtggagatcagaaatctaagtcagaggagagggaagggagtctggcttgaccaactgatggaaaactggagaagaatcaggagtgtgggcaaaggcaaaagaggagaggatgaaaagctcagaatccagacctgaggaaagcagagacaagaaaatcagtggcaagcactgccctgtcagcggctcatggtgctgccatcaaagtattcatgatccactcttcttccatcattcatccaaccatccaatcatccattcatttatccacccatctctcctttcatccatcccctttccttccctccttttattctcctatccatctatccctccatcctccttagctctctccctccatgcatctctccatccatccatccatccatcatccatccatccatctattcacctatttacctaaacctccattcatctgtccctgatccttcccttcattctttcctccatcccttcctccatcccttcatccatctctttatccactcatccctcttttttctcccttaatctatgtctccatatctttatctatccatcatccatttgtctacctagccctccatctatccattcatccctctctttattcatccaccatcatccatctacccatccctctattcatttacaagtagtattgaagatcttctgaatgcctggcactgtactaggcactggggttgcaaacataaaaagacatgatcggctgggtgcggtggctcacacctgtactcccagcactttggcaggctaaggtaggcagattgcttgagctcaggagttcgagaccagcctgggcaacatgacaaaactccgtctctacaaaaattccaaaaattagctgggtgtggtgatgcacacctgtagtaccagctactctggaggcctgagcatgggaggtggaggttgcagtgagccaagattgtgctactatactccagcctgggtgacagagtgagaccctgtctcagaaaaaaaaaagacatgatcactagtctcacagatcttataatctagtagggggaagagagagagagagaggaagagagagagagctagagacagctggcaacataatgtagtggctcagagtttgaggttctgagacaaaagccaggcttcaaattccatctgtgtttcttcctgccttcttcagaagcaccttagcatctctacattcttatctgtgagatggaaataataatgcctagctcatgggatgatcagatgagataatacatggagagattagcaccatgcctggaaatgttaggtttattattacacagggagttaacagggagtgtgagaagtgcaaaagtaggtttcttgtacacagtgctgagggctctggatctgcaacctagaaaaaaatatatgagaccaaggggcccatacggctaccttctgagtactctaaattgaaggtgcctgccgttgggaccaagcaccagtacttgaagcaagaaaacatcattccaaggctacgcttctattcctgtcatcatttgcttggtgtggtagaagagtcgtggttaaggctttgaagtaaaccagatggggattaaaaatcagtcctaccacttactccttgtgtgactttgggcaagttatgtacctggtctgagctgtaaatttttcgtctttaaaatagagataatattgtcttcttttcatggttattatgaggatcaaatggaaaatttatgtaaagtgcttagcacaatacctggaacataataagcattcaataaatgggccgctatgattattaatattaatcacagtagtaaagagccagctattttcttagttatcttactgttgtaaaatgaggaagctagactagatagtctttggtttttttttttttaacgccaaaattttatggccactggccgtaaccaatgtggagaggtggagaggaaatgtaaccctccgtaagggttaaatgcttgcagagtccagcctagttcccataacccagagggggccttgtcaggaggaaactgctgattcctgcctgcttctgagccagaggaaagaggaagatgacactcttctctgctccagagcagagggacaagcctgggctagttacaaaaggatagcaaaggcactgggagagaggtgacagtgagtggggccaggaccttagagtggagagccccttgcctccaccccttcagcaccacacccttctggtgcaagggctgcaagaggaatggccccttaaagaccctgatactccaaagaactaagacccagggacccagaaatattttggtggccttagaggggaataaggataaatgaaagaagctgtggtcccagagcttgattttaacatgactctggaataacatggaaatctcagatcaaaaatttgagctctgatcccagaaaagagaggaagaagggggctatcactcattgaatagcagctagtcctaaaggctaagcttggcaatttaagtgttatctcacttgctcctcacaatgaccccataaagcaagagttatcttccccattttacagattaaaaaacaaaggctcacaaagactaagtaagttgctcagatctccacagctataagtgataaagcggggatttgaatttagttcggctgtattacttcttagtccagtctctctctattgagcccttctgtttccaaggaaagccatacaccaagctctcaccatttgagcaaaagtaaaggtgcatcaggtgtttgggaatatctaacaatatattgaaaaacaacttgaggaggaaagaaattccagccaatcctaagggcttaggctgagaataaatcttttttttttttaatagttctggagatactagaatcaataagacagtagcaaaatctaggattaccaggtttttgcttctgtcatcatttctcaaaagctgacttgggctacgcctgtgcccagactctgtggccttaccagccctgcagaaagtgggaaagaaatggaagccatgaaattaaggacttttagagctcaaaggaagcttgacaattacctgttccaatacttttactttacagatgagaaaactgaggctgagacatggtacatgacatatcaaggtcacacagctggtttcagtagagaaaggcctaaaatctggatcactttcatcttagccagggcagtagctgcgtgtagtgtagggatgagatgaggaagagaagcacacaatgtaaaaagtgtagctgataactctgacctgcctttctagggagctagaattcccgtggttggctccagtggtgtgctggtaaatattaaataactggctctatgcaggcaggggagggagaggagtgctctggtttgtagcctctgccaattgccatggtataaatacacctatcctggctgatttcaagcatcatgggatgtcactgaatgcacagttattccctaacagctggcttcagcacaccacagcttcactcccttcctgagaaactcattccttctgctctgtggggctcaatattatcccgggttcaaaagtcatcttaacctaaaaatttgttttatttcctgaagaatatacacacacaagtgcagcaccatcattcctaccagtaacaggagcagcagctctctacaaaacactgtggaaccacaaaaaatgagtctctgctccttttgggactgagaagagaaaggaacggaagtccctggtttaaaaaaaaaaatcatatgccataacttataaaccaattattccaaagaaatgaggctgtcaacgagtgatggtgtgtcagcctgctcttccctggtgagggtgagaggaggctgaagggagcatgggggcaggctgttctgctgctttctatgatttctacgatagccatttccttcctcctctgggatgccttcacagacccagaaggaacagctgccacaggatgcggggctctttctggcccagagcctgcagcctttgccacaggattccacattgtgccattaactgggccatgtcagagcactcattctgacccagccccgtgctgagcactgtgtacagaatgcaaacccctcagcagcccctgcctcaggaagcattatggtctttgtctttcattcttttttagatgagagacctaagatctttcttgagaccttagaaatcatcaatttaacattccctttaagagccctacaagaggaccctgcttgtccaagttttcacaaccagttagtagcagaacaggggataggatcaagatcttcctactttctttccagcaatttttttttttttttttttgagacggagtctcgttctgccgcccaggctggagtgcagtggcgcaatctcggctcactgcaacctccgcctcctgggttcaggcgattctcccacctcagcctcccaagtagctgggactacaggcacacaccaccacgcctggctaattttttgtatttttagtagagacagggtttcactatgttggccagaatggtctcgatctcctgacttcgtgaactgcccgccttggcctcccaaagtgctgggattacaggcgtgagccaccgtgcccggccacaatttttttttcacttgctcaaggtgatcttctttcaaacatgctccagtcgctgctgacagatacattatggagccacaccaccactctccttaaaggctggaaatatgaaggacaccacctccagaattctctcttaattatatttacccaaacattgttgaagatctataatgcacaatagtggaaagagttggacaacttaacacaaatcttttgcatgcattatttcatttgttccttcacaattctatcagaaaggtgggcaggtattattccaaaggaagaaactgaggcataggtagattaacttttccaaagtataaggtactgttcgatatcattatgacacttctgatctctttccagtatggaaagatagtagggagctagaattcccatggttggctccagtgacgtgctggtaaatattaaacaactggatagttgaatggcctaaaatttcttgcacccaaagggagaccctacagcccaagaaacaaacaagaaaccctttctgggctggtagaaatcctgtaatgttgcctttagactgattatccactgaaggaactcttgtctgaaatagaaagatcccacagaatgccatggtcctgaggaacattaaaataaatagaaaatgagttcaggcacttagctttacaaattgatcctggttctcctggcagaaaggtagatacaggtgacgccagctgagtggaaggttgctgcctgttctttcatctggcttcataagaaccaacatggaatttgtgggtgagctggtgagaagtttttgtctgcagcttgtattagggcccctgaactcccatgtctgcctctctgaggcctggtgtcctaaggctggaagttgtggatatgggtcgtgtagagacttcaccatgcctccactgttactcaccccaattccttccgcttccctccagcctgtccccatcgatgataacttctgtggactggacatcaaccagcccctgggaggctcaactccagtggagggcctgaccctgtacaccaccagcagggaccgcatgacctctgtggcctcctacgtttacaacggctacagcgtggtttttgtggggactaagagtggcaagctgaaaaaggtaagagtctatgagttcagatgctccaatgccattcacctcctcagcaaagagtccctcttggaaggtagctattggtggagatttaactataggcaactttattttcttggggaacaaaggtgaaatggggaggtaagaaggggttaattttgtgacttagcttctagctacttcctccagccatcagtcattgggtatgtaaggaatgcaagcgtatttcaatatttcccaaactttaagaaaaaactttaagaaggtacatctgcaaaagcaaaaaaaaaaaaaaaaaaaaattgctcttcattcccaaatcaagcaaaactaagtttttgattatgtgcattataaatctccaaaatcgcaaatccctccctagaacctgtaaacttgattatactggtctttgttgaattcagagaagttggttgaagcagattactggtcccaattctaagacctggggtaaacggtgggtgctgctctctgatggtatatgatgcctgaagaaaacaccattctccagtctttcctcttcctgcaatcacagactcttcccttcccagctccccacccagatgtaagctgccaggtggaagtagacattttaccttgcgcctcccagggtacttctgccagctggagggcacaggctgtctggggatggcagcatgggaggcctcttgtgcagcaggctgaagccaacagcttgtaccagcttgtctagtgcctagggtgcagagagggcgcacaatctggttcattatgtgggattagagcagccacattctttccggtctcagctaatcccttttcccaagcttaccctcctgccacctttccctggtcccagcacctgtggatcaaggaacatgcaagacctcactgcatctcaccctttgatgttgacatcaccctggagctctttcctcctaatccatttagagccttgggagggatgttgtttggaaatgtggaaggagggtaacctggagtgagcccaaggaagaatttctatgttctgcttgttctgaattactgccaggggaggtgagaagaactggtctgggttcacctagcagtgctaaaccctccaggcttcttctggttctcatgataccaaagatatttaaccatttcctcacttgctgtagaggttcctacatgttcctcttctgtgccctccactctgcctgggactagggaccctagcttggcttttcggcacatggaagagagaaagaatgtggtccttgcatttgcttttccaaaatgggaagggaaggagttgctgtgtgaaattctgctaagatttaaaagtggcttctaccaagaagcaattcagcttggaaccctgaggccggctacttccctgctcagccagggtcaccatatccagttgagcaaattgtgcctggcctaggaggattgtgttaacgggcctagtgggagttgaaatccagcctgagctctccctgtcacatcatgtaccctgtggtataaacatctgctcatgggacttctcttactaagtcatctacccatagggaccaccttttcctaaatggcacacaggctctctaagggccagcagaaaccacacaggctagcgtgagcacctttcccctaccttcagtcactgctccaggtcatgtgtgtcattctgtctccttgattctcttgaaagttctgtgaaaggcaggggtcatgctttttggactgttcccttcttcccctttaatcctgtcaccgagtgttcactcatgggataggcttcaaaactgctttgaaaaatagaaccattctttaaggaaccttagagattgcctggcccaatactctcattatttgacagggaaactgaggtccagagaagaaaattgacttgcccaagcatagagatctaggacaagttgcttcttgccttgacacccaatttggcaccatttttacttaaagaagtagctctagagcccagggagggagactgagaatgatcttcaggtccaggcttgctacagaggtcagctaggggccagtgctttcactctcttcagatctagatgtgaattaaggaatcagtgtttgctgaatggatggatggatgagaagtgaataaaggaaaagggacccaaccagatacaaagggaccttgagttgactttccccatatctccatgcatcgtgcacagcacacactaggggctgcttggcatctatccaagtcacacacctgagttggccaagttctcctggccttattgaaaccctgacggacaagttactgtggagaccagtcagcaggttcaagggcaaagctgggggcgtggttacccacagcttgttctgacctgtgatttggctgcttcttctcactctttgcttggcctttctttggcggtttctatgagctcatgacacccctccttcctcctctgtgcagctcacccttccttcccacccacgctgctttgaggtacttgacattcatacccaggcccctgctggcctcccatctaccagcttacttgctcccacccctctccagagaaataacccatgaagaatttatggaatgtccccaggaaaccctactatggtccaggccccatagctctttcaacacaggaaggaaaataaagaaaaaaaatagctaagagtttggaaagggaagggaagccgggtgcgtcagaactactcacttctcccggcgtctgtcaggctgtccagccctcatctactgtggtctgtaggaacaggatgtccctgtgtatgtaagtttagaggaagcagagacttgctagaagtgataggaccacagggcgctcttatgtgctgtgtccacatagctgcttatacactgctttctgcaagatgcatagagagcaccctagacaagaccactgccttctgagctgcaaacatgtggaaggaacagacagaataaggttaagtccccaaaacctgtatgtgaggccgggcacggtggctcatgcctataatcccagcactttgggaggccgaggcaggtggatcacctgaggtcaggagttcaagaccagcccggccaacatggtgaaaccccgtctctactaaaaatacaaaaattagctaggcgtggtggcacatgcctgtagtcccagccacttgggaggctgaggtgggagaatcgcttgaacccaggaggtggaggttgcagtgagccaagatcatgctactgcactccagcctgagcaacagagtgagactccatctcaaaagcaaaacaaaacaaagcaaaacaaaaacaagagtttgagaccagcctgaccaacatggtgaaaccctgtcggtactaaaaatacaaaaatcagcagggcatggtggcatgcacctgtaatcccagctactcaggaggctgaggcaggagaattgcttgaacctgggaggtggaggttgcagtgagcccagatcgcgccactagcctgggcgacagggcaagagtctgtctcaaaaaaaaaaaaaaaaaaaaaacctatatgtgcaatgctgcataagctaagggtcagtgcattgcaggtgataagaagacatgcaaagattcaccataagggtggaagaattcaaacaaaacagcaactatagtgtgatcaatctgcaaagctttactgaaaaggaagattaccagggtctgcttatagactagatgagacagaagaactgatgaactgatgagttgggggagagaagggcattctagaccttgggtgccacactgagaaggtacaaagcatatgcaatgaaggtccaacattcagagaagctcagaagacttggacaggtaagaggggagggagagccctgtgaggctttaagccctaaggagatcaagtgaaaaggatcttgggattttagcgaaccgtgaggttgacatgagccaactctgtgatatattgcttcaacaaagttagtcttcatcatgataatagaagaacagcttctatgtcacgagacacagtgactccactttaccttggagataacatcgcaagagggtgttaagcaaactcaagtgccagataaacaagagctggatcgatgtgggaatcatgctatgtgaagggaaaaagtgaataaagcaggacatagaacagctgtctttacataacataatttactgagcacttattatgtgtcacatgctattgaagagctttatatctgttaactcatttactctttatataactctatgaggtaggtgctattatcacctccattttaaagatgaggaaatggaggtcaagaaaggttaaaaaataataataaagtcacacagcaaataaaatggcagagctaggacttgaaatgtgattacctggttttacaatctgctggcttatccattaagctatggaagatgaattaggcttattcagtgtggccccagagggcagaacagggccactgggtaggcgttacagcaatgcagctttccccttcatataaggaagacgttttttacagccagactgtcccgtgatggtgagagctgacccaggaaggaatgaggtcctagtcagtggaaatatgcaagcagagactggatggtcaccaaccagggtgctgtcaaggggattcctgcatcaaatctcagatcttctcaatgatactgccactgtttctctggctctgtcagcaaagcgtgcgatgaaggaggacaggctgaggcagagaagaggagcagaaaagggaagaccaaggtcccctgggtgtgggctttggaatgaggctggttttgagcctgcccttagtgtagcagaaagcccctcagggtcaggtaggaggggcttggcacagacagggcaaggcatggcctggatgatgaggacaggcaggcctagggccagatgtaggggagggaaaagcaggttatcctggggtctgggtccagttcctcatgacagcatccctcctggttaagaataggcagtgggagtccagatgatagagattaagtgcaaacaccaaagcagatggagatggaggaagagtggcaacaggaactggaaactcattttacatgattttccaggtttcagggcggagacaggaggcaaatcaagctcatgccatggggcaaaagagggaagaagtcaagctgagcaagtgaaagatgccaggacaatggaaggaaggactatcttgggttagggtgaagttcctttggtttcttccttccatttgcagctgctaaactgccgcctcaacccaggtttcacatccctgcagggctcctcacagaagctggggggtagtgttttgccgaggctctctagcctcttagtcccagggaccttaaacagcagcagatgctgctggctctcttttccatccccaccagaaacctcttctgctgctcaagcattgtgacatgtcctttattctgtcccttcaaccactatgcatggcaccctcctagaccccacagcatctggcaagggagcagctgttaaggtgtctacctcccttgagattcacagatctttgagggcaggggccttccttttcacattcatcacgccatccccactgccagatacacattaggtgctcatgaaagtgatctcaaatgtattgggtgcctattctatgccagacatctatttgtacgaattgaaatagaatcagacaccaacggtgactcctgttgatgtggttggttgcgaaggaaggaaggtatgatgtgttgggtaggtcagtgaggggaggaggagggttggcgtggcagtggcatgaggagtcaaggaaacaggacaacttctggtgggtaacaggaaaggagtttgttttctggttaacaacatctggaagagggtggggtggtaatctcagaaatgttggctggaggaaggggacagcatttacactgttgcctggagggccccagaatagtacagacagccatctgcttcacctggatcagatgcaggcttgtgtataacaggggaagcaggaaagaatgcccagggaaccactgcttcccccaccagtctctgtatgactcttgggatgtttttgcaaatcctcagagactttccaagctctggggagggccccggcctattctggcactaccttctttcccattagctaatggtggctgctgaaatgcctgtgaaattcttaaaggaaaattctttctgcctttccctaagggacataccaacccaaggtctccagtccccagcccacaggaagccctgacgtcccaattctattcttctctttgtaatcgcacaaacgatttactaagcaaagccaggaaaactgtgagcttcttgcagtagcagcttaggcattggaaagaatccatcaggagcaccaaagtattaactctcctcagccctggggttattactcagttatttgataacactgactgtttacaagatacgtttccgtggttcttttcatcttcctcaaatacttcaactgagggtgctgatcgcccctgcatctttaccccattttacagatgtaggaaactgagctgtagctatactaaatgtcttgcccaaggttatatgctcacccccaccctccaatgccaatattgacattggcatttagactttctccccaaacacactaacctgttacttggctcctctcgtggggtggagttgccttggcggatggaaggccaagttggatgaaaagctgagaaacatgcctttctctctgtgccagccccaccaaacaatagccactcattcctctgagtggaaatgattcacttgtctctcagtatgaacccttgattgagtaaacagccggagctgcaggtccacatctaagagacttagtggctctcctgggacctgagaccgcccatctgataccctaactcgcccaggcgtctcagcaatgctggacactggggtggtggggagtagagaccctctccccttccccagagcctgcatggaaggggtggggtggtggttcagggagctcaccaccacatccctagtaatgagtttggctccctgcccgggctcccgccgccaagctcgctgtttgttttgttgttctataggcctcttgggtccccagaactggtcttctgaaagctgggaaaggctgcatttggttggcacaagaaaggggcatatttacagaatgtcccactcccacccgtcttgacacacacactctggccagcacatctccttgcttgaccatggcaggtgtagacaggagatgtcggctctgtccagatccccagcagaccccagggaaggaggtcctgatctcccagagtcattctgaaaggggagaaactaaagactcatttattttttgtactttttgtgtagtttctaatatacttcaatcttggacaattcttgtatgaggcctcaggctgtgtattcagctggctgttttgcagtcttaaggttgagctcctgcagctcggggctttattgccaagcaggtgaaacacagagaactgtgttttatggatgggtgggatgggcgtaatgattcaagctcacagaatacaggtgacctaaataggctatgcaaaattttcaagaggccaaggtgctggtgtttacagaggtcttatctttaggaaaatacagacccttttacaccattaagccttgcctgtctgtggattttgtacatggacctggatctctgagtcggaagggacttacaaagaccacctggtccactctcctgccttcgggtagggaccaatttgcataacaaagagtataggggctttggagagatccagtcctgactccatcctactagctgtgtgacctctgagctttaatttcctcaatgtaaaatgaggacagttctggtaccggcatcataagattacagtaaggattaaatgacataattcattattgaactgatatttattgaatatgtactgtgtgccaggagcttggtataaagcagtagaaaataaaactgtcaaaaatggctgccctggccaggtatggtggctcacacctgtaatcccagcactttaggaggccgaggcgggctgatcacctgaggtcaggagttcgagaccagcctggccaacatgatgaaaccccatctctactaaaaatacaaaaattagccgggcatggcggcattgtgcctgtaatcccagctactcaggaggccaaggtgggggaattgcttgaacctaggaggcagaggttgcagtgagctgagattgcaccactgcattccaagctgggggacacagagagactccatctcaaaaagaaaaaaaaaaaaaaaaattcttgccctgatggaaattatctgaatgtgggaagtcagacaaacaaagtaagtaatcacaatatatattatgtttagtgggtgataagtgctaaggaaaaaatagatcataaagaaataattcatggaagggatggagtgcagagcttgggcacatgggcatatgtgcatttaaatattactacaattgtgacttaacttgtgaacttcgattttttttttcctgtggagtggggtagtaataagcactttgcatatttgttgtaaggattaaataaaatcatgtgtaaaaagtgcttaatatggtgcttggcatgcaagtgctttctattattactgatatctttgaggcttccccaaaaccccacttcttccctggctccctggggtagtgatgctgtcagatcaggctccttttcagtgacatgtttgcaaggtcagacggaggaagagaatcctgtcccctactcccagccctgagtcatgggaaaaaaatacttagaagacgggaccagctgagccgaactaatctaatcctgctggactttggcatccagttgcattagtcaccagtgagaggtttcccagtctcatatcaccaaacaatatgtactgaccccctccccagggtggggctgaaggaagtgtcagttgccctgttgtagcttcgcagaattaactaaaacaggcccattctccccctttgcatgtctccacaccaaccacagtatcctgtgctgcacaactctgccttcgatgaattatgtgatctgaggggacctcagtttattcatctggaccacccatgcctgcctggcaagattgctatgcgtatcagacatggaggatatataatgtctaacacagatcttgacataggagatgcttaataaatggcagtcattgctgcctaccacctctgttgctgctagagtgactcctcctactagtattactactaccactcctgtactattaccatgtttttctgccacagtcccaaattctctttgattctattagttcattagtcccatataattttcagatgatcaagaaggattggaggccaggcgcggttgttcacgcctgtaatcccagcactttgggaggccgaggcaggcagattgcctgaggtcaagagttcaagaccagcctggccaacatggcgaaactccgtctctactaaaaatacaaaaaaaaaaaattagctgggcctggtggcggatgcctgcaatcccagctactaaggaggctgaggcaggaggcaggagaatcgcttgaagccgggaggcggaggttgcagggagccaagattgtaccactgcacaccagcctaggcgacagagcaagactctgtctccaaaaaaagaaaaaaaaaaaaaaaaaaaaaaagaaggattgggatatttcactgctctgttgcagatggtgattctgaaattcagagattatggacttacttggggtcaagttgtaaatcaagggaagatgtggaaattggaaccagaacgacaaatacttcagggtggagatgggcccagcatatacctaagtcacttgtgtagcccaagatgatcaagctaagagcttatggctactttaatgtctctttccttcttgctagcatgtgcctctctgtccagggaggcaggaaatacatggagatgaatgtggtgaaaatgaatctggagctctggccttctgagtctcttcctgtggttctattcttctcctggcctcagcctccagaaaggtttctaggctccaaggtgggaaagaagttcaggagctggtgccgttgggttgtcccaatcagccatccccatcctaccctgtgttatggtttctatggcaaaggctgagtgtcccccagctaatctggaaggagaaatggcatcaacaggctttaataacaaatctggaattcccacgcttgacaattgaggggaagaggctggggaattggggttaaggcccccaggggataagattgacgctatcaagcaagatcaagagtgttcccttaaatgtgtatcatagatttagtagctggaggggacctcagaaaactgatctggtctactgactttggacaagtaagatgcgtattgttctattttatgaatgagttagctgaggcctagaaaggtggagtgatctgctgaaactcacccaggttcttacccacggaggcaagactggaacccaggtttttgaattccaattttggggcccttccctatatcattttaaaggacttttttttttctttttttttttgagacagagtctcactttgtcaccaggctggagtgcagtggcgtgatctcagctcactgcaacctccaactccctagttcaagcgattctcctgcctcagcttcccaagtagctgggattacaggctcatgccaccacgcccagttaatttttgtatttttagtagagacggggtttcaacatgttggccaggatggtctcgatctcctgaccttgtgatccacccaccttggccccccaaagtgctgggattacaggcgtgagccactgcgcccggcctaaagaacattctttctgcacaaaacatcagactgacctcggcctctctagcatgcaggcatttcctatgccgaacttaaaattgatctagggatttttttccctggagcaagaatccagctgagcttcttgtaccaggcctgaccatacaaccttgatctagggtgaccaggatccctgagccctcagtccacacatctcagggatcttaccagaacctgcccagcagggaggcctacttcacttctggcctcagggctaagaagttctgacaaatcagaagaacactgaattgggaccctcaagtcttacacgttagtcttctctctaggaatgccacatttttgaatggggataggcctaaaagatccactataaattcagcacttactatatgctaagccctgggctaagtgttttgttttgtttcagttaagcctcatcaacccttgcaaattgtaaaaatcattagtcttgtttccattttacatataacaagctgaggctcaacaaaactaagtaacttggcagagtctcaatgctactaattggagagctgggatttgaatccagagctctctgactccagacctgtgcttttaaccactagctttttagcattcaattgaacttctctacgcttccatatgtccacgtgtagactaccacttgcctgatggagagctgcaagaagatgcacgagagaagaggggaagggctacctctttgcacccttttgagtgaaggtgccctggaaactcgggacatggcagctgtcacctcggcacacgctgtcttccttgtgtccctctcctcaggcctcctcctccaccttcccatccctctcggcctgggtcacaatgcgcggggtggcagccttttgtgccacacacagtccccagctgactcccctttctccaggcatcattgtttgctgtgagctttctgaaggagagacaaaggagtgttgctgacaaggccaaaagctgctgggtaaagcgtggggccagggcccatcacccatgcatccctcggagcccccgggctcttcttcaaagacattgtctgggatcttttgtgtgccagtcatacccattcagagctggccaggcaaaggtttcagtggggaggaggagcacactgagaaatggagtcattttgatctggcaaaattggaagagacattaaggcaatagttaacagccgaccactgctggggggatgggcccaaatgcttgttctctgtttatggggcttatgcaattccatcaatattgatgcctgatgcctttgattctgacactaatcattgctatgaattaaatttgcagccatataattaggattgctattaatagggccctgagctaagcactccgatgtggcgtgtctttttcttgatagaaaatggcatccttggaactctgctaatggggcgcacctgggatttgccaagaatgatgtgaaaattatacattctatatttgtattgggccttttactgaaataccagcaagcaaaggtgaggctggaggaagggttctctcctacccagtgctgtgggcagcaattaggtgtctctgctgctctttaaagtctttaggaaaggatatgccagagccaatgttggtcgctcatggtcaagcttcagacagctcgtagccaggaagttctgctttatgtctaacctaatgggagtcagtttaggctaagacactagccaactaagggaagaggaattttcctcataccctaagcttatttgaaagaggctgagccaaactcctactgatgggcccagttgggcctcatttctaggtggatgattgggcaagacccctactgacaactgattccaagggtccccatccagagagctccctgggccacagacaacccgttaatttcacacacaagggttagctctctttcatgttgagattcttttccaggtaaatttgcagcatatttagtcacggggaaacccggtctcttccggcaattagcccccagttcagcttcggtgactgtcagtgccccattcaccctcagcctgagtaatcacgtgtcgtcatgcacaagggttatctaacccttttccaacaatggcacatgtggtgacctccctttatcacttagaataataatttataccagttggcacaagggatgcactagtccctgctcttttgatcttcagactgaaaataatttttcttctaaaccatcactgattgatttttttctttcattgttttatatcattgagataagacaatggtttgagttcaagtcctaactctactatttactaagtacgtgaccttggccaagttatttaacttctcagcaattcagagttgagagttcttgtctttaaaaaggtcataataataccttcttcagaaggattataataaggttcaataagcatctaaatctcttagcacaggtctagtacacctaataagattccctgccttcccctttttctttcacctcacatatacccagatacagaggacaaaagagatagctttcttttccaacatctacccccgcccttgccacccattcttctgaataccacattattttccacccattctcagggacaacacacataaaattaatttctccaaagcaaatggtgcaatggaatctgaattccaaatgccttcagtctttttctccccacccgctacaagggtgaacaggagcttcttgcccccactgccatggtttctactgtttctctttcttctcagttaacccagggtcttaggtggactgagtccattctccaattcaattctcaggaccctaccacaaactcacaggtgttcagcacctccatgaaagggagaaaggagcaagagcatctcagcaccacccaaaaccaaggctacttgaacacaggatttgcattcacttctgttgtctgccccacaaatacactgtacatttacccactctgtgtaagtgcatgcttaaaggcaagtgtgtggctagaaagtaattggctaatggtcaatattagcagagaacatggttttttttttgttttttgttttttaacataaaaccctaggaaacagtgtgtttggttgagtcctcaagtacgtgaactttttattaattaccaaacaggtattttacttttcattcctgaagctgggcagggatgggattcctgttgggtgattgttggtgttggtgctgttttggctcctactaaatagaaaacattaatcagtttcttcagtattggaaatgtgcctgatgttgggcaagttcatggttactcgtaggtgcattctgtcataagcccaacataactatactcgcccccttcagttatcttgtcactagcaaggtcttgtatggcacaaccaaaccccaaaactagactcccccatgaggccatataatgtaccccccacctcccttgtaccttcagtctttcccgtagtctaatggctgcccctcttgaagctgtaaaatgttgggtaatgtaagtctcagacggattggtggtatccccagaggaatggtcatagacagagaaatgaaggaaaaaatatgcccaacctccccccaccatcaaatcaaagaaataaaaaatctgtctccttgatgcctccccagtatttatgtctgagctcagcagacacccctgggctgcagccagtctgtgtattagcattagtccattacgctttttatgatgcatgttgcccacccctaacccccccccccaaaaaacattttatgactatccttttcatttctggaaaaagcttcacagaatggcagatgcctgaatctccccactctttggggagctatttgtaggcagcctgtcccaggccataaacaatgggagataaaccacagccactggcagtaaatgcagccaaggccatggaggtgcaaaaagtagggggtgggataagcttggtggagtcttgtacaagcacagtgcctggtgggtctgtgggtctaccctactcacaggagagtcaagagattggggccaaagtggttgccaccctcccggatctccacaaaagctagagggaaatcttaccactctccctcatgcctgtcttccctagtgaagccatgcatcccttaactgtgatcagaacctgtcaactttccaatcagaaggagaaggtgagctttggcatcattttctcctgctagctcatgctgctacctagattactacatgccactcatctcccacggatgcttctagatcttggagcaacttcttggaagtttctctgccttctcccactcactcttcttgtgacacccacccctacctcttcctgctccactctctaatgctcttctgctcccttattgtcaagctcgagtcttaccaatccatcaccactacttctggcttattaaaacttcagcgtggactctggtggccatggtggtgatatgtatttataccaccttttgagctgtacccacaagcaagtcacataggacactgcaggaaacagcaccttgagccagctttgctccagaaaaggtgcccttgggaaaagaaaaccaaattctgaatgaatactagaacagtggagatttctgattcttcctacacacacgaaacagcattcaaaagcaaagaaggagatggaggggctgggaggtggagaaggacagcagcaaagccctgaataattagtgcatggcggggttttgtttctcatctgccccatcttggtggcaggatgtatagataggatggaggtaatggtgttctttttcttttccttatttggttttggactccacatcaaatggagacatgtagatgaaagtggcgtgcatttaaaatgtatgtacacatcagactgctggagatggtagatattatactgcatgtatgttttttttttctttcttttttttttttttttttttgcagtaagctgctaaattatttattgggcactgggctttaatctcataaacctgccttcaggcctcaggcaccagcagcctaagcactgcataaaacacatacatcgggtgggctgcatggagcactccggtgactctaggtagtgattgttcattttcattcggccctttcccccagatcagctcattaacagcaggcagaacctatgaagagccttctagttttcccatcactgtgaacttggaaattgatttgcatctagtagcagacaggggctcccaacctgagcacaacataccaggggaactgtggcaagaggctgttctcacagtctctttccttggctgagggataggcctaaaaagatggagtaaacgactccaggattacaaaccattgctggattatccagagctatgcgccctaagctatgaacccccttaagttcccacccccaggactcataggtgaatgatcctggacaagtgttttttatttaaaaataaaaaaaatttttttaataaaatttttcgttatttattttacatttaaaaagtttttttagagacaggtcccactctgtcaccccagctgcagtacagttgtgcaatcatacatagctcactacagcctcaatctcttgtgcttaagcagtcctcctgccttggcctcctaaagtgctgggattacaggtgtgagcgactgtgaccagcccagacaaattttttatattttgggcatgaatttgccttttctaagtgaaagagatctttattatcctccctggttccaaggcctgagagcaactctcttggtatgaatctccttgtcagtctcttaaatgctaagataataataacattcttaaacttattcattggtttcagttatataaagagctttcataaatatacatatattgcccatttttatctcattttgtaatcctaacagccccatgggctgcgatattatgggtgaagaaactggccagagtggtcaagtgatttgtcattatcactcagtaatgacactgagattagaacatggatgtccatcctttgtccacactaatcattgcctagatgtgtgagctaagtagcattacacgagtatggaaactgaggcacaaatcatctctggcaccaaggggccctagggctatgagggagtaatgttaacaccaatgcccttgtcatggaaatgtgagcccaaaaagggttgtgctttccaaaccctgggcctctgctgtctttgagcaaatgaagcaatgccaggactgtctgggtttcatcattcactgtgctgcagcagccaaaaccttatgaccctcccttacaaaatcagtaagaagaggatattgcggtagttggatgcacagagttttcatctatgttccaggattcagggggtctgtgatctaccagaaaaatgttttacaaacatttgtagatttagttttttgtgtagcgggcccattgcttacattagattctcaaagttgtctatgaccctaaaatattaagaccctttgtctaatggtttttttttttttctttttctttttcttttgagacggagctttgctcttgttgcccaggctggaatgcaatggtgcaatctcggctcactgcaccctccacctcctgggttcaagcgattctcctgcttcagcctcctaagtagctgggactacaggcatgcatcaccatgcctggctaatttttgtattcttaatagagacagggtttctccatgttggccaggctggtctcgaactcctgaccttaagtgatctgcccaccttggcctcccaaagtgctgggattacaggcatgagccactgcacctggcctgtctaatggtttttaaaaagtgtgcctttgagttctaggccactcccaactcccaactccacccttcttcaatcaaagtatcttactttcatctatttcatctatctatttcttctagtagggttaggagtatggtttttttgttgtttaaaaaaaaaggttcaaatggcagatgatgacattttaggtctgtttgatcatcacatgttatgtaccctgggtaataggcatacctgcaccacagtcaccacctgccatatgtgtgcacgtgcacacacacacacacacacacacaccatccccaaacccggtgtccatggcagcaggacaagacaaccctggaagaattcagatcagggcccagaggtgggccagaggagccagtgggcccagaccaggagaatggatcagagcagatggaaagagtggactcgaaggttacacctgggagacaaagtcagggtcatggtctttgttgtgacaccaaatcaggcagcacgggctgagagaggaggctgaagaggtagctccaaatcaatattgagagaaccaaatcaggccagaaggtaggagtcccatcagctgggtgggtcttactcccaccatgaggcaaggggagggagtccactcagggagggtaagaatcgcctcgtggatccctgaccctgacacgtcttcatgcttgttctcacctcggggctttgtgtgcagtgttctcagactaggaacccctcgccctgccccgtgcccagctaacacctcctcatcttccacatgctgatacaccacctcctctaggaagcccccatgtgcttcatagcaccccaattatgtggctgtcagagcaggagagcactgcgtttaagaagagtccaggccttggggccaaagtatctgtgttcaactcttgattctctcccttaatatctgtgcgacatagtgacaataacctcacctctctgtgcctgtttcttcatttgcaaactggaaataataataatttctgcctcccaggctcattgtgagggacatgtaaatgagttaatacatgtaaagcatatagatcagtgtccaaaatagagtgtgtactcaggaaacagtaatattattgttgtatgtactattataattgtcctttttcttttctctctccctcccctcagtacgcgccacgattttaggataagggctgcattcattatctctctatctatagtaacagctaatataaaagacattcaataaatgttttaaaagaagaaaaggagatgagaaaagtggggagggggaagaaatcctaggacaggagccatctctctgccccaattttgaggcaccttcttgatgtgagtcaaaggcgcttgcagatgtgtgctgtgtttccgcgtgaggcaggacctccgggattcttaccaatgtttgttgctggccatgggcaaagaacaaggttcttggggagtgcacatgattcaggcagtcacatctcatacacagaaattcaagccagcagtgctgcagccgaatccttttgggaccgcccttttccagagggaaaaatcctttagcctcacttagctcatagcctccctcacctgtcagtgccccacctgcaaatcccagcagatggcaggtctgcactgaaagacaactacagaggattccatcaaccttctggggtccaggactgagtagactgtactcctgccaccaaaggttcgaagatgcagagcaacgcccattattagagtgttcattcatacaattatttactcactcattcaaaaacaatgacaattacatatgggcctgctatgtgctgtcaaacatattacttgttgctaatatctgtattaattacatcaagctagtggtttccaactggaggtgattttgcagacatttggcagtatctggcgatgtcttttcattgctatgtcttgggcaaagagagctattggcgtctagtgggtagaggccagggatactgctaaacatcctacaatggatgggacttcctccccacaatgaagaattatctggtccatgatgtcgatagtactgaggttgacaaaccctgatcaaggcaaccaacatttctggagcgtcaaccatgtgtcaaccactgtgctaagcactcttcatttgatctttctaacagccctgcaacataggtactatattttttgagataagaaaactaagactcagggagattaaattattttcccatttattcacataatatgcagttattaaacaactcagtgggtagtggatttgaaaagcaaacccaggtcttctagccccaaagtctactcatctacaaaagcatgctagctctctgcacaaggtcagaaaggagaaaacatgacgtaagtaagtgatggagaagcatgagttttgggaggaaaatgttgttcataactgccactgggaatgaaaaaaaaatcccttttctgcctccttctctcccagtctaccatctatactcatatacacacacatacacaatcgaacaaaatccttgaggccccagtttgccttcagggtgacttcggtgtgggtggtaattttagcttgagattccaccctccttcccccaccccaaaatgtttctcatcttacacatacaaccacacttttggctgggaagagggtggagatatttctcctgctcctgaaatgtcttcataaagatcttctctctgccaacctccagcttctcctcgtgctgatttagtgcctgctgtaggaggtgtgggattttatttgtagctcctgactggcgggctgttggacaggagctgtgtgtgtagtgggaagagtagggactttggcatcagactatcttggttcaaatcctatcatctaagaggattatattgggtaaatcagttagccttattgagctttggtttcttcatttgcaaaatgagaatgatgatacctaccttgcagcgttgctccaaaagttaagtgaggtcagttgtgttcatcttttagtgcagtacttggcaaagagggaatactcaggaaatgctagccagtatgctcatccttctgcctcagccccaggttcgcttttttttttttctctttatctcttctcaggagctcaaagagaaggggaggaggagtcagggttcccttctggtgggcctgctggaccatgcttccctccctattctgggcctcctgtggggccctgtgtatagctcagcccaggcccttgagtcaaccacaagatcactatctttgctctgcctctgtttagagtcaggtaacacagaccacagctgccaccacctccccaggcatgatcatgtgagtgacagtcatcaccataagactctcccacttcatccctaacttagcagagattcacaacgtggctggaagtgttaagcagtggtgctggttcaccctgttaaaaatgtagcctgaaatcattcaggatcttaaggcttggagggatccccaagatgccttgtccttgtgattgtcctcatgactgtctttttgcccttttctttgcgcttctcgtagagaatgttttggaatggttagagacagaagggaaactcattcatagagaacctgccatgcaccaggtcctttccatcctaaggtggcttatcccttttcctgggtgcactacatccagcccatctggggctggagtacataagcattgctctacagaagaagaggagcttccacaaccctctgccatcttatctttggtgacttctgaaactgcagggtccagaagatccaactttacacattgcagtatgcagtatactctcacatttctcctctcatttagttctcatagcagcttgagaggttgggattcatagctccattttttttctttttttttttttttttgagacagagtttcattcttgatgcccaggctggagtgcagtggtgccatctcagctcactgcaacctccgcctcccaggttcaagcaattctcctgcctcagcctcccgagtagctgggattacaggcaaccaccaccatgcccagctgatttttgtatttttagtagagatgggatttcgacatgttggccaggctggtcttgaaatcctgacctcaggtgatcctcctgccttggcctcccaaagtgctgggattacaggcgtgagccactgcgcccagcctatatctccattttgcaaatggattgaactgagattattgagtcagtaagcagtggatcctaggcataaatccctagttttgtggctcaaagttcacagcctccatgagggctccatacctttgttgtgtcttttcttctatcctaccctaaagcaggcattcagcctatcttgctagaacctcgtgacatgtaatctctgtaggttttgggctacagtaggtgtaaaggacaataggacatgggttctttcctcaggtgcctagttgaaggcatgagataagcttgcctcctttgttcttcccctcaagacgtgatctgggggctccattctcataaatattcaggtgcgcgtcactggtggtggtgcaatgtggagctgggggagagaagcccagaaatcgggtgggctgagctcagtcccagctctacagccactgaccttggggaaatcaccccagttctcttatccctaaaatggagacattgatcatttcagttcctccttcacaggatcgtggggcaatttagtgagatgatacgtgtgaaagcaacagtaactgcacaccactgcacaaatgtaagggttagtgctgccttctctctgctacctgacccatctgatcagcagcatcagaaagaacctaacacctgcaggttttatcccgcaagtacatggcctggtaatgctctgaaggtggagaaaatacttgccagggacttttacaagatcctggtcattgtgctaacagtaagggaaacaacagtccagataggacagagtaccttgcagacgtcttcgcatagcactggctggtttgctgtctctaaaaaattttttatcttgtgagagtttcaggtttgctttcatgagtcagctttagggaagtaagctgaaagcacagtgcagaaaagatttcagagctcgagttgttcaggtggtgttctttggagcgcatttgttgttcaggctgttgctcctgcttccctcccttccaaatccagcctccctacggtctctctcacacacacagaaccaagatcagcctctctgggctatgtaacaaaaaccatctttctcttgctggtccatgacataaccctgccagtctgggagctattactttttccagatgtggaataattgcagggctaatcacccctggagactgctgggacccttctctaagggtctccaggtcctttcatttaatcctcatgacagtcactaacaataaagaagaaagtggtagatgctgagtgaggagctaagatatttgtccagagacacagcaagctgcatgtaattctggttcaaaattcttaggtctgcaaaaaaactgaaaaatgtctcttgtccctcccccaccttcctacaggaaggattttgtacaaaataacattgcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaataaaataacattgcaattcccaggacagcccttcattccttagctacttctctacagatgtggggccacctactctccccctatcccattttctccatcaccgcctcctgcctccaagcctacctttctgaaagatgttcttgacactgtcattaaacagctgccagcaacacctgctggcattctctgttgcaaagataacaacccaactttaaaaagagagaatacaaaacaagaaaggctatgggaggtgtggttgtgggttttggttttattgtgtttttttccgtttgtttgtttttttgccaaattacattttgtacatttctctgttgattctcttattcctttgcattttctattctctatttatgaaccccctctcccaacccccactttaaaaatcaagaaaaggaaacctgtttcaggattaaatatggtgtcaacatgtggctaggatctgaatacctcaaagagaagtcacaggggttgtctccacctacccaagcctttaatggtggagaaggaaagatggatttaaaaaagacggaggagccagccttttcctcctaccctcctgggcctccttccaacaaatgatgatgcagggtgatgaagatagcgctctcagaatctgtgcctagtgataactccctcagaaagtcatggggatgctttccccacctgtgcgtgtacactggtgtttcttctgtttatgcaaggagtcattgcagggagggctacatctagtctgctgccccagtggttgctaagtcttgatagacaccacctctatctgccctgccctcctgctcacccacagagatgtggcccattctgaaaccaccagcacctcttccttgccacacctgtctctaagtgccattggatcccactgcacaactaattcccttttgcagccagctggaggaacacaaagcttattactctcttaagacaatagctcaaaagtgatagtttctttttttttttccttttttttttttttttttttttgctttcagagaccaacaaggaataaaggggcagcttcagcttcaggaaatcgagttgtgttttgtgttgccagggggttgggggctggcgagggctgaagaggttgggttactggaagcaagattcaagggagctttgcagaggtcaaccccaagcagtctttgtgggaaccatcaaactgatgactctgctgattttctatagtgtcatggaaaaggattgtagggaattcttgccaagtctttagaagaaaagatatatatagctaaagacatgtatatttatagagagatatatggatatatttatgccagtcatgccaatgagctctgcagcgaggagaggcctctagagaagagcagggcaccaggatctccctgcagcactttctggcccttgggaaaaggaaataagaacatcatcgaaggtacctggatctgtggccttaatcctgagaggccccacctcctggactgagagggcctccttaacaaggccaagccaggagttttcctttgaacggttcagtcaaatccctgcagcctagaagacaccttagaaggaaatctttctgggagtctttgatccctgaggaacctaatgttcagagcagagtgtgagaggcagggattccttatgggccaatgccaggagtagggagggggctgatgggagggctgagtgctccatgcctaaaagaagggaagaatggccccaaattcatttttgcttccacctgtgggcaaaaagcttaattggactgttgggcttggaagggcccagaccctgcttttagaggaactgggaggcttgcctatttagctgggaccatctgctggccccccgcttaagcctgggggaacagctgaggcttactgagaaattgggctaaagattctttccagaaatctccctggaactgcatgaggcgtgtgtgtgtgtgtgtgtactctttgtgatttctctgcaccagcggatctcttaatgtgagtaaagcagcgcaggctcaagggtgagctgggcgggaggctttgctgggtgtgcccaatatctggctttaacatctctcattccatctccatcatgtcaacagctttcaagattgactgaagcataactgcttgcttcatccccagcctgtgtgccccttccatccctgcctacacccaaccctgtagaggccctggggtgtgatgagtaagtcagggtaatgacaccacacccacattatctagggctggccttggtatactttccttggtttttttttttttaagcagggggtggagaagggaggcagaatatgattgcaaaacctatttggctgtagctaccacctgaattcctcttttgctacagacagcgtcccccttcctccccaggcaagttaaattgcttaggactggcaaagagactcagagtctaaagaaaaccttcgggttggcagaataaacattcttacccgtcccttccctcctccctgtctcaacccaccccacatctatcctctgggccagttagccctcattcctaaggagcaggctatcatgtgaacatctggggaaatcaagaatgaaagttacacttgagtaaaaacttcctagaacagcactgtccaagataacattctgtgatgagaaaaaacttttatatctgtgctgttcaatacaatagccactagctacatgtggctattgagagattgacatatattagtgtgcctgaaaagctgaatttcttattttacttaattttaattaatataaggataaatagctacctgtggctagtggctattacactggatggtacagttctagaatatgaagtagaaataacttagaagtctagggtaccatgaaagcctaaaggaaaagtctccaactctcagtcccagttgaaaagggggcagttttgtaagatgctacagtgcaatttctttttcatctgccccagaataaaccaaattcccagcttaaagcatcagacgggcctctcttggtgatctgtttcccaggtaaaagaaactgaggggtagataagcaggagtggggcccagcaccgtcccccacccccaaagacccccccctctccctctctggcacctggctctggcttctcgtctacagcagggaccccagtggggacgctgcgcagaatggtgctgcaactgcggacatctggtttccctcccatctctgccccttcatttcttttctgtcagcaacagctcctggctgtggatggtcagcagagtcaacgaggcctgcagacctcctttccggctccctctactcccccatcccctgctgaggaaggttaagggagaaagagaaaaaaagagacaggaaggcagagtgagggtgaaatgaaatgttagtgacattcaagaaagtgagttcatggggctctcactgccctccctccggattcaggatgaaccttgtctggtttataagccatcagtggcttctcccctgtctgagttgccaaactcttgtgcccccaccctccatggctcactgcaacacatgtgcctcctcccatatcatggcaggtccatctgtgacctttgttcttctgacctctcccctagacgaagggggagccccagaggaactttccctccctatcccagactgaatacattcaacctgcctctctgtacagcctcccccagtcgctgtgggtaaacaggaggaagagagaggaaaagctttctttcttgactaggaggttggcagccccagcttgattccacatgggaagaagctattcctttttctgatcttggctccttggcttttactgtcccctacccctagccagaagctgcattaattcaccgggtcactcagcagccagagtctcctctaggagaggctgagctgcccaacctaggaatgggctagaacccagcagtactggatgcaaactccccgcacagctctgcccagctgaaaggctgcccttcaaaccccttttcttgctcagaactacaggggaaagcaggagagcccctgttttgctacaaacaagcagagtgatggcaaatacgcctcagttttcctatctgcaaaatgaggagacggcctcataaggcccttccggagctccattccatgaatgcagtgtcccaacattgccactcgcatgggcagagcaagacgctttcagtagctatggaactgccaaaaaattctcttgcagttttttggtggttctgatttcttttttctgtctttctttctttttttcttttctgagacaaagtatcactctgtcacccaggctggagtgcagtggcgcgatctgggctcactgcaacctccacctccctggtgcaagcaattctcctgcctcagcctcctaagtagctgggattataggcaggcaccaccatgcccggctaatttttgtatgtttagtagagatggggtttcaccatggtggtcaggctggtctcgaactcctgaccttgtgatccgcccgcctcagcctcccaaagtgctgggtttacaggcgtgagccactgcacccggcctttgatttcttaaggaagagagatgaacccattgctcatctccttctactggtttgattccttttgtcttgagttctaagctctggagctgagctgagctgagctagactgaacaggccacggtgaaagagacaggagagacactaagtcaatttgcctttgtttgtatagcagctagagcagggaggagttgaaatgagataatagaaagaacttcctaaatgggacacggtctcaggggagtgtaacattttctttcctagcaaaatttcaaaataagaaagttggaggagaacatttgcctcccaaaagctatttttctggacataatttaaaattacagcttctcctcctatcgctctgtattccgccacttcccatccctggacctcatccctaccttcacagtgaactcgggcccacaacggcctggtctacagatggcggaaagaggtgggaggttttgccagagagcaggggtgagattcccctcccagcccctctctgacttctgacctctgcacctttcttgctagtgatccctaaattactgggctgtctaaccctctctagggaggagggaagcaaacagggctgacgggaggtggagcagagaaagtatgaggtggaggtcaggggtcttttcacagtgtgttttggcaaaggaagcctgtggagctgccagtgggatcagactttcatctcctgagctagccccctcactgggaaagcaaaagctgtcactggagctgtgatttggagcatgtgctctggggaactaggctgcacccctcagggtctggccccctgaaggaaagaccagagaacagacagggccttccctgcaccctcctgccaccaccctcctcagccttaggaggtgacagcagtgcctggaaaggggcttgctcagaaggaaaaggctcggtctgcctacctgggtcgggaagtggtagatgggattgtcctcagggccccagccagcatgaagcctctctgatgcttcttatagccctcagtgtgttcctatcactccagagaacctcccacatgcatttgtctcccagtccagcaaattaaaatctgaaaggaaggaagaggtcacaggctcagagcctggacactagaggtttctcactgagtgaactttggaaggcttggaaggctggagtttggggtcgcagagaagtcagcctccgccatcccctctcaaacttgggcagggggagaccccagaagcttgacatggccagggccaatagcggttactccctttccctcctacccccatttccctcatcacagtcctttttacccctcctgggatatcttccatcccagttcccctcgattgctttagggtgtggggcaatgacagcgaatactcatgaggggcaacaacttcagacaaaatctctgaagactcacccgtgtctccacacttcttccaccccttgctagctgtgtaaagttaaccactgtgactctcagtttcctcgtctgccaaacggagtaaataatagtgcctttctaggatggatgccaatgttgtttggattcaacataaagcagatgcagagggtgtaacgcggtgcctgatacatgaaagttaagcatgagctcttgggtttttgtttcccaggtttcttctctcttggtggctctttaatgaatagtgacagtccatacccaggcagccatagccactgccactgccacagccaaagctcaggctatgtgatgaacctgttttctctgccttctgcccctgctcccagccatcccggcagaggtgcccactcaggcctcctaccggagcccctctcccaccgcttgaatgcagaggcgtttcttctgctgacagcctgaagacaggccatttttcttctcctcccatataatggcctttactctcctaccactccaccccctttcccagccttaatgactttaacatacacacagttatttaaaaaaaaaaaaaaaaatacaagcccccagtgagctgctctaaaccgcctgttgtggaggaggaacaacccaagcacatgttcacaagtcactgcatgtgatgacagggggccttgtgctaatttcctcgtgtttgaagccccagggtgggggcggggcaggaggcagccagaggggagagacccagggcttgggtatttgcttgttccctttgatcctcctagaaaatgctgtagcatttggggaagtatttcatcctgggaaatctcaaagaagagtaagaaagatgccttaggcaggggttggggggtggcaggggatactgtagaaggaagatgctaccagatgaccttttctctccttgagattctgaatccctgctctggcttccctgggcagcaggagagagtacagaatctccaaggggaggcttcagctcaaggtatttatggatttgctgaagcctcctaccctaacactcacacagtttttgccttccagtttctctttgtggcttatctgagagaggctaatagagcctccagggccctcatctgccccaccctgtggatagcatctaggttgagcctctccctctgatcttgacctctagggctgacgtgtagtctgtgaaccaagggttggtctggtgggggagaaggggagtgagtgctgcctgcctcttggcagaccattatgccaggagggaggaggttcctgaccacaggacaggtccggcagaagggagggaggacaaagagccaaaagccccggctgcacctcctagcagggaaatggagctggctgtgagccaggttttcctctaaatcagaagcaaatgcaccaaagctgcaaccttaccccttgaccgaggacgggaaagtgcctgtctgacctcacgttattggtgctattatcatcattattggtaatatcaccatcatcatcctgtaatttaccagcttcaatggcgaggatgcttaggcttcctctgggctttcatgttaagagaaaatgagttgtggcagcctccccgcctctctcctccccataaccacccacagggcctctgcccctgtcctcatcaccagagactctccgtagcccaggcccagcgtgctgtcatgcttgtggggatgctgtgtgtcagggcttacatgctagggcaagggggaaggcccctttgtgtggtagcacatgtccctcctctttaaaccaagaaaaagacttcaacccacaccctaaactagttgttctcaaacttaagcttgcatccgaatcacctgcagagcttattaaaatacagatcactgggtcccacgcccagcatttctgatttaatggatctgagatggagcctgagaatttgtattttccaaatgctgattttgtaagtttccagttgatgttgatgctgttgatctgagtaccacattttgcaaaccactcccctaagggtgagttattggaactcttcttctcctcgcatcctcctggatacaggtgtttacattgtccctcattcgataccttccaaattgggttcccaacaaggaggccaagggcccaggtgcagtgtgagatgggggagtgctgctagctcgcacacataggaaccccttggagagaaggcagaggcaggcaacacccccgcccctacccctgaagatttattctttcatttggtattttaggccttcctcaagggggtgctggggccagcctgactcactgtgtaaacctttttcaggaacactgggctgcagccaagctctcctccctcagttaggcccaccctcattcttccccacctgttcctctagctgagcttcaggctcagcagaaagtgacaatgtccctgtgcacactgtccccatgccctgtagggaacaggcacctggctgcacattgtgtacattaattttcaaagcaaggcttctcataactctttgccatagctttctcctcccctctactccaaagagctcaggaattccacaaaaacagtgccatgggagcgtgacctttgctctttttttttctcctctcggtaggataaagaggaaagaaggtaggaatggacacttattatgctcctatagaatggcagaggctgtgctaaatgcattgcacatcatcttctattaccaggagtgttttctgcctaatgtttgttcaagtcctcagggtaaggcccctgttttgcagtaagaggtttgaaatctccaggtgcacactgtacacagataaccagagacgggcaaagtctagcccagtgattctcagacttgagagtgcatcagaatcacctgactgcttgttaaaacgcaaattgctgggtcccacccccagagtttctgattcattagcactgggctggggcaggccccaagaatttgcattgctaacaagttcttaggtggggcagatgctgctgctctggggaccacggttgagaaccacttatctagttctacagcccattggttagacttttgctggctgttgttttatgtttcactcatcagaactgtattcccacctctagaccagattatactctttctgcgatcccttgaggtcactaaggaaaaatgtgaccagcttgctaattccatgttgtttattcatttattcaaaagataataatcattatagtaaacactcatttagtgctaagtgccactgtcctagagctttgcatgtattaactcttttaatcctcataaataatcctgaggtatctgtaattattatccccatttacaaatgaagcaacagagacacagagatttgaaggttacacagctgatcagaggtggagtagggattcaaaccaggcagtctagttccagaatttgttttgctaatcagtcctctgcttggtgagtatctgttttgagataggcactatgctggactctgaatgcatcaggtaggaaaaatacaaaaaggtgaataagtcacagcctttcctttaacaattaacagtgtttaacagttacagcctttccttgtatgaacaattggaacatcatagaatagtaccaagacagaaatatgtatccagtgctgaggccctaaagcaggcagaatgaataggtctgggagagtcggcaaagccatcaaagaaaagtgtgcatggagcttggtttgtaatgcaaggagttttgagctgtgaaagaggcaaaaggccattccctagcagcagccaaagcagtctgtgcaaaggcaccggcaccgtggtgaactgggcacagcaggttcaggggactatgagtggttcagtgctagaggatcccaggactcaaggaggaagggagtagggcaaaaagggaaagcagctgacaggcaggctagggctacactgtcagtgctcaagagtttggactttggttatcaaggggaaaccctttaaggtctttggagcaagtgagggacgtaatcagatgtgtcattttgaaagataatgccaggttttagcttttagttcagcatgggctacatgaacagacacagtaggagctggccttcccttgcatcctcagtcacttatatgtccctgggtaaaatcaccctctttccctggcactttctatctacctggacagcatccccttactgtctgtttctcactgtgggactttttcttgttgatattttccattcttctccaggcttttccaacctgtacctacctaactctgaccctgtaattcattaattttgcatcttattcttcatgaccccaagaaaaaatctgtagcaatgttgtttgtagcctggaaacccatgcttaagttggccatggctccttgctctggtaggtaagggcagatgtggatacaggcataatttgaggagtaaagaaggggtgacagcctcttcttacccatgcccgtggaaatgaaatgaatgagtctagagttagttgcaggccactgggacccctctgcagggcttacctgtctaacccagctcttgtcatctcactggaaaggctgatgggaaccagtgctagaagcaccatcctgggacctttattttttcatctgtgaagtggcaacaattccttacttgtttatttcacagttattgtgaccttaactcaaacctgactttgaaagcctattataaactgtaaagcaccagacaactatgagagagaaggagggtacgtaaggctggttggttccaacagaaacagaattgagccatccatcaattcacttcagacaaaaccccaagataccacacaatgggaagccggcccgtgtccaaccctataaccatcctagtgagtccctaggcatcttttaactatggtttgaaccagcctgtcttctttctctggctatcaggttttctgaggcactctcttaggaagactgccattctccagcctgacctctgccaaccagggcctcaggttgttgctccctggggctatggatgacctttccagatttccagcccattcccctggggagcagtgattcctgttgtggagacagctggccccaggactccagctcagacttctcaacaaaggactggtccaagaagaagaacatagttccaatcagactgcctagactgtccaggacacaggcaaagtttggtctcctttaccctaagagaatcctttggaggccattttacattcttcctcttcctccaggccaggtagcctctatctcttcttactttaatgctggagcctttgtgtccatgttcagaggatgtgccagccctggagggatacagtgggggaacaagaagagacctcccctggaaaggaaggactcttgcccagtgactggctgtattccatactggagtccacagttcactgtctggtgctcagctgggatgagtggacccagttggaatgtaggaagactcacgctttgttcttatcacatccctgccctctccccctccaccctttagccttctttctcatcctcccttagtggagctcctgagtgctcttcaggtacagggtctccaggtgttccggttcactcatcatataccttctcccccaaagattcctgcaggatcagccagtctgctcactgctgttgagttctgttttctaaggggtacaggagctcccacgagccactagtgtgcaaagtcctaacaacagctggctcccacctgtcccagctcccccagaggcagcaaatggccagggctggacagagttcccagcaccagggaggtatcagatcagcaggggccaaatccgatttcccttgcattccagaggcattgagggagaccaggaaacaccagctcatttcctcggggaatttctcttgtatccaccactgttgtcactttgcagtcgtgaacttgaggatatacaggtggggggaacacatgaggaggagagaaggcctaagggctagtgtggagcagggagtgcattgtggggtttgagtttcagaactgaaagcagagaaactgggctgagccttgagcagaagtgcctggtgacccctgtggccctggtgcatggaccagcctattgggggcatgggagctcctccggcttcccactctgatggcttaggtcagcagccttcacctgcctcttctgcccttcccagtctcctcccctcagtttgtcttcttcccctccctgcacacctccagcctgcctcctccatatggtctccacatctggctgatgaccatccagagagtttgacaatgccttcttccctccctccacagcccttacctcctcccacccccacccgcggcgtctccttatgactctgccttctgtgttcctccttccctcccccaggcgcctctgcaagaatagaacaagcaggcaggctttccaaagagttagcccttctctctccagcccccaaccccacacacaaccattggctgccaggccatagcaagtccccactcctctcttttccatactcaaagcccctcaccgacaggagctgaggtctgccagtgggcaggacccctccatgaccaggcaagtggcctagacacatttgcaaaaaccagtcacgtcatgactcagagattctacctctgatccaaatacccttctcagaggggacttggcacaagggagaaaacccacatattccaccaacttctcttcttttcaaagcgctatctcagcgggctcctaattctgtctccagcatatgtgcttctgtgtgagtgggggtgcgcacatgcaccacatctcagcatcctggtacccgcatggcattcccaggaggggcagaggaaatgaaagtcgagcaagcagcagcagatgttgctggagttcttcttcctggcttggtgctgctcatccttctgcaggtcagactggtaatgagaggattaattttagttctcctccttcttggccccaatatggctggccaatgctagttcagctggtaacattttcattggcaaatcctccactcacccttgagacaggctcagcatgcacagccccagaacgagatctgctgggaacagaagccttggcccttattcttggacagatatgacagcttggtagcaaagaactgatcctttgtccccttgctggtagactggaaagaacgctgggctggactgcaggtgaatcctgcttggccgtgtgctagctgtgtgattctgagaacttcacttagattctctgagctccgattttctcagttcttaatgaacataataacatgggatgcacagggcttgttgcaaggattaaataagataatatattcatatatagtaagcactcagcaaatgctagattaagtctgaaatctaaacggggctcatagtgcagggaaatagaactgcagactttttaagagaccttcaaaggctcactaatccaacatcctcgatatggcagtaaaggcattaatactagtggccgtaatactagtaaacacacataatgttttctgtgccatctactgttccaagtactttatttgtatatattaactcttaatcttgcaccgacaggatttgaaataaggaaattttacaaatgagggcatttggcttatagaggctgagagccctgctcttgttagtggtaaagccaggagtccaatctagcaatactggttgtagattttgctcttaatcactacccaacactgcctctcagatatgccagtgaggcagctccagcctagagggcagtaacttgctcacagtcacctcgctgttaatcttctccctctcaggcctgggctctttctgtgatgttgaactgattagtcatattcactgggagctgctagaaggacccatcttctgcagccagccagccgtccccagagtatcccagttactcctttcttctctaatgctgcccaaaagtgtcccctgaacacaaaaaaacagctttgtgcaggctcctgcagggactcccaggtaaggcctgagcactctcagccctcccttctgccaagatggatagtaccatccaaggacatgatgagatcagctccctcagccctccagaatctgttataaagagaaagcagcttccttgggatagttgccacccaagaactcagaagccaagctttccagcggtgagataagtgtcagggcatgtgctcggctcagcctgcccagagctgaggtcagacccttgtgacccccaggtgtcatctgcggatgggggcagtgctgtgggcacaactagcaggcagaggagatggaagaggagggggcagcggtaacttggaagtacttaggagttgtttttaaaagcaatgtcaaagtagagagctagaaattgaaggaagaacagaacacactttttacaaagcaaagtccagggatccctggtctttcacaatatgaccccaccaacctttccaattccacagtacttcctccaacccaaaacattacctctgcaaataacagagccccaaacagtggttttcacataggtctgcaaacaatatgtgcatctttcctttggagccactcttcaggctgctgttacgttggtgcaaaagtctttgtggtttttgcctgttttccccccagctctctattttgacactgctttgtgcttatctcactgcacaacattggtgcagaagtaattgcgggttttgccttttttttttttatggcaaaacccacaattacttctgcaccaatgtaataactgctaagatgtactgagcacctactatgtgccccaggcactatgcatcatatgcattttcttaaattaattctcaccacataatcctattagggtaagagctattattatcatcttaaaaaaaacttcctttttatacagggtctcactgtcactcaggctggcatgcagtgatgcaatcatggctcactgcagcctggatctcgtgggctcaagcgatcctctcacctcagcttcccaagtagctgggactacaggcgcatgccacatcatgcctggctaattttaaaaatttatttatcgcagaaacagggtctcactctgttacccagactggtgtcaaactcctggcctcaagccatcctcccgccttggcctcccaaagcactgggatgaggcatgaaggtgttgggatgaggcatgagccatcttgctaggcctattaccaacatttaatagttaaagagatcagaggttagcgagcaggttaggtaacttaggcaagtttcttaaactcctactgcccccattttccttctgctacaatgggggactaactcagaatttattttgaggattaaatgtattttgagaattaaatgatagagtacatatcaaacctttaaaatgtatctgggctgtagtaagcatttagtaaaagttaactgttattattatcattactgcattcaccatctcctctgactgaaagtaccccagcccttccccagcatgctcaaatctcactagtccttcaggttcaagctgtgacagtgccaacatggcaccctgcactaccaccacactgctcttctttgataaggacaacttgcctcttcccaagtttatcaaatgctaaggaagcttacctacttacctttaatctatgtcccctggttcagattggagcccatcatgagatgttaccactcgttacagcctgcattgggaataataccccctccaggaagtcttccttcctcagcctccactgatatccctgaattcctgcaagaccatcctctataatattcagcatttgctcactggcattacttcttgttatttttcttcctctgtcttgctctctgcactggattgtaggattcttgagagcaaggactatattttattttattttattttatttattttatttctgtttatactgccaggatatttatcactccggaggcacttaaaacacttgttggttcatgcatcaaccaataatggttaattgttcattaaaaacaatgtagattatagggtaaaaggcaatttttgacagtacttattcctacttcaaaggccagaataacactggggtcatgaaatcataccatgaaacctattgggctttgatcacatcggattcattccattttcttgtgcttggttgaactagccccttatgaacatgcccacagacagctcttgcctgctagccagcctcatgccccggctctggcaggcatccagccccacagggcctcctgctcccctgcctctgtgggtggctgtgcctctcctcctggccgtggttcagatccacccgcccctgcttccccctgcctgtcaatcaccagtctctggagatggtccccaaggcccatgctagttctccccagcctccagtcacaaatgactgcttcaaggcaggctggtctttgtttaatgcttctttcatttgactttgggctaagaggaagataaatgacactctgtctctttaaggtaaaatagaggcattaaaaatggcctatttttttgccttttaagaaaaaaaatcctccaagttattagcggaaagaaaatcatttgacttaagcagcctctggcagtctggtgatgctgagaacaatatacctatcagcatctatcaggtttggaaaacaaagccatctgcatatggggaaatgaaggggggctgaggactgagaagaggtggtgaatatctaatgagggatgcacagagcaccccacgcctagctgggaaagttcttggaggtcctggtgtctgtggttgtcagtgactagaaaagtctagacatttaggaagggagcattaagtttggactttgaaactttttcttaatagtcaatacagattttagagttcatccaatctaagtcatcttttttttttttcattttataaactcaagactgtagaagataagtgatttgcccaaggctatacttgatttgcaccataatcggggctagaatccaggttccctggctttctcagattggttatcttgtctgctgatagaagccccttttctcacctgttgaacatgctgtctcttttcttctgccccaatctttcttccactccagaatctctccctgtggaccccagtgtgactttcccatccaagtcttctgatttcctggtgctccagccctttgtccacttgcccaccaggcataccttctaggacaggggctctgtttattcccaaacagggccacgtacacccaaaatagacttttgggtgcagcagtaatttgccctggggctaggtcccagcaacatcaagtctgccatggaagacagagaaatattcatgacgagttaaagttatgcccacagacaaggctgatggtccagacttgctgatcatgtgtgacccgtccgaactctccctgtgtcttgtcatcactccgttaatctgcacttgtttatcggtttttgaatgtgtgtcctgtctgcatctacaacgtgtgcctgtcacctcctgcctgcccttgactcccaaaggtcagcctcagagcctctttttcccttgagctctctctggggcacacagaggagctcagtgcagggaggagtctgcctttaccccagcccagctgttccatgttcaataacttggtctgagagcatccacaggccagagtgaggacaatcaagaccctctctagggagttcatgaaaaagagtgcaagccgggtggatgatcagcttggccttatagaaaaccatcgaagggcagggtatcttttgaaatgaatatgggggtggagttgagagtccgtgatcctggagaagcctggtattctgactcccagaggtcctgcttcttgtgcctgctgagaagtcctgtttctctggcctcatgtcctggttgagattgggtctcactgggatagcatgacctggccacagatggctcattagaactgtgttgagccatcagtctctcaggagcactacctgtcattctaaaaaaaaaaaaaaaaaaaaaaaaaaaccccgcatactctttgtcttctttttgtctttattttcccttttagagactccctagtctctgagggcctgctgaaagcagcagatagaacatttgaggcagacacctgagtttatatcccaggctagctgtatgccttgagcaatgcacttaagctctctgagcctatttgttcttctgcaaagtgggggcaatagactccccctcatggcattattatacaaattgaataagagatggaatatcattcatttattcagtaaatatttcctgagcacctcctatgtgttggtcaccctcctagatgttaggaatacatcagtgaacaaaacagatcagcacctgttgcattctagtgccctgttttaaattggaatgtgtgtattttaactgaaatctgagggaaggtattgctacatcctcatagtccattcctcttctctggacagaatacctctactcgctatccagatgtggctatatatgaagaggggaaaagagagggagacaaatatgaacatttaaggagaaccacttctcctaaattacaccttttagttctcaccaatggtgtaggtatcgctgtccctactttccacataagtagatgaaagccctagaagcttgcggaacttgcccaaggtttcacagcccatgagtagcaaaaccaggatttgaaccacagtcttctgactctaaagacctgcctttgggttccatcaagctgctgcatatagcacattcactttgtcacccatctcagtattaataactctgggaccccaagccagagagcaattctgtaatggatttgtgttgggtggggtgaggagtggcaaatggggggtcagcatgcaggtgcttgtgtttgtgtctgctgagtctgtgtatgtgtgtggggtttcaacgacagggatctcagtagggaattggtatttgggctgctaaataaccacaatttgtattaagcagaaacatagtcattatgcaccacgtgcgggctgctgctgctcactcccgttagggaagagcgcagctgatggcactttggcctgtggtcttgtgaaaagcttccaccaggggtcctgagatggccttctggggacaggatattgggaggaggtggtaggggagtaagaagagcagggcgctagggcatatggacctcaatttcaggagacgtgctccttgcctcctacctctatgggcctctcatcagtaaggccattctggttctcattaacgcaagtaaatacgcatcccagcactgggcaggggacacgtgttgatatttaattatatagtgtgcactgagcatattatggctcctccagggaatggcagctgcagacaatgaggtgcaatggagtacattcaaaactacttagttaattaatgcattagcggcccactttgctgtgaggggggtgtgggagagagggcagagattttcctggtgttcttttctcccttcctgttcctctcttcctctcagccttttcttccagaaaatataaaatcgccatagtcaggggagtcctcattaggagctgtggtccaagatttactgagagaataaggttaaaattcagcactgagataagtgaagcttggaaatcatacatggatttcctttgcctagttgatgcttatccccagcaacctagagaggctggcagtcagcaaactgacattccaacgtagccccaagctctgctctctattttgggaactccctctctcattcagtagccccaggtgcagactcaggtgcggagttgcagcaacacacagaattccattgtgctgagagcttcatggtttggagtgaggaggaaggagtgctatgcctaagccaggtgaagtgtgaggaaccgaaaccagaggtttagaatccatctatttacaaagagacccttccttctaggtttctttcaatatgtgtttcccctctcctcccactccacatggcacctttaattcttacatcaatgcatgaagttctcattctgtgttctttgcggttttcattgttataaactttgtacatttgttgattttcctttcctcaccctggaacccatggactttatctctcattcttttgaactcagaggcattttccaaactgctccatgtgcatttgtcattaagcctcttagttacctgtattgctccctctcaaaacaagctgctaaggtcaaagactagatcatactcagcattctgtgcatagcaccatactttgcacaggaggcattcaagctgtatttgaatgccttccttattggatcttcaggaagtacctgcaggtcaatgatcatgtctttttgtcttttgggatccctgctgccagctcagtgggctgagcctgctgagggttccagcaatgcagaccagttggctgccttaggtccaagccagcctaacatctgctcttaggacagtcacctaagccagaaatctctcggagagaaggtgtgttgtagcaaatctgtgactgggaatggaactcccatcactagttgctgatgttatcgagatttttttccctttttcaaaatctcactattgtggttgattcctttctgtgttgtgtttaatgtgagaaacataatctgcccttatgatttctttgtaaaggtggggtggtggggaaggaggggttcccttttcagagttctctctccttggacaattagagatgaggcctacgcatgggaagtaactctcagttcatcggtatggaagaaagagccctcagctgtagcaggaagtcaaaccttagtggggacctttctgagcaggagggaggagtacagtaagcactgaatcagcttgccaatgggagttgtagaacatttgttctctctgatcaaaaaatgagacccagatgtcctggcccacgtgggagaggatgaagtcaccggaggcttgaggccgctctcagtcctggaactctgtagttctgaggtgaggcagggacgccactgctcaagctgccttctggtcctgagggagtggagaccagggaccccaagaccagcttagggttggaccagccccagaccacataggggtagctgggcttgcggggttttgagacagatgaagttgaaagaggctattgacgaaagctgccccgttgttgttttcctaatgggagggttaaggcgaacaaaatcgtggagagaatggaggatacaggaagagccctagagaggacatcagaaagcccttactgaagtccacgctgccacttcctagatgtgtgactttgggcaagtctcataaactctcagagccttgtttccccaaatataaaaccggggtagtaatcctcacctcacaggcatgctgtgagggtgcaatgaggtattctatgtagaaacactcagacacagtacaaacattctctaaacacagggtactattatttcctcccctctgagacttacttccttttcctgggtaagagaacataagctataagatgaatgagggcttgggtgcacccaccagagatctgctggcatgccaaggatgcccaagctccaggctgagaaggagggaggccaggtgactgccatggtcctcatttgctacatggctccccaggccttagaaaagaggcaacattaatccctccatctccacaggcctttgccaatcattgcggcaaattcaaacagggggcacaagagaagcggagggtccagcagctttggttccgtccctgacttcccgcctcagaggcctctcatcactgtaattcccctggcaaggcccccacctaagcctctttgctaacagagtatttttaacctgccacctccttgcagctttgccgatctgcagacaagggtcccggcgagataagagaatccgttagtgccgctagagtcaggcagcgcctgctaagtacttcctcaggagctccctcctctgcccccagggagccgctgccggactgacgcccagggatctgaaggcgaggagggctgggtttggcacctgcatgaagggagctccagcttcttcactcagcccagcctctaaaacagagtttgttttctctatcttaggtgttttcaaagatggtccctgccctggctttttaaggagccaaattattccacttctaagggtatcagatactttcatcttcccttttccctccaaattctgtggggatttggaaagaaagtatttcttagaaggtgtctggaactggccctcaatggaagacaccaccaaaaagcaactggtactaaacctccctatgagagggaagggaaggaaggctcacctctgctcttaccttttgcattagggcatgcggagcaaagaactgcagagtcctgaacagggttcagggagtaggggcagagctcttgtttctcctcttccgcctcctcaggtagatgttggtggtgaatggagcagaagagggttttggggaacaaaaaagaggcagaggtggattgggctgggaggggcttgcccaggaaggggaatcacagaagtcttcccctgtagcctgcagggctaaaggtgtcccctaaccaaatgctctctaatggggcacacacatgccagccccttcctgctaaggtcaatttccatgctaaattgttcattattgccatgcggcaacactgtatggaagcgtcagaacccacaagtgtgggcagagtggacaggtgaacacatgaatacacctgccttcctgtgctccatggggggaagcggcccctttgtgggggtggtgatgagaagccccccacatgctgacatccaagagtgggagaagggcatctggcccagaggcagagatcatcaattcatttagcaagaatttatggagcatcgacttgccaggcactgtgttcagcactggggacaccaaactcaacaaaacaaaggatggttgggagaaaggacaccagcaagttgttgcacaaataactgcttattacatggctggccagtgttgtagagatgtccaaagttcaataagcagcatgggaacctgtaactagggaaccagaactactgggagaaaagggatcaggaaaagcttcctggggaagcaatatttaagctgaattgtaaatgctttgtcagcctctctgtctcatccctaatatgcacagtttagagctccctaccccatgccccttggggccacccatccacatttcccaccagccatcccaggcaaaggtgagctctctaactcccatactgctccctctctctcatttcccacattgagtttgctgccaaatcttgtctgttcatcttttccctcacctgccctcctttccacctccctcccccagcccaggctgagacttttattatctattcttgaacttgtgctggctcctgccctgccttctctaagttagctttcacattttttatatcatttaatggctctccgcagcttgtaggtagggtatagctgagtctcttgagcaaggtcttggcatccctccaccagaaacagtttatccctccctacatcccttccccatgccacttctgccacactcacaccctgttcttccagctttgccaatccctccctcttccctaagtgcccctgtgccttggctcaagggtcagtccatgcctatgtcttgactcaagctgtccctgccatgcctccctctctctgcctgatgaagtgccctgtcctttcaggtttaagttatatcacacctcctcagtgaagccttcctgatttgcccctctataatcccacatttcttatcattggttacagcacttagcagagtcagccttgtatgtgagttgcttgtatttctttgttagaggcagtgtgcacagtggtgaatgtcacagactttggagtgggattatttgagctcaaaacctggctctgttcttactaggagtatgactttgggcaagctacttaacctctcaatgccttactttcttcatcaggcatacagagataataacaggacctacctcatagagctattgtaggcatttaatgtcttcatacaggtaaagcacacggaacagtacctgtttgttattatgtttatttcatagtttatctgccttccttgcctgattgtgaactcctggagatcaagaagcatgcaggattcatctttgtactcccctaaaaagattctgcttctccccatagtctcctcaaagaaagaagcacaaagggccaaagctagaaaggacctcagggctcaccttgagtaaatgctaattttatatatcagtcaactgaggcccaataaactgaaggacttgcccaaatcacacagctagaaacagctctggaaacctagcagtcaggaatgtaatacccaggtctagctcacatctctcctgctccaatacaaatgctatttctacctcctctttggagaagaacagatggtcagtgtcatctccagtcttcccttggcatatcactgagtcacattttccaatcaccctcagccttctgcccttcctgctaatggatgtcagctgtcctgagccctttggcctttcctaatgaggcaggtttttctaccttcccatcagggtgctgtgcttctacacagggtgctgcgtgttctttaaatagagagctctaaggagctacaagcaggatttacgcttggcctcaatggagactccagggcgaagaaggggagagatcaagttgaggcacacacaggctggctcctgctccccctctcctcccagcacctaccctgccaggcacccaggccacattcagactcctccttttactgtggattcaatacaatctggaaaatgcattaaacatgacacagagtagttgacgcgtaattaataaagtacagattttggctggaagcctcaacttaaaatagcaccatgactgtggagaaaaagggagggcaggggagagaggctggagatgaatgtgatgagaaccaagaccgttatctctgagagtaacaggaccacttctccctccaaagcaccctgaaattaaggaggaggaagataacaatttttttattattattaatgggatgaagctgaggctcagagaggctaaatgtcctgcccaaggacactcgtgcaccataggacagagccttggccactcgtccgtgccctcaggtggtcagagtccaccatttgcgtattagtaatctactctctcgtgaagttgcacatttcaggactgtttttaatttgagagatgttttaatggcattttgagacagactgttccctagctgattctccagagaggctggagggagcttcatattttctttgaagaagcaaaaaataaaataaagccttttcttctgcaagcacattcagagagccctttgctgcagttcaccagccttctggtgtgaggggagaggtgagaaggggattgaggaaggagagggagagggtagaaaaggcttctgtggttcattcaaatgcctgggcctcaggggcattctctattgaagctggatccctgctgctttctgccagagattccagactggttttctgaagcaaaatgtaaatttcagcccaactaatcaaccctgataaggcaacatcacctccagcctgccagtcattaacaaaggatccaaggcagacctgggcgactaggagcagcagctctgggtggaggaggctgagatggaatattctgaaaactccagaagcaaatcaccagaaagcagaattttgataacaaaggggaaactgaggcaggaaatcctgatgtgattccctcatgccacttgcagtaattccttcctgtctctacaaggtagaaatgaacttgatctttttaaaatagcagtggagagatggggacgtgtaaaagtctattatagtacaaggcccagtgggccctctctgagaataattaatctatgaattatgtgacataggaaaacagcactggtttctgtggcatgatctgtgttgcatttgtttctgtgccccagagcatgaatgctatccttagcacatagcaggtcctcaaaaatgtttatggcaagattcaggagaccaaaaccaaatctgtgctctaaacctctcagagccttggtatatctgtctgcagattggggataaagaaggcttgtctttcttccagcctgttgggcagattgaatgagatgacgttcctgtgtggaagccacgcaacaatgagatgctgttgagtatcagatatctggctgccgtgttctacctagttctgtgttcctccctcccatgcctgggtcagggccagctagactgatctggcaatcagagggacacaaggagtttctcctccaccccgtggctctccttacaagcacactgttctcaaatacccagaacttgaacccagaaccttatacagctactcttcccagggggaaatagttcagagctccagagccagaggcccagctgtcaactaaattccccgcaataaccctttctacttctgggcggggggggttgtactaatgaagggaagaagggacagagaaaaaacatgctatctatctctggtagcagaaggagtgagggaggctctggtgggagagacgggttgggtttcactggcattccatagcaggccttccgagtgcagctgaatcagagctgagggagctgccgagaccagaggagccttacagtcgactgtgggcaaacctgatagcccatctggaatccatccatggcctggctccctcccccatgtcctgagctcactgcagaagccatggtggaggagcagggccaggcacctcaaccagcaggctgtaaaatcccccaagtgccagcccaccagcccctgctgtccctccctggctctggaagcacaggttcaccctcccactcaccagcccctggcttcagttcctgccccttcctctctgagaaccagagtgaataatcttacggctttgagtagtacagagatggcgaagcagcatcagagatccggccctcctgaggttatttagagggcctgagaatgccagctccagtccatgtcagcaagaattgcaagtgggcgtcacggtagcaccagactttcagatcttcacagaggagttgaccagcccttggctgtcagagtcctaaatccccttggatggctggtgtccccagtctcctctgactccaacatcctaaatgcccagactctcaagacagaaagagcacgagctggaggacgtgggattgtgcaaagagcaggggcagccgtcttcctggagcctggtactttagcataggctccccagctgtttgcttggtgattttgagggagttgtgtgctttcaccaggactcagttcctcttctatgggaaggtacttccccccacaggatgatcatgaagatcaaaaaagaaaaattaggtgatagaaacaaacaaaatgtcattaccttcagcataccctcagcctagcagatgataatgcagtgcctgttagatggacaaaggacaacattggctgggagaatcaatgcccagctctgaggagccctccccagagcctctagggaaggggtttccccattttcctggcatttctcccactccctaggttgattggagtcatggtggttttgttgtcacctgccatatttcagtaacctttgaccatcgcccagctagcctgtgggggtagatgcctatgcggctctccctccctctcccatgcagagaagcacagtcctccctgggagcaggaaggaatgtgcttcctgggaatactccttgccccatgtgctggagatagagcccactgcagggctccaccacagggaggatcttgaaagccaagaaaagcgacccatttgttggagaacccgacagggtcagaggcagctcagaccacctgtagggaatcaggcccttttgcccaccacaaatctcttttaacaacaaactttgagaacagcctgttttcccagcgcagcttcctgcatagtgtttgcctaatctttctgtccaaaatccctctccaaacaggaggtttcctgcccagcactggcaatcagagagctaattatgtgggattagagatggagttggggggtgttccttttaattacaggaaaaaattagtccaactgatgtcggcaaggccactgggattagaatgaaagtccaggtttgggcacaggtcagtttgggaggtggtagagcccccatgctctggggctggtgtcttctgcccttaactgcctctggagtctggggcagacagggggaaatgcaggtctctgaggagcttctcttttgggaatcttggagaggtcatgtgtatgtatgagagaggagacagacacagggagaaagaagtagagacagcacagagaaagaaacaatgtatatggagagatctggggattgatgggagagagacaaggaagggaaggagaaagagagacgcaggtgggtgttaagaggagattttgagtaaaaacagacagagggacacaggtttagagaccaccatttctctccccacactcactgtggactagtatttatgtgactgtctctttcaacggggaagaagagaaaggcatcagaagctgtacctaggcttctgtcctccctccttcctaccttccttctttcccacttcccactctctttcccctggtgtccagcacactggcctggtttcacagcacacggtgccagtgaggaatgctttggcctggctggggacaaggatggtgtggaaagcttggactccgctgggctcctagtgatcttgagtctcctctgtggcctgaagatggggctttctgccaaacagtcttgccttctctcctatgagaagaatctcttggccagaaaagcattcattcattaatttattcattcattcttccattttacaaataattacagagctttattatgggccagacccataggagtttctcctccacccccgtggctctccttacaagcacactgttctcaaatacccagaacttgaacccggaaccttacacagctactcttcccaggagtctatgaatttttattagtgcagtggaatacaaatcaaccactggctttccattttgagtggtatctccccacctcacccctgtcatccagcccctcacttacaacatcctgagagtagcccagaccctcactcagaaacatccactggccaactcttccttaaagaggcaaatgatataagcacagagtaaaaagacctgagaatattttgaggcaatgtacaacaggtacagattcatagggtacaaagaaaagacctgagcataattatttgtgtgtattcatatctcacttctttccaaagaaggaattaagatgacttacaataaaagatttggccaacatggaatgataactgtcttagaactagaaaagccaagccataaagggagtagaaacacatatgttaccaagaaggtcaacataggcaccaggatccagcatgagatttggcctgagtgtcccagcagccaagtcataaagggaaatgaaatgagcaagaaatctttacactttgagagaaggcagtgtccctacttttcaggacatttcccagacattacattctgtaaattatttatcatgtgagacctgtacagacaccaggacaagagtttgacatccaaatcagatgcttcttttatatggcaatttcttgtattagctcctgacaaagtgccaaggctgtgacttccatgcaacaagcagcattcgatgtgttattcttatggagtaacaaatgctgaaaaataagtatatgaggctgtgagggaaaaggaagcttgctggtttggcttttgtggtccaagtttacggctttctggagctctcacttgattcaagtatagaatgcaatttttaagcaccctgtcatgcttggcactctgctaaaagttgaataaaatgaactatatagattcaacttctacatctgggaatttataatttatgttggcacttagatgaggctcagacagcagaataagagcattaaaatgacagacagtaagatgttaacattatacacaagacaaaggtgagtgtattttagggaagtaaatggattaataaaagattttataatcaaactgactcgtttgcatgcctttctactactggctggctgtgtggcctaaggcagtcacttaacctctctgagcctcagtttcttcatcagtgaaatgggttttgggtttcatcagtgaaatgggttttgtaaatgatttgcatgtaaatcatttacataagatgcctggcgtcatgtccaattcgtagcatgtgctcaatagtatagctatgctcacattctaggattgttaaatagggatgagttcctagtggggtgagaggagcaagagtcttccgatccactccagggaagctgaagactcattacttctttcgatgaatgcccccaaagccgttcgcttcctaatagtcaggatgtctaaagctgaactggaaatattccaacataggtcatctcaggaacccgagaaacctctccctttgatctgtttatatcacaacttgactgggaaatccataaccctcctttctttcaccctgctttccccacttaggaaatgcccaggacttggattttgctgccccagggtcattatttaggccatcctccctcaccagccacataggctctcctttccttaagcctcaggtactccttcactgcgcttcatggggaggtcctggtgtcaggcagaatgaagggcattaactcccacatttcctggagggatccctttgtccagattggttgtcagccagacccaggcagcctccaggctatagcaagagggggtgaagatgggaagccatgtgatgctcccctgcacaccccaccacacccctgtgacagctggagcccagcatcccatgagccagagctcagcatcccatgagccagagctgggcagggagggtgggacaagtccagtgcagccgggtgttgggccaggagtcaggtaggccccaggcgggtcctccaggcacatccccttggtcctgccctccccatcctcacctccgcttctttgcagtttctctggtactttccaacttactgccaaattgtcaaaagctatgagaggcaaagtgctgttcagttaatgactccagtccctggagaggtggagcactcttttaagagaaaaaaatcctagaagagtgggggtgtgggaggggcagaatgagggatgctttagtactttacacaaaagccaggctatagctcctttcagcactttttaaggagcatattagcagtgggtaggtttgccccgagctgccttctctctgtgggtgaaggactggagcctcccccttgcttttctctatttcacaaagtgaaaagggtctgagacagaaggctgccatcccttcggcccagtgactgcggccctctgtgtccccagcaccggtcctgtggagaccctagtcaaacgactcctccttgctctgagagaggctgccttcaaaagcaggctggaacggccactatgcaaggggttcgcgctccatgcacctgctaaccctctgctgcctcccgctcctcctccccgcagtcctgctcccttggaaaggacagaggaggaggtactaatttcccccatgtccccctgaagaatttcctcccagcccaattttcctcctcagtctggtcccacccaagtctatgaatcagagataaatcaatccaaaatccctctttcatgctttcctttccagtttcccaaatgctttcacattccttatctcatttgttcccgccgctgccttgtcatgctggcatgttgtgttaccagttttgtagatgaggaaagtgagaattaactcccttggctgagtgcccctgcgtggcctccaccccagtgagctagacatcagccttcgctggacaatcaatgtctattggaagggaagatggaaatgcagagcttggaagatctagaaaggaaatcaaaaaaaatctatgaagagactgcccaaggcgagacttgtacaatctctcacttccatcgtctcttgctgtgatctgacttggagaggggagaatttttttaaagttatttttgttttgagttggccctagtgtagctcccttggtcttagtccttggtcatccatgcacatcctctgcagccactgccactttttgggtgcgatgatgtggctgtccaggcccaacagcacatgaatcctaggtagtgccaacttctcaggggccaggaggacttggggagtcctaaggagaagaatagaggctgcactttgcctaccgttgagcccactggatattctgagaatgctcagagaaaaggcaggacaaagttccttcctcacagggccaagccctgcttctcttcctcccactctgcggtgagatccgggcacctgctgtactgtacccagcaccagcagagtcttcacgctggcactctgcccagcagctgtggggcgttagcacaaaaagggggtgggcattgaggacaagcaggtgtccagccaaagagaacaaggtgaccggggagggtcttggagcagtgatggcagggagcaaagagagtccatggaagaacaagcagatcgagacaatccttactcaccaccccacccccaccccaccttgattagaatgatctggccccagaagaatagcaatgaattaattaggggcctgttttcatgaagcagctcattattaaagcccctctcctgggaggggagatgggaaaaggtgtgaagatgacagctattcaaacagaatcttttaaaagaggtagaccctcccccagctgtctgttctgcccttgggctctgccaagcagtcaggcagaccagagcacacagggtacccctgggctggctgccggggactgcaagggatggaggctttctggcttgacttcccttccctcccttctcctcttaccctgttcctcagaccccaactctgacctcatcttcgtaacctcaattcttgctttccacctgtctgagccagcaggctttccgcttagtggtcctggagtccttttcatagcagtaccttgagtgtttatactactttcctcctaagagctctcaccagcccactggggagccagaaaagatcatttcgacagaaacaaatgtggataggtgtttacacgccaggttccagaagattccgggtggttgggatggcatggaacaagattccctctttctctactcatttttctctagtgatggaaaaacagaggcctagagaaatgaagacccaagagagttcagatcctggctcttttgcctaccagctttgtgaccttggggaagttacctcaccctactatgcctccgtttcctcatctcagccttagggataatagtagcgcctaccccattaggttgttgtgaggattaaatgagaaaatgtgcataaagcctttagcatgacatcaaacaataataggagttcagtcaatgtgagccatgagtaaagttctactcctgcccagtctcagcaacagggattccttcatgccatcagcctgtgttactgagagcctactgtgtgcagggcagtaccaagtgtagtaaggcatacgaagctgtacaaagcatggtttcttctccaggagcctgaatatcttaggaaagatgactgcatatgtttacaagtaactgtgccaagagacattctaggtgctatgggagttccaaggaaagattggtgcaggcttcgtggagtaggtagcatttggataaggccttgaaggatggttaggatctaggaggtagaataaattgtcaagcaaaggcgtgaagacgaaaaagctggggatgcaattggaaaatggtgagaaggccatgttagctagactcctgaatgacaaactgaggagtatgaactcttctaaattattaaaggggacaattgaaggtggtgtgtgtgtgtgtgtgtgtgtgtgtgtgtgtgtgcgtgtgtgtgtgtgtatgtgtatgcatgaatacatgccatgatttacttttttcattattccaaaagtagtgtatgttcatcataaaaaaattaggagactgagttaagcaagagaaagaaaattaccaacacctgaaatttaaggattttgcatacagaaaaggcaggatcgaacaagtgttttaagaagattaatctggcagtgtttggtagaatagattagaacaagaatatgctggaggcagggagatttctcaggttattgcagtagcccagataagaggcaataaagactcagccccagcgcactagcaatgggaagagagattcgatggcatggttgtaggctccatttctctcggttaccatggcttttctgcaccatggtgggcacatgccacgtgtgtgtgtgtttttaatgacttcttttaaaatctctgggagtctcctgcatttaggcacaagtccagtgtcagataatggtgcttagcgctctcgacctcccttcccatccctacagctggaaatgccatcctcagtgttaatgaaagcaaagattactgttccagattataaaatgcagggcaatctcaggccatagaaaagaaaagaatgaattaattaaagagagtaataaccctcttaaacaccccatcctttgctcctttctccagactgcaggtggccttctttgtcacagtggaggagacagctatatgatctattttgttccccaggacttatctccagaggcacccagtgctttttaaatgtagtttttagtcctaatgtaggcattgtcctcctgtttaacttagagaaagcgtaggctctggagggaggcagaataaaagagttcaggctttggaatcagacagattcagcttcgagtttcactctgccactttctagctgtgtgatcctgcaatagacacttaacatgtctttttctataaaatgagaatgcctacctcagagttttgaagagtattcatgtttatatccctgaatttttgcacacgggttgacatagaatagatgctcaataaatgtgttgaactaaacttataaagagagagaagctattcgaaagcaccatgtatatccagtcccaggaagtgctagtttccttgtcctgcccccttttgaggagtgagacaggcatttccaaggtagttaacctgtcgatatgcctaattccatcagttctcaccacaccctattccagagcttggtgagaaaggctgccctgcactccccacagacctgaaagagtggctctaaatcattccagttcaaaaagcctaagaggttcaattctatcctgaaacaaccagggcatctccaggaaaggaacctgtgtgcagtgccttgaatggagattccgagtgcccacactactagaacttggggtaaacaaaggttcagatttggcagaagttcctcgttattctgtattaattcctcctaccacccctccagctacacacccccaactctgtgtgctccatgtgaattattgctttgcttctgcatgatttgatttcatctgaggctgcttaatgcttcggctgtctccactgtgtttatcttattgtttcccagaacaatcaaatgcttcctccgcccctggcagcttcgtcttgttccctcagcctcctgacctgcccaagcctaaagctggagcagtgtttaaaggtggggttggactaaggcctgagccccgtgttcctgaatcacccagtgtaattcacctctcataagctcttgtcctggcccttggagttcaaaattctccaagagtagaacccagaggtctggattctttttgcttctagctctttgtgtcattctctcatgagtagcaaagggagaggccccagagatggggtgcttggtgcctttgtgagtgtagtttgtcattaactgtaggaaggcatggagcaggggccactcctcttagttctacgagcagcatagaccagtgatggcttggccatcctcatccacccttgtctgatgagggagcagagacgccacaatttagaaacagaaaactggtctccggagatcctcaccagccaatctccccaccctaacccttgaacgctgaccttactcatagtaaatgctcaataaatagtcactacagctactatccttactagccaggctattaattctcatactgtcccaagatgcaaaagtccagagaacaagtgagtcctctggggactcctccctacattccaggagaaagatctccatggcctggccccctgaaatccaggactctctagccccatgcaccccgctgttagctccacccacccctagttgaatatctagggcagactcttaacatggacagaaatagaaataattgtacatggaaatgtcaatctccagtgttaaccgaagattgaccaacaactcattggggaccagtgctggaagcagtgtgtgtgtgcatgtgcgtgtgtgtgtaagggtgggagcagcagaaattctcaaatcttagaacatcttaacaacctccttccccttcatggaaaagagagacccttatccctgtttcccttcttcctctcctctgctagctcagtgcaaaccacgggccaagttttccaggctcctgcgtccccgtccaattagccaagcatttagggccaggctcctagctgtcctccagggagcctcagcctgctgagttttgactctgcaagcttagttaatgttttcacagctcagagggcggggccagcaataggcaccctggactgccaccgctgctgttgctgctgttgaatgcgtatgtgagagagtgtgtgtgtatgtgtatgtgagtgtgtgaatgtatgtacaggatagagggaggaagagtctcagagacagaatttaccaaagacttaaatctataaataattcgggtcatgaagctctacaaaaataatcttcagcttgaatcttctctcgcagcaccaaatgctcaactccagatacactctcattaactcactcccagggtcagcctcagcagcaccaggccctctccacctttcacctccttaaaggtctgaacacacacacacacacaatatacacacaccacacttatacacacaccacacttatacacacatactgcatacacacaccacatacagtgcctatacaccatactcatacaacagacttacacacaccatacatacatacaccacatacaacacataccatactcatacacactcacaacacatatacaccacattcatacacacaacagactcatacacacataccacatatacacacaccacatccatgtacatacaacacatacacaccacactcatgcacacaacagatttacacacaccacacacatacatatcacacatccaacacacatcatatacatacaacagactcatacacacacaacacatacacatcatacacatacacacaacagactcatacacacaccacatatgtacacacaccacacatgccacacacatacacattcacatgccacatatatgttaatagaccacaaaagcatagggtccttaggtgaacagaggtagaagcgagtgataaaggcctcttctgaagtgaatttgaggacgccagatgctgagacctgctgagagtgatgttgagcgctcaataactctgtgtcaaaagtctcatcctctccaaatgcttaggtctgagagaccaagtttctaagaaatctgagctcaggcataacaagaacagctttatatttatattacactgtacgttttccaaagaacccacatttccactcctgcattttggcttaggcctcacctcctccaggaagtaccccctcagggcctccttcaggccaggtgagatgctgctccgccccccgtgctggtctccctgggacccccatgcaaacctcttctcacaaggggtgacccctgtgttcatgaagaccagacaaattgtccatttccccatcaccgggcttcctgaggggatccttatcctttatcacgtatctgcagctcctaacgcaggcctagctcatggtaggcacataataaatcaatattggacagtactgacattcatagctaataactcattttacattcacaatatcttttttgagctaaggaccattatgtcccaccattatgggacagctacagaaactattacataaacaagtgaaatgacttgcctgaagtcacacagccaatgaaagaaaaccttgggattaaatcccagccctgcagacatgatccagtgcttccttctgtgtggtgatgcctttcaaaccaatctctttgctactaagaaacccaagaagaagattcccaattctgctcttccacagctcttgcagaaaacctatatatactattactgctactgctactactactaataataatgtgatattagagtaccaaagggctccataaattagggctaactagagaagaaatcgaagcacaagaaaaggagtttagagggggctgcaggtaagcgagttaattggatatgctgattggaattggatattcaagaaaagaagctgacattaatttctgtccagatatagctgtgatttaaaggaaaggtactaatggggttactatttcattctcatttcaactggaggactggacgctaaatctctgctggattttacctcacacgctcctgccccaaagccagccctgataaactgagttttatcccccaggtaaggcccccaaaaattaggttctgagtttactgttgtccccaggaaataggagattgtcccactttgaacttgggatcctaaagggggaagagtggatgagggggaaatttggacttttagatgacccatctactctgctcagcagcaagggcagctatgtttgcccattattagccccctcttcagagaattcaggctctagctgggaatctcagttacgccactctccagctgtgtgatcttgagagagttgcctaactctcctgtgcctctgagtttttatctataaaatgggatttaaaatagtatttacctcaggaatgcttggaagtgttaaatgagttcatttttgttaagtactgtgacagcacgtagcactgtggtagctattattaaattctttaggtgaacagaacctttcagaatccaagtctatcctactgccttcaggcagggccacatttaaccatgaaaaaaaggggttatcctgggtttaaaaccctcctgagaaggagattacagtctcctatagtcacccattctatagtaaagtctttggttcttactagagctagactaaatgtcctcatgtcagagtttaggctgggcatagtagctcacacctgtaatcctagcacttcgtggggctgaggtgggaggatcactggagctcaagagtttgagaccagcctgggcaacataatgagaccctgtctctaaaaaaaaaattaaaaagtagccagttgtggtggtgcacacctgtagtcccagctacttgggtggctgagtaggaggatcgcttgatcttgggagctcaaggctgcagtgagctgtgattgcgccactgcacttggcctgggtggcacagagtgagaccctgtcttaaaataaataagtagtttaggcacattttgtcttttgctggtctcagtaaagactgtcactctcttctgttccttgtgctatctggctgctgagccttgtccaagcaaaatagccccagtagcttctgcatttccaccgaggtcaagccttcccagaagaagaagatcccaaatagaaaaacacactccagtgactcattccacctgtccctgtcacctccctcctttgccccatctccagtatcctccgctgcctggttggattttgggacctgtgcatcttggtgttgcaccgcatgcaagggctggttcagtttattgctgtcactttgtgggacaccatagaataaactcaattggttggctattaaaatcccactcttgttttgggactccttgacactcccctcaccactggccatcctgtttctggcaaagacagaggacagctttgaaacccaaaatttcctatccaagacagagacatgagaaaaatcacagacttaaactacattagcagccttcttcctagtcacttccaaggcattctccccctcagccatgtgctttcctctggaccccaccagctggggctggtttgaaccccagttccaccatggattggaagttttgaatggaagagtttagacaagattagctccagtaatttttataagtctatgattctcctgtgataggcaccaagcagattgcttcttccagttattcagagaggaacactaaggctcagagaggtaactcacctaaaagtgtgccattaggcagaaatcaagccccagggaagaacagagtcagaatggaaacccaggaggcctgaggcccagacttaaaccctgcactcattggtgtgttgccttaagggagcaaaggggatcaagggaggggaaagacctctgctgcccaggggatctgctgccttctctctgccagcccctgccccacctttttctccttgacctggcctcctggcccctactctccatcttctctgaccccctatacgtatcttgaaaggtgactccatcttggggcagatagcatggatcgggggtgagtggggggagtcacagacttcttggccaataccacatttctctccgggatttagactgaatgaaataggatagcttagttcgggttcagtaccaacaacattttctgttctggtttggttttacctctgacatttgagacttatgtaggtttgattctggcttcaactggcttattaaaagattggggttgcagacagggaaaaagaaaaaccttcagattaggtctctgattcagtaaaatattaatggttgggattggtcctgaccgaatgcagcagacaatgtgatgataagttgtctttggttcaactccagctctaatcttgccacgggtaccatctggtcccagggaccacagaggaagggccctcaccatggcattcattctctcttctgacttggtgtgcaggccttgctgaatccacgcaagtgcccaggctctgggagagggtagaggccaacatgtaggaaaaggcagatgaagaatattaaagtgccattagcatgaaaacagcggactattccagccagcagagggttaactggccttctggggcaggagatcccagaccaggcttgagggaggggcctggctctgcagctcctgggacccagccctgcagctgctgggacgcagccagcaccttgaggaggcttaaatctccctggagaggagtagctgtcacagggaaggtgggagaagcactgggacactttcccttcagaggaggggcacagttcagactcaggcaagaagcagggcctgaaatccccattttatggagacagaaaactgagaccaggccaaccagaagtcatggcaatcacatctgccctctacctcttgcaatagcccaagaacttttgtgactaaaagctatgatatttctgtaagaatcttatggaaatttgggtctgtctatctaagggagaatgctgctttgaatgtcaaggagaaccattttaactgtggggcattttcccacacagagactcttattcttccttctgcttgaatctcatcatcagaattgctccaggttacaggctggtggtctcagccgtgtaacaccattgctgactcttagaatccccttgaccctgtgaaaatgaaacaaatgggcttctaacaacatttctggaaggaggggctttactgatagatgacaaggcaacagccttgaacagcaggaagcccattcactagggagaaagagggcaagagcggagcataggggaaagtcccacaaggggagtgatgaggcacaggaatgggtgagaagagtttatttggttccattgaggttacctccttaagttcaggcccagaagcccccaagtcgcccagcaaagcaggtgaggaggagaacatggtgtccttgcctctagaccctgacctaccattttcatccgtggggtatagcacaagggcctcaggcaagaatctgctgtttctaccaccggggacccccgggccagagcttcccaccccacgatggactcatggtctgtttcccatgtacatcgagtccatcccaacccaacaggtacagaccaagccctggttcaagctcctcaaggatgcagattctcaggacagtagagaaataggaatggaagctcttctcccactcccctagctctgcaatcaatagtgctgttgaccttccccactcggccaataagaactgaaaacacatccatccatccatccatgctagtgtacttgttgtggcatcaggcattgaacttggcacttgggatgaataagtcatggtgccttggcctgaggagctctcagtgtggtgtagggagaaacaggcagagggagaagatgatgaagggcccaagagagaatccaaagggtgtaagggagaagaagccttaatcttaaaatcttccagggaaaatgtcttttgacctcactttgattcagccctaaggagtctaggatatgctgtcagttggtgcacagttcacgctctttcaacaagcatttcacaagcattcccttttatccgttgccggctatgttcccagtcgcatgctagtcctcagagggttataagataaatagaaaagatatccctgccttcaaaatgttgacaggacttacgcacatctgaagcaattagagaacaattcgagtaggtagtcaatacatgttagctagtatatatacaatgaacaaatcaattgattatcctaggacaaaatgtctggcaaaaaaaaaaggcatcaaagtgggagcaattaattagccattagagaggatggggaaggcttcatggaggaggtggggcttgagctagagatgggcagaggacagtgaaaacaggctggggtcatgaatattggtcaggagtcagctactagaaaactagaaaactaacaactagaaaaactggggatggggcacattcagaccaagggctccttgccaccaactttttgtatgaccttagggacctcttttctttgaggtcagcattgaacataagggcctagatagtacttttcaaacccttatagtaacagcatcagcatcagctggggaatttgttagaaatgtacattctcagccctcatgcccactgaatcagaaattctggaggtgggcctcgcagtgcattcaccaagccctccaggtgattctgaggacacactagtgtgagaactgcaggactacctcgctgctcctcgaccctggctactcattaaattcacccggggagcttttaagctgaagaagatgcctgggccccacccacagagattgtgattaatggatgtagccctggcattcatattttttaaagctccccagatgattctaatgtgcagccagggctgagaagcactggactagatgacatctcagtcctttctgacttattttcctaggatgggcttggagaggctaagccaggattcctggctccccacatctcacagggtggatttgtggacagtcagggcatatgtttgggggctgaaagaccctcctgggatccaaaaatctttaatctcttaatgagcagctttttgatgatttatataaattgttcaccattccttcatacttgtctgaggctaagatactgtgaacagatgttgactttcccaccccagccaccatgaaggagtgtgcataagcacacactcacttacacacacatacaatacacagtgctataaatagatgtacatgcacacaaggataactgcatagggatattcaaaatcattcccaagggcgtatatgcacacacaaataaatccactgtcagaaatcccaggcccagaacactcagactgcttgggaaaggattccttttggtggaaattgggctgtttaaaagaagtggcacttcagtctatggagtagtgactgggggttagcaatggtcttctgtaagctacctgctctgggcagaggcaggtagcccacaggggaatactgagggcagatgctgaggacacccttgtttctcatacagattcgggccgacggtcccccccatggtggggtccagtacgagatggtctctgtgctcaaggacggaagccccatcctccgggacatggccttctccattgatcagcgctacctgtacgtcatgtctgagagacaggtaagtgctaacatccatctctgctttccaaactccaagaaactgctgataatctgtcacctttgttcagaaactgttcagtccaagaagagagacctctgggcttgcagcacaggggtcttgagagaggcagagtgcctgtaggcttttgcagggagctagagagaagcagccgggggccagccacttcccggaggcttcactctaggccacagcccctgtctcagtaagtgatgaacagccctgcaagaacaggccagactgcgtggagcagcttggtgtgattaggaggtagatttactgctctcaggcccacagagtctgctgctcaagggagccaaagaggtgtaaataatccaggcctctgggctgggcccactcctgggagaggcagacccaagacagggccccagaaggaaataaaaatcttggcgtgagtcttagactggtgcagagtataagctggtcagctctgggaagctgaaaccaggcctatggagatgggaagccctgagaaatagacttctaccctctgtagggaaacagctgagcaagtcttccaccctctgggatggatggagactgtatttcctgtgaatatgtgtgagtagagagaaggcaaatgcagagagaaccatggtgaagggaaagagaagcagggaaggcaggggattcatgagatcgacagagacccagaaagctaggcaaagaccttagccaagccggacacattccattcactcggtcagtgggttaatagttgttcagcagcagcagcaggggtcttgtcatttttcttaacagggtaagtaaaataaaggccaaagaaatgaggaaaaggattgccagtctgtcccagcagctgaggacactgacttaggctagagaaggatgctggtagagctgaaggtccagagagctttcacaagttgcttcccagctcatgtcattctcagagaattctgcaagagttccaggtgtccttgatcaaacttaccctttccagagctctccttacctcctttcttttctaatttaaaaggagtctgaatcaggggatgagggatgagcgaagaagtaaggaagagataagtgtgcacacgacagcattaagggaagcagtgatgcagttctgagttgaaaattagttcttgaggacagatgacgtaaatcatacgataattgcatgccaattatatccagatcctcttgaacccacctgtctttttcaccttctttcatgtggcctctgccgttgaagtataaacaggtccagatgggaattttgtggatctgtagacagctttgcctaacctagagtgggtaagacagtcttggaaataaacactgacctatcattccgatgaaacagtcagtgggcctaaaaagaactattcctgggcacatatttattgggaacaaagtgctgggaatcatcaaaatgaatgagacttagccactaccttaagttgattgcaatctaacaagagagagacaggtacccaaatagcctaataacatcagattgaattctatacatgctcttttatcctgttcttctttaagggaaaacattatttgtttaataaaaattgtggacgcttgttatacaaattcaagcaatgcatacagaaaagaaaacagcagaaggtcaccaaatctcactacccaaaatataacaccatgttaacatttgatgagcaccattccaggcacttatgcagatatagatacagaaaaaaggacaggtagatagatgacaacctatattggtggataaaacgatgagcagaggttaaatagactcacattttatgcaatgttttcaagaggcactgtgtgtagcagaggaccaggcgggtagctctgggtaagagctctttcttagattctctgagcccagcaaagtgggaaggaagaagtgaccaatgagaccttagtgggaccgagaaggtaccaaggcatatattttagctgcatatctttttatccaatgaaacgctttctgaaaatgcattcaaaatgtatccaaagaagaggggctgggtcagggctggaggcagatgagtgggtttcagagaatataatcacctcctagatccatatctgatgccatctctgagaccatcagcctggccacaccaagtgtccacacagcttatctgtaaatacccctcctctgtcccaccttctgcttcaggtacccagttcttgttacagtctacaccaaacagaggggtttagcagtagccagccacgatgagcagagataggaagaatttgggtttcatgccatgggctgcctctggtcaagtgaaatattagtagggggagctccctgtaccagatggagctgtgattacgaggcaaagtctgagggggatttgtggtggagctctgaggcctgtcacctggagagccgtaaattgtgtagaaataggtagccaggtgacttcaccaggggctcagtccaaagctgaaagccaagaacagctcaggaggcccatctgtctgaggccggctgtgagttaagtactcacagacagctcagatgtctccaaggaagcagttgaatgtgtggcaggagaataatctgtcaaaatgaagtcagatgtcctgggttctagtccagcttgtgttatcactgatagtagaatcctctgacagctttggttcctcttttatagctgagaggagttgcatcagataacaccatatctgaagtccatgggtatgatttggacttcatttcaccattctctatctgaatggccttgcacaagtcacttaacctcagtgtttctcacacaaggtcagtgtgaggctcagctgagacaataaagggggaatttctttttatactgccccacatgccacattctatatggcccattctagctctcatgcctcatgatcccatttctcaggagtatagagatggtgtgtgatgaagagggggcagggggacatgacacacccagtcatcctcagcctgagccaggagatctgtgttctaggcctggccccatctctgacttcaagggtaacctgggccctcaacttctcagagtctcagtttcctcatctgtaaagatggagattataaatctaactctaaagtctctttcagatcttatagaaatttgtttaaggtcctaggattgggactctgctctgtctctctccagaagatgataccaaaagcacaaaagatgggcctgagactaaaccaaaagcagtgttctctttttcaatttttaattttaaaattttttattttgttttgttttgtttttgagacagagtctcactattgccctgtcacccaggctgtggtgcagtggcatgaccttggctcactgcaacctccgcctcctgggttaaagcgattcttctgcctcagcctcctgagttgctgggattacaggtacatgccaccacacacagctaatttttgtatttttagtagagccggggttttgccatgttggccaggttgctctcaaactcctgacctcaagtgatccacctgccttggcctcccaaagtgctgggattacaggcatgaaccaccatgccagagcaatttaaaattttttttatggaaatagagatggggtttcaccatgttgcccaggctggtctcgaactcttgggctcaagggatccgtccacctcggcctcccaaagtcctgggattacaagcgtgcgccactgcgcccggtcagcataatgttcttaaggagagatttatgaggccacatgtgctcatatgagcatcttcgctgaagggtcaacattgtagagaaagctggaatgctggtttggttatggatatgtacacatgctctcgacttatgatggggttgcctcctactcaagccattgtaggttggaaatattgtaagtcaaatacatgtttaatacacctaacctcccaagctcatagcttagcctcacctaccttaaacatgctcagaacacttatcttcacctacagttgggcaaaatcatctaacacgaagccaactttataattaagtgttgaatatctcatgtaatgaattgaagagtgtactgaaggtgaaggagagagtggctgcatggatacttgaagtacaatttctactgaatgtgtattgctttcacaccactgtaaagtaaaaaaaccataagttgaatcatcgtaagttgtctattttcctactttgagacagcaatttaagactttcaagttctctaaaagtcctgagaccttttaagatatcatgggaatgggtttttcatcatttcgctctaaaacaaatctctgggcaacctactctcatccctgtcttccaccctgccccaacccttgcctctctgttcccccacccatcctccaaacatgacacatgtaatattcttggggccgtgagagtggaacacatagtgagagtaaaaccaagtctctggtcttacattctgcctagagaggttttcatctccccacagagctagaacaatccaatatagcactcatgtattctctttcactctcaattaattaattaaatgtaattaagaaataggactagtaagtgttgggtcgttagtgtcactgcctaacaagtcaatggtaatgtactgttaatagatctaagaccggccagtcccaggggaaaatttgggaactgattccccaatcctattaattgcccaggtgctccactgagaggatgcctggctctttcctagaaagtctgccccagcttcactgacagcgaatcagcagatgttatgggcatgcatacaagttgctcccatatcctcagtgtgtaatggaagtcagacagcgagtcaagggaaaatcaggctatgagccaagtgaaaaaccaagcaacaagatgaaaagaaacttgatagccccagttttcacccaacttgtcaggctggccactcctagaaaaggagtataaatctatacacagggtggatgggaaaagagtatagggatggaagcaattattctattttatactttaattagtttgcattagcagagggaatagaggcatgaaatgatccagcgaagggtgaaatggaaaaagggagtcacagtggagaatggctccgtacagactggaaagggccttgggaacagcagaaaggatggtgatgggtgtgtgtgtttggagtgggtgctggggcatgggattctgttctctacttcaaggcctggagaggcaaaatagcatagatgttaagagctggcccgtgggagtcaggccaacctccattccatagacacttactaagtatatggttttgataatgttattcaacttctctaaacctcagtttgatcatctgtgtaatgggcctaatgcaattgttgtgaggattgagagaatgcatataaatcacccagcatcatgtctgacacatagtgttttcaaaaggtggtggtaattattattactagtagtagtcttagaacttctttggaacttcagaaagggctagaaacatctccaccacaaattatggctggcacagagttcccagtttcaggcagtggcctccaactgccattcctcctgcttactcccaagcgctgcctcagaagcctctggcctggccaaatgacagcactgagctgagtctcccataatctggtatttattttaaaaatccaggaatgtgcctggcagactaaacagtcccgctcccctcaatatacaggcaggcagccccaggccgatgtgtgaggccagaaggccaggatagcaggcatctgtggagagaagggaggaggaacctgtgagcctggggctgcatgcatggacaccgggccagaaagggaatacctatggggcttttcatttctggtttctccacgtaagtaacaaagtctcacgctcattgtgaaagatgggtctgccactctccaggtagtgaacattcagaccccagttccgaatgtcctagatgtactagtagttggcacactgttctggttatttactgctttgtaacaaaccacccccaggtttggggatatttttaaaaacacattttattatgctcaaagactgtgtaagtcaggaattcagatacggtgcactgaagacggctcatctctattctataatgtctgcagcctctgctaggatgacacaaatggctgggactgactagaaggacaaggggctagaatcatttggaagcttctccccctacatgtctgggaagtggaagctgggatcagttgggactgttgaccacagtgccttagacaagtccctgccatgtgtgttgggcttcctgacagcaggcggcccccaagacagtcagaattcttgcttgtggcagctgaggactccaagagtgagtactccctataatgaggtagaaattgcatcgcctttttgtgacttggctttggcagtcacgcagtcggtctgcttgcctcttccctctgctgcccaacacccatgtgattctgatgcgtgtggtccatgaacacacattaagaacatgattccccagctaccaaggtcatggaatcacagagcatcagagctggtaaggactgtagagagcacccattctgaccccagataagaaagacgaggcccagagagcaccctgtttagctgccccatcagcattgtgcaacacccaacgcccagctggagtcatcaaagctggactgatttcttcaaacatgtggggaagtactgacaactttaaagcttgctgttgatttgctgaaggttgtgtaagtcctacctgaggtctatcaaatgcctgtgggccctgaaaatgctttcaggaagggtttgcaggaatccatcagtagcaggatcacactgcctggaaattttcccatggagggtatgctgcttataaatagctctccaggcagtcttcctgtggcaatattgtctcatcttgcacaggagcaggcctctcagtgacttaccttcagtatgtgggggagtgggacctcatccccatggattacaggaaactggctttttaaccacatctgtttaacgtaatttaaaagagttggggcaaggagactgtcagcttggagtttcagaaacaaaaattatttggaaagattgtaaagccaccctttcctgaaggtcttaaatgcaggagagaccccccaccaccccctaagaaattctctgcattgtttgaagaccctacgcagtatctggggagagatggaaggacaggccagacccttagcataccatccaccaatgtccagcagctgcaccagaaaactaattgtggtttcctccatttggaggaggccctgtcaactactaacccggatctagaaccaaaaataagaatccttttcagaggtgctattgtgatacatggggcagtaagtcttctacctgtagccaaagctactgaactgttaagtccctaaggcacctaaagaccttggggaagggaaagaaaaaacgtggggagtcacacttccagatgtcccctgctcatttattttgacatctcagactattattttgattgtgcacatttgtttagtccaggcgataaggcttcccagggtgcaggcagagcatgccaaggtgtatttttacaaggcgggcaaggactcagtaacaggagacctcccttctgcctgggctgggaggccttggctgagcctctggggaggagggaatgtgagggggcagggaggagagttgagcctgagggactttggggagaattacagagtttgcggattaggaaagtgaggataagcgaattgctgctgcacttttgttttaaaatgtgtcactttcaatccaaggctttgatgcacatgtgtttctggttaaggatgcaggaccccagtgtggcccaggagctgagcactcacatcagtgcctttcccaaagaaagggcggagtcctgcctcccacctcccggggctgtgggtgcaggcaacaatgaccacctcaaacccgggttttgattttttcctctttctttcccccatttcaaatgtcaaggaacaaagaggctgatagggagctgattctctggctattaatattctcatcggagtattttttttaaataaatattttcacatgagggaaaggcaatgcaaacccaccctattaatcagacacttggcttgctgtatttaagagagaaaactccagcctcttattttgaaatcctttggtttggaaagaaatgattgaatacaatgcccaggctgggagaagtggtgccaaaaacctcatttctctaaatgggcaagggggttggagactctctaatccttgatgagggatttgatttttctttctagataggtattgctgaaggatgacactgactgcccagaatcatgttcctatgaccaggagatgggaagttacagtgtctcaccagaaggaaacttaccctccttcattcttttaaatatggggaaactgatgcctccagagaggaaagtcatttgcctaggccatcatctgaattaccagaagaatcagggtaaatcctgagtaacctggtctagcccagcatcctttcccaacttgacaacagtttcactcagcacagacaagagtgaacactgtgtttaaaaacttttaattagcaacattaaaacaacctaggcccaagagagttcctgaagatgttccgaagggtcaaattaaaatagggaaagatttgcatattgtttgcatatgcagactcattcattcaatagaccattaagtgttgaccatgtataatgcatagagctgtccactgacaagtcatttgcatatgtagatatagatagggctgtctttctaagtaatattccagcaaaagtctccttctaaatagggctgccaggaagataagtaccttcttgatttctttttgctgttttcaatgcaacaatagcactattacgtatgcttttgtatagcaaaaaataaaatagaatccctgccctcaaggtggtcaaattctggagaagcgcaatgatgtatagataaatcacaagataaggttatttatttgtacatcagagcaatgctgtagaagagatgtactatgtattcaatgattaaagtaactcataaacgcataccaccaggaagggacctgtcctggttccctccctaattggggtcactcgggggactcaccctctccctaacacaagaatccagagctggtttatccagagattctctagtgaagagcagccctttattttacagaagaggagatgagaggtctgagggggcagtgactccggagaagaaagggtataccaagccgaatgtggagaagcagacaatgattgactatcagtagtttcctgacagccatggggagcagccagcctgggttcaagccctggctctactgcttactgccatgtgaccttgggcaagttgcttcacctttctgtgcttcagttacctcacctgtaaaatgggcataattatggcatctgtttgaagattaaattaattaatgcataaaaagcactctgaaaagtaccaggaacctactacccgcttagtaaatggtagtagtagtaattatatttttacagttgtgcccccatacatcatcatcaggccaagccctgcaggtcatgctttgcaaacagccacacctaaaaaaagcttaaccaccctgccttgcctctcagccctaccttatttaagctgtgttgaaatctaactaatatttttgccgtgtttttcttattttagtttacaaacatggcctcagctaatacaccagtcctatgagataagtattattgtccttgcctttttttaacagataacaaaactgaaattcaaactgactaagtaatttgcccagggccaccaagctgtccaacagcagggctgggactccaccccacacctctgaagccaaatccacacctcttcagcttcctgagacagcgccccctggctgccctgtggctgcagaaggctcctcccctcctgctctccccacacccggctcccagttaggaaaagggttcagaggcggctttctgggctccaggaggccagcacagactcagtaactcctcatttgacaccttcaaggagattggagtagtgcactgtttagtttaaaaaaccaataaaggaaagcaagcactgccccgggccctacatggacagtcaggggaaatgcctctgcaggtggtcagaatgcagggagaaaaagcacctcgccccaggaagttaccgcggagtttctcctgcgcagccagccaagcgcctcacgagcatgatctcccctcttcacaagaacctgggaagacaggtattatctcccccgtttgacaaatgaggaaggccaggtgcagcaatgttgagggatctgagctaggtgtgtctatgacttttaggaggcatagccgggagtgaggagcctgtctgtgtggctgcaaagctcctggactgctcgccctcccctagcaccaggagagcccatgcagagaccccagcgggagacatcatgactcctctgcatattttcttacccccatccaaagctcgtcggtctggcaaaggaaaaaccttttcaaggagggcagctgcagaacacatgtgaggcattgaagccccgattcagcttctctggtgctgtttcaagtgtgaaccatgcaaacccatatcagctcaatccctggccctaagtaagaggttctcagactcaagaaagcctcctgtgttccccatcttaagtcttatccagccagacacagggggccccggaatgacaccccagagctctgcagcctgcttttcagctccttccaggagcgctcccttgtgttccctgcgttgagtttcagtaattgaatgtgttttatttagaccataacatttagtgccactttggatttccaattaggcttcaatcagatgccgagagtctgattcgttttgttgttttgatcaacacgaaagatggcaacatcagaggagccgtcatgaaaagttactgccatccactgatgactaggacggtttctgtagtgtgaagatgcaggttcagaggtgtcgagagcggcaccatgcatcaggaagaggggcagaggcaaaggggaagtcagtgaacccctggagacaagcgcaattggaagtcctggggtgcgtggccgggacttggcaaggtccctctgtatgtgggccagggctctgggtgcccctgagggaggggaaaggtgttggtctccaccccagcagatttctcatacaaatggttcaggcttgaacagctcctctcaggccttttatccagggacatctttgtgaacacagggttcccatgaagtgggaagctgaccaccactttttgatttctttagtgaaggcctctgaactcctcagccagaagtgaccagctgtactcatttacagaaatatgtggggggctttttctcaccacctgtgagttctggccagccactggcacatgctgtctgtcagataaggtttctcaatggggttgatcctagggacaaaatttggaatccaactttgaactgccagggagtttgttgcgggagggaggtggcaggatggcagaggggtgatgggagagtggccggggaggagtaggtaagagtctgcctgtgccaatcatcaagagtcactcaccacacatctgagtcaaggtcaactggagcctcattttccccattgataaaatgtgtttgaatgccccttgcggcaatgacattgggtgcattccttctagccatgaatgtgtatggaatggaggctgtgtgcacagcgctcggaggctgacctgggttcgagtatgcatgtgcttgtgagaacagaagttggtggggttggtgagtgagatgagagcaaacgttcctgtgtgttctgggggtgttagtgtctacactatgttagtgttagtgtcttcactatgttagtgttaggctctttcatatgccattgcatgtacccactgggggaaatgtgtgttcaagcccttctcctcccagctttacactgtttttagagcccagcttggctgcatttccagctggccctttgatctttctgtagcaggccagctcagggactcagcttttcagccgcaatctccacttcatagagtgcatgccttgtggttaagttccctgagcctttgccactgtgcctcaagttacctccctcacctcaccttgttccccccagttatgactggtccccaccttgcaaacaggttggggtttgaaactcccaccaggtgatgagaaggctgactgtgtcatcagctgttggtgacttagcaaacagtctgggttcagcctctgtccctcaactaatatttaattataagaaagaggtgggcagagatgcaagccaggtagaaggaagacaggagagggaagaatgaactgagatgaaaaaaatgttctagccacttagccattaaatagctcatcaaacagcctttgaggaccaactgtgctcacagcaaagagcttatccttgcactatcacacatacatatggaaaatagacaagtaagtagtgagttacaatacagtatgcagagtgctgggattacaggagagggcaccacccaatatagcctgtgagtcaaggaaggcttcctggaggaggtgatgctctaggtgaatcgtgagaggggaggggctcacccagtggaataaaaaagcaaagaaatattgttcaagttaaggaaagcttgggagtgtgagagagtttggtatattcaaggactatttcccaaaacttgatactggcagagctgaaggcaaggattaggaggcatccatcctcacagaatttctgcagcatgcaggtgagcagccttcaggggggctcaatccacccacctttcctaagagggattcccccagccccagctgctacaacatagaacttggtaggaagccatcatgcacccagcccctggtgctctctgtggcaagctcaccagcaggtcctctggacataccctgtatctaagtaacatcatcaggaaaaaagatgctagctctggcagagctccagtgctgaagcccgttgtaaccttgccaatcccctcccctcaggacagccatttctctgactgtacagcaaggaagatctctgcccatcccaggttcatggaaagaggataaaggaaatgagatagtgcacccatttcaggcattcattgtatcatttctgcagcatttattacaggcagagaccttgcctgtctgggctgcttctgtctccccaagagataccacagcatttggtacttagtaggtactcaagaaacactagggctgggcgcagtggctcacgcctgtaatcccagcactttgcgaggctgaggcgggtggatcacgaggtcaggagaccatcctggctaacacggtgaaaccccgtctctactaaaaatacaaaaaattagccaggcatggtggcggtcacctgtagtcccagctactcgggaggctgaggcaggagaatggtgtgaaccctggagatggagcttgcagggagccgagatcgctccactgcactccagcctgggggacagagagagactccatcccaaaaaaaaaaaaaaaaaaaaaaaagaaagaaacaggaaacacttgttggagcttaggaagaaagagaggagggggaaaaaggaaacaaaggaaaatatctatgaaaaggaggcattctagtttactgtaaggcctcatcttgggaggcaattagaattgtattcaaatcttggctctatcactctttgatatggcctagcgtatcctctctaagccttggtcttgtcttctgtaaagtggggataacaataatacctacctgataggactgctgagaaggtgaaatccctatacaatgcctgggacagtgtgagagccaaaccctcagccatggctctagctaagccctgtgttttctccctgcctccaaggtaatctccctctttcactaccatggagtcccccacaactaacacgttgcccatttttcatccttaagtcatctgccagttgcatctatttctagcctctgtcttatgagacaagaataaggaaggaaaacagataactgtggaggctcatttgccagttgtcagctcctgccgtcagctgggctctcttgtctgcttctccctgggtgcctggaaaaatcattgtgaccttttatttactggttgatctagtcagttcttggctccggatctctctgcccgcccctcaggctccccgcagctctcccagccctccatcagccagtgtgggttccctgactcccaggcagaatcatgctgcaagatgggcaggctgtgctgggccctcggagcctgcctgtcttcatgatcagattcctaaaaacctgtgggcacagagaggaggggcagtcagagctattgatcttccctactcgctgctcccgccaggggggatttctactgcagattctctcctgcaggcctcttcttctcaccccgttttactgagcagctaaactgagcttgaggctagcgagtggctgccccggagttactccgtaagtcagcagcatactctctctcttggcccctcatccaactttttgagctttaccaggttgttttcatccttttcccttcatcctcttctactccctacatcagctcccagcccggctggctggccatggccagcagctatttctgcttttccttctctttctccctgggaccagccatgcatttctctgcagctcctctgagccaattggactgaggtgtgcacctcgggaagtggagggtggctgttgggaatagggacaattgtagtggtgacaaggagacaggaggctaacaagtgtgtgctgacaagaagacatgccacattggtccctggaaggccaggaatgagccaggcagacccaaactatgtcttgattggctgcaggagttaatggtgtatacagcataaatgtgaccttttatttactggttgtgagtaaataaaaggagtatgtgtatgtatgtgtgtgtacatgcacacatatgtgtatcatacccaaatcagcttctgcaaaaacaatcatccaaggtagagtatggctttctcactccattttcttcaggccatctccttggacttcccaaagttttcattgcccatgttggaattggcaagccttatgcctccctcaaatttggagaaaggagttttaaaagcctcttgtgcaagtcagctccctgcttcccaagctctcttcttggcccttgctgtcagcatcaattttctgcagggagtgatttaaccttcgtttattcattaattcctttttcctcttaacttcattaggtaagttttataaaggtgctgaattggaaaggtcacctgtccctgggcccaggacacagtgtgcctgcctctcttcttgtgtgcttcctttcaggagtgcttctgaggtagggaggtgaggagagtagcagaagagagagtgagagcagggcctgtgctctgggaaggcagggcaggcaggaagataccataggctctgaacacgcttccaaattgcctgcttactgttgggaggcaggatggcatggtggggaggataggctctgtgttaggcacatctggagtcctggcactacccttcctaagcatcagccttccccaagttacctgtcctcattaagccttcggtttcctcttagaaaaactgtcaataatgctagaatccactccatcaggttcttgcaaggattaaatgagatgcttcatgagcatagtgcctagaacacagcaaacattcaacaaacaaattgaacatctttttaaaaagatcttcagttttccaatacaagccttggtagcactgggcagtcattggatcatggaccactagagactagtgtgcagaaagtctatttgattcccccaggcaagctaagcccacatagtctgtgactgaccctatctccagaaccacaggaaaagcctgtggtttcctcatgggggagccagaaagaaccaaaccaccccatggggtcaaggttgcttcccagggtctaacagatttctgcagagagttagggtaagctagcctcctgctcactgctgtcaccctctgagacccacccaccaatcgttcatggtcgtgggccttttttcaagtccctgaggcctgctgggctcagctgctaaccatctcatcttaaggagctgtctctctcattgccagcctccctggaaggaggggatgcagtacagactaaagagcatgcaggtgttttgaacttgcacaaaggtcagaatatctgcctgctgccatctccatgttgtctttcctcctgtgaccgcaacagagctcaaaaccatctcaatccaccccaatcacagtgaattcagtcctctgaatttctctaactcttatggtaaaactgcctgtccggatctatccatgtggtgtcttcccccatcaggctttaagctacttggggagcggatgcaggttggaagcagcctatcccctcccagggccatttgtgcagccagaactcaatcaggtgtttgagaaaataattttaatagaaaagtacagaggaaagcgggcaggcaaacctgttctgtgtgccaagctgagaatattcggtttgaatatgatcacagaggattacaagaattaattttattttatctaatatgcttcgaattgggcttctggaattcaacatgcaaatgtatgctcctagtgcaaattggagcatgcccagattaatggagaaaattctcatcaccttgcttttctcagaatgcgatttctctcacctgggatcacttatttgtttgccaaggatgaaccaaggggtaaattctgatggaggaaggaatctgagggctgggtaaatctaaccagtgccttccccatggcagatggaatgaagagagatgctgagcagtggatgacagcccttcaaagagcatggggacttcagggcagtagccatgggaagtccaaactgctcctctggtcccagaccagccttcactggtatacagatcacttcaaacgcattgtgttagttcctgttatcctcacctcccggatttaatgagattcttgggcatcgttaataaacaatgcctgacctttttagagtggcaacattatattatttcatgaaatatggccctacacaaaaggccatttggtatagttattgttacattttgaagtgaatttgggtctaataatgaatttggttctgagactttcacagtatccattgagaaaaccggagatactagtcactgaatagcctaaatagaaagtgaccagtgtttatacccgaatgtcatggctataccccattctctgagcttctgccctcgttctctagctgtggcctataccattactgccgtgcctggccactaaggacgctgtgacaccagcttggcctagctgtggacaatttcctctccctataattcaagctaaatcaatatttgaatgtataggaaagaaagaaggcctcacatgtataggaaatttattttctcaaccctctttagttgggcttgcctaaaacatagggtatctctggttcttttttttttttttttttttttttgagacggagttttgctgttgtcgcccaggctggagtgcaatcacatgatcttggctcactgcaacctctgcctaccgggttcaagggattctcctgcctcagcctcccaagtagctgggattacaggcgcccgccaccacgcccagctaatttttgtatttttagtagagatagggtttcgccatgttggccaggctggccttgaactcctgacctcaggtgatctgcccgcttcggcttcccaaagtgctgggattacagacgtgagccaccgtgcctggcctggttctactttttaaaacaacttttatttaaggttcgggggtacatatgcaggtttgttatttaggtaaactcgggtcatgggaatttgttgtacagattatttcatcacccaggtactaagcctagtacccaatagttgttttttctgctcctctcccccttccctccctccaccctcaagtaggccccagtgtctgttgttcccttctttgtgttcatgagttcccttcatttagctcccacttgtaagtgagaacgtgtgatacttggttttctattctgacaaccactggattggttctactttttatgaagttcagtttctttaccagtggccctagactaacatctagtggccacggggcaatgttggtagacgtcagtgcagagtgaagctgcacacacaacataggctttaaatagtttctctctctggggtcaactagatggaatagatacctggtcattcccgtaactctccaagtagcttcccttagggacacatctcacttcagttatagaagaaaggtggtttatgttttctaagtccaatgactagccgcgtccttttcaatccagattagaagctcctccaacctcagaaactgcgtttggcccaagggtactgctttctgctttcccgcatcctaaggctacagtcttaacatataaaattactttaaacataaacaatgacagataaccattagaggagagtcattcttttacattgtaaaaattgaactgggaattgtcactttggagaggtaagagagagacatatggacagactaccaggagacccttatttgtctcttaacattaaatctaaatcataaaaaccaagagacaagagacccttacacttggagcctatttcattttctttttttcatgagaggtgtgtggagggtgcaaaaggcccacactcgaaaacatcatttcactgtgcttcggtttccctgatggtaaaaatgaaagaatccagctgcctgatatcttaagtgtgtatattaatgactaaactggatcagtgggatttcttggggtgaacagtgggacagtttccatcatgacacttgcttatgtgggaggatattaagctcctttctttcaccttcttgcctctgaattaggaaatttaggaagttactaacataggctacaatatggatgaaccttgaaaacatcatgctagaagctagtcacaaaggatcacgtactgtatgattccatctctatgaaatgcccagaataggtgaatccctacagacagaaagtcgattggtgttgcctagggctggggcaggcaggagggaatgggagtgactactaatgggtatggggtttcttttggggggatgatgaaagtattctgaaatggattgtgctaatggttgtacagttcctgaatatacaaaacaccattgaattgcgcaatctagtttggtgaattttttggtgtgtgaattatctcattaaagctcttatattaaaaatcttgggaagatcatgtcctaattgtctggctattccagcacctctccttcccctggcaaccaccacccaaagaggaagtggatgctgcaccatggatgacatcaatgtgtacatctaagggttctgccatccttattctctgttcctcttcccttcttcctgctttcttccccctgccttgttctcctattatttcctattccttctatctcccttctccttttttccttattttcctactgatctcaccatccaatgggtgcatctcacgggctttccttaaccctaggaagctgaaaggggcatggaagagggaacaagagagagtgaaatttaacaatcaccataataataaagcgttaatattattaaaaattattattatagctgtccagaacttaatttaatcttcacaacattcctattagggagataatcatccacattttatagattaagacgtttttatggataaagatgaagaaataacactaacatgctcaagaaaacccagcaaatcagaggcaaaaacagaattcaaaccagggtctgtctggcctcagagcctattctccaaagcatgatagaaccttaaatatgaggctgggcctggttatttattgatgaattataatagaagtaatttgatggggttccaaactgcagtatctaggatctcatctgttggtctgatatttatagccgtttatgggtgatatctgtgtggctcttccattcattatggttttcattaagactctaatcctgtttagaagtctgtttgtcatttttaactctcctgtttaatcttgggcagccctaatcttttttcactaccagccagagagagacagctcctgatggctcttttcttctcacagttgtgtgcaggtgggggtatgaggggagatgagtgtggtgggcctgcctgtccatgactgtgtgggacatgaatgtgtgtatggagtatccgtgtgagctgtgatgtgagcatgtgtgaagttcgtgcatggtgtcactgtattggtgtgcactgtgagtgtgtggtatggatgtgtgtttgtgttcatgagtgtgtgtacacgagtatgggtatgggtttgtggagtaatggagtacatatgtgtgtgtgtcaggggctaccattcatgatatttgtattagtctgttctcatgctgctataaagaaatgctcgagactgggtaatttataaagaaaggaggtttaattgactcacagttctgcatgactggggaggcctcaggaaacttacaatcatggtggaaggcacctcttcacagggcagcaggagagagaatgagtgccagtagggggaatgccagatgcttataaagccatcagttctcatgagaactcactcattatcacgagaacagcatgagggaaaccacccccatgattcaattacctccacctggtcctgcctttgattacaattcaaggtgagatatgggtggggacacagagccaaaccatatcagtattcttttttcataagcacgagaattcttgagtggaaacctaaccatctgcttctaaaacacagagaccatttcgcctcacatctgaccttccctggtgtataaatcctcctggggtgagagggttttagggaatcctgaaagggatagcgattgaccaggccccctctcctaaggcagtctcggagcccagctctcgctcatggtggaccttacttaggtttccccggggatggaaatctccttcccagcagcattggtttacagagaaattcttccattgggctcttcatccttgagggaggattagatttgttttactttttcggttattaagcgtctactgctaaggaatgagtaacaaaggaaatctacatgggtgacatcccatattgtgtccttcgctggccccagtgcacacccatagctcattctctctgctttggtttatggcgttttcatgcccaggccacttttcaccctgccccttttcaaatcttgcctcctccttggagccttgcctgctctcagacccaaaggtgattcccatctctctgcaccctctgacctcccctcacagacattataagagggcccacaatatttagtacttaaaaacattctgtctctgagtccaccaggccagaactctgggagacccaccagctatatttcaactccctacttccctagggacttcaaggctgaaatgatggttcaggaaatgcactacataaaggcatctggctgaggggcaagtaggggctgaaacaaaagtcctcattcatcttaccaaggcatgtgcctagatggggcacctctttcaaattgcaccaaagtaccgcattggcaagtggtagtcctgaaagggagtctcagagagttcaatcttcttgtctcagggcctgtagtagcagccagaggaatgcttaatgaagaacccgaaaagtgctgcctgcccctccccatgcgtcaaagatgaagtctggcctcacagtctgtcttcagaaagcttcaccccctctctgattaatcccaccccactctaatcaccacttaactccacatgcccttgtctggctccagcttaattttcacatctcagtatctgccttttaagagtcctgaatctttttttcacatctttgttatgctcttccaactagttagcaagctgtaggagggcagagagcatgttttcatttcctttggttttggccacctttgtgacatccatcagaaaactctgcacccagccggggctaaatcagtattgttgacacactgagtcaccagccaaaggtgcagagacaccaaagccctgtgcttagagctaggagctgggccagtgacccctgtccccaaaagccagctcagccaggcgcctcaggggacacaaatccatccactcacctccctccggttctggacctcattacccaaagaaatgtccctaaggattagaaagttccggagaaggccaggtgcggtggctcatgcctgtaatcccagcactttgggaggctaggcaggtggatcacttgagatcaggagttcgaaaccagcctggccaacatggtgaaaccccatctctactaaaaatacaaaaattaaattagccaggcatggtggcacacacttgtattcccagctacttgggaggctgaggcaggagaatcgcttgaacccaggaggcggaggctgcagtgagctgagactgtgccactgcactctagcctgggtgacagagcaagacactgtctcaataaaataaaataagaaagaaaaaaaggaagttccagagaaactcagccaatctcttggtctctttctgtgatgacataaagtgctggacaggaagaggaagaagtggccctagcccttcaccagactcacctttccgtatcacttagtgaaggattgatttgatttcttgtgttcaagggctttgcagggactagagcttcacccctccctgaaggtgtgtttgctttggatcagggacaggcctgtttgcggacagagcatccggacacctttcgctgggtctgtgatatggtggctttgttgctctcctagacaacaatatatatggcatgcctggccagtggcatcagggaacatatctcctgccacttcttcctggagacctccaaccccaagcccctggctgacctcctccactttcacctttcagcctcgtactcctgtgccacctcagcacactctcctgctctaaaaaaaaagaagcattcaggcagtcactaaatagcagtattgatgccccatccccacatgccctggaatgataatgcatcacccgtggtgtgtatccagacgaagccagattacgctcaggtggttaaaagtccaggtctaattagagttccagggaatcaagccattgtattattaatgattctccggcaatgttctgattaaaacagtaattttaataagcacagctcgatgctaagtgttcagtgagcacctaattacatcagttatgactccaaaattatttaaaattccgctttttttccaccggacccggcatgcaccaaataaaatagagactcagacaacttggtgattatttgctctaattaatatcctaagcacctcttttaaaaaaaaaagaaaaaaaatgtatctttgtctctcttctatctcccccaggttcccctctctgtgacccccagaagctcgatgacattggttacatttgaggcagccattcagggaggtcaggaatagaaagctgtgaggaaggtagatttgaacagtccccacactaacctccaggtgaggggaggctgcaaagtgctaatccccgttgattgcccaggcaggacaagaccccggggtgggggaggcagaagcacccagagagggctactaacctggagccagttcctgactgcagccttatcttcagcagaccagcttcagttgtcacatttaaccatcacgcttgcatctcctggaagagggtggccagtgggtcaaggggcttccctgtgtggctgttctcaaattcttctggccactttcgttgcaaaagagactgcctgacctattcactccctggaaggacaccaggatttcaggaaaaatggtctgctgaaccatctgaggattggtgtccacagttttctttttttaaacaattttatcagtaagttatccatctgtatgcaataagcctgatagtgaacaatgcggtgctgaagctctcacttcttgtgaacctcatgacaatatgctagtgaggaacagcagtccttaacatcatcgtgcccaacccacgtgctgggagataccatcacaaggcagctttctgctgtctcctactgtctcttcaagatgtttatcatgagtaaagttttgcctggatctcaggcaggtggcatagcttctctgcacacttgtagataatgaaaggcctttcgtcactccagtctcaaacacagcctcaaattggaatgataatgtccagttccagaccagacttaacctatggactgatgtgcagatttttttcctccccttgcctgagcctgctgcatggtctccagttacttctgtctctctctttctcatttgctttcccccaaatggatccactttgtagaaaggagaggggtcagaggagttctttctcacatgaactggaattggcagcagatagcctctgttctcaggcctggtggatatttctgactcttacagggctgggttcttcctgggcctcgaaactcccctgctgaaccattccatggctgcagctgtcatcaagagggtggtgcttcctcttgactggacactgtcctcttggccgtgattttccagttctctccatacagatgtccgcagtggggtcacagcaccacctccagggggtcttttggacaggttgtaaaatgcttcaggccagccctccctcctaaggtgtccacatctgctgcaagggaagtacttgcccatctttttagcctgccaccattgtgcagctggggtgggagcggtgacctcccaagttcctgcttcgctctgcctcctgcgggctcgccagcctaccctctgggtttcctcctgcatcctcctatccacttccaggtggtcctgttgaagggtggttaggtttcagccttccaagccctccctccaataattcacacagtctcttctttttcattccttcaactcttttttttatgtgagacagagtcttgctctgtcatccaggctggagtgcagtggtgtgatcccggctcactgcaacctccacctcccaggttcaagctattctcctgcctcagcctcctgagtagctgggaccacaggcatgcaccaccacacccggctaatttttgtatttttgtagacacggggtttcaccatgttggccaggctggtctcaaactcctgaactcaaatgatcctgcccagcttggcctcccaaagttctgggattacaggcataagcaccttgcctggcccctttaatcctttcattccattcatctgggtcaggggatccagggtcaggggcagaagaatcatgaacctgaatcttgagaatctactctgaaaaattgtatggcagtctgcactttaccttagaacacagcattattgtatcatggtgccttcgtggatgccttaattttaacatccaataatatttaacaaatgtgaaaactgaggcccagggaggttaagggacttgcccggtacagttgagtatgtggtgaggctgagctacgttcttctgaccctaacagctatgtcctttccgtgacaccaaaagcctctgctgtgttgtaaacattgactattaaaaaattttaaaagccctcaagtcaccgaatggatactcgcagaataccagggggcctcagccacacctagagaactttagcatagtgcatttgattaaagagcttaaaataaaacctggatcattgggcaagtataattagcttctcagcaggtatttatagacctatttcgtacaagaaactgaagtgggagcatacagagatgtctcataagaagaaataaaaagaagagccctataagtaatctaaaaagttacctacctaagaagagtataaaaagtgcattagactcatgccaattgggcaggcagtcagattctcagttcagagagagaagtaacaaaggttgatcaaggaagacttcctggaggagggagggcccagggatttgcacatgagcgggagaggggaggatgtttggattagcaggaatgtatgagcaaaggcatggaggcaggactacacaaagcaagagaggaggccagcctggcaggagtgcagttgacattgaccaaaggggtcaggagtggaaacgtcagcctgggtgaggagcagaatttagaagtctgaaatgtcacactgaggtgtttggactataaacttcctgagataggcagagttttcttgttgttttatattttatttttattgttgtgtttctttagctgaaagaaactgtgttttgtattattggtacaaaacactgactcttgaaagccttccctgatttgtacttcccttttgctcctatagcttttaccatgtctcaatcatattgctaatatttcattatagtttgggaggtgtgtctgtcttcctgacaacactatgagtactttgggatcaaggttgtatctgtgcattctgtgaacttaatgtctacacagactgtattgtaggtgtttaatacatatttattaataataactatcagctatcagcaaggtacagggcttagcattttctaacccatgccatccttcatgtctaagaggcggtatggtgtaaaagttgagaacatgggctctgtagccagcctgcctgagtgcgagtcccagctgtataacttactgaatacatgactttaaacaacttcactgagactctctgttcctcagtttcttcttcagctgcagataacttttatacaacttatatatatagcagtctggtggatgaatggatggatgaatggatgaactcagcggatagactaatgattgagtaaatgaatgaataaacaagcaaatgcacaaagtatatgtgcccggtgtatttctaccacattcaggttgacttggtgataaatcaaatatatcagaatgcagattcacaaggtcacgccaatcaacccacactgactaacccctgggtacaaagcactgaggccatgtggtcattgctgcctccatggaatggtcttgatccaactgaccagtctataaaggttcccaaaccaacacagaggcactggatccagcaaagcctaggagctttcctgcctcatatcaccaccttgccagagttgaatgaatgaatggcaggaatgaataaatgagctctataccaaaaggaaattaaaatgttccaatgtaagtataggagactcttgtttccccttaggcagagatttaatacatattcttatcctccatctccctcccgctccctctatccttccttccctctctcgctctctctctctttcacacacatacacacacactcatctactcactcactgccttctaggaagctgtgatggacaagacaattctctatagttctgcccaagggaaccagtcactcagcataccaagaaaagtcagagagaatactatcggggggtctgatgtgtcagagaggacaagatgcccaagttttggatggttagaaaggaaagctgcgagatagtggagaagatgcattccatggtgtttgctgaaaaccaaaattctgttttacagcatgaggttcctgtggcttcttacctactcagagtcatacaacagtttaggcagagaggtagagtctggtctcagatccggcacctatggataatgctgagctagctccctgcttccttgtgtacatagctgttgacctggtgcagtgaagaaggccttgggcagtcaggctttgccaaatctgattctgtgtcataccatttgatgacactgtcctccttatgtaaagacgacctgggaacatcaacgtggggtcccttcataactggggaaacagattctaagggaagtatcaaggatggaagattagaaaacaaggaatccctaagaacccacacgtattatcaataaccacaaatgccaacagcagagcaggaagtgttgctggggaccaagaggcaaaaactagagctctgttgggaggcagtgccagggactttgccagagggagctaatttttatagtatctttcaggagcagtgatgtcctaaaggccccactttccctattataaaagtattctcccaaacataaattctgaatcctcatctcagacaacactaaaggtggcttcaaccttctattcaacaacagcaaagatgctcttacccgagctgtctgaccagcttcttcttgggctccttcccctgatgatttccactccaaacctcaccttctatgcttaaaaaggccataagcactttacattaaaaaaggccatttggggctgggcacagtggctcacacctgtaattccaacactttgagttgctctggcgggcagatcacttgagcccaggggttcaagaccggcctgagccacatggcaagaccccatcactataaaaaatttaaacaattagccaggcatggtggcacatgacatgcctctagtctcagctactcaggaggctgaggtgggaggattgcatgaatccgggagcctgaggcttcagtgagccaagatcataccactgcactccaggctgggcaacagagcaagaccgcatctcaaaaaaaaaaaaaaaaaaaaagagagagagagcatttgggattaactggaattccaaacccttctttcatgctctcttggagactggaaggcaagggaagtagaaatcaaaagggcagggccctgagatggggtcctgttaggcagatgcccagttcttggaagaagtcaagctctgtggtaaggctagactcaggctctgtgtgtcctggggcctcactggaaccatgtctgggcaaacaaccattgtggaatgaatgagtaggaatgagtaggtagggggcatccctgccttatcaccccaccccatgccatcatcacctttccccctcctggggtagggcagtcaatgtggaccctataaggagctttgtaggacctggctaatcccaggcatctggtccccagatgagaggtctgttttagttatttcttaggccctagttcccaaagcctcctcatcccccatttcctatcccagctgctttttctaactgaataaatccactgttgtcatggagacaacacagtatcagcatctctgtttttttttttttttttttgtaggtccttccaaaaaccagaacttcctagaaagggtcctacttctacctccctagtatttctggcatgggagtcttctctgataaaatatggtttgatgtttggagtatctgccttgcccataagatttcctaccctctttgtagttttaccttgcccaagttttacctctatccttagcacgctgagcttaatttgacttctttcagccaaggatcctgagtttcagcacacttccaacactgggattatttaataaagacggcagttacaggggctggatggctcttcatgcaaaagggcagacataattctccccatgtcatagataaacaatcgtagctccaagaggccgggtggcttcagcaaggtcacccatcatagaagagcaaagccagggccctctgcagcttttccatgctagcactgccaccttcagtggggtctgcatctagacactgagcatggtaactaccactattgagcaccagctgtgtgcaagtcagtatgtacagacatcacgtaagcctcagaacaaccttgtgaaatggatatcaatgtcaccattttacagagaaggaaactaaagctcaagaaagtccagcatcttacttagtgtcatacagctgataagcacagaagctggattggaaactgagggctgtccccttcaaagtgcaaaaccagtacaaaatatggcctctacctgaaaacaggtttcaggagcagtcactgccccagcactcatccaagggttgaattccactgtatggggccagaagtttcttttcatattgtcctctcccctttgactcctgcaggacctctgctgagtttttatgaatgaggaggaaaaaaaatgtcattgaaaagttcaaccaactttggtctcctctctctgagtgatagataggtttaattactctgaattactcaaccactctactcttctcccccaagtcattaaaaatagattttctctttgaactgcactccgccctcaggtctccagatagtcaggagttcttaggagacagcaccggggtcagcttctggtcagaaggttgtgcattgctttagttgcaatcacagtctccggaacctccagctgtttttctggggtttttgtgcctctttttccttaatggtgttgatcacgtgactttcacagcccagaggacaggcaggaggctgggttggtatttactttatgagaatttaaggggatctgaatgcatgactattgattgttaaagaaatggatctaacactgagaacaaacaataatgagttcttcacattaattactgtgaagctgattcataggaaaaacctaagctgaaagtgtgggctcagaggtgttctgcttcctgatgagccccagagataggtgggacagatattgtctttatctcaaaataaggagatgagggcttgaggcataaccggagtgcccatggcgacacagctgatcactggcaagaccgggacagaaaacttctgctgcggccactacccaagctgtgctaacagagggcttggtgacattttgtaggaagctcagatggaaaacgtggagcctgctcacagcctcttccattatcgttctggtcctagtaagcttaaaaacagaagtccagccaggtgcaaaggctcacacctgtaatcccaacattttaggagccagaggtaggagagcccttgagcccaggagtttttgactagcctgggaaacatagggagattctgtctctccaaaaaaaataaattaaattaaattaaattaattagccaggtgtggtggcacacacctgtagtccagctactcaggagggctgaggcaagagaatccgttgagcccgggaggtagagactgcagtgagctgtgattgcaccactgtactcctgcctgggtgacagaacaagactgtcgtttaaaaaaaaatcccttagggaatctttcacccttcccaatctatgtccctcttcaccttctggtatcacctctcttgctgtctggctcctgattcacccagctgaatcactgttagaaaacagaggggagtaaaatgagctaagagatttgcagtggtcaggcgggtgaacctgacctgcagtgtccagcagcttgactaggaagcagaaagatgttctttctaggaagaagaatggccccggtggccgcttttggggcagctccaggagaaggggccttccctctgcagtccttgcctctgtctgtctggaccccgctgcatctgtgtgggaattaaacaaacttagacaccaattttgtttctgttaccctacaaaggatatgaccttacctgcgttacttaagctgacactcagttttctaataggtaaaatgggactaagaatacctccctggaaaggttggtgtaaggattaaatgaggtaatctatgtgacgtgcctggcatgcggtaaatactggatacatgcagctgttgttattattgttcctgctgcttcaatccattcaacaagctcggtccactgcccagctcagggcaaggtggggccagccaggagcctgccagctgtcaggagacctcagtgcccatcacttcccccagaaccttaggcagcagatccaaagggacatgatttccttgctgcctccctcacctgctcccagcaggggagattgagattaaggtgttgcttcaggcatccagtagacatcagctctttcctgctgaaggacagaaagtggtgtgggaatttttctttggagacttgctgagccaaaggggatggagtaagaggcatgtcaggagggagggggcctggactttccccagagggtctaccttggcttctctgcctgagagaataaggccagggtcaggggcaggactgggcctccccaaacattggcccacatttctctccctgtgaggactctgaatgagtgtcaagggaagcatagtacactaggctgccaggcagaaaatctacagaaaatcaacatctccatgttaattgcacccatttacagaagggcttacaagatttggtgcaagcctgtgaagaagaaaaactccacccacccatttattccatcagttaacagctactgggtactaggagctgtagggtgcagagaagcagaagcctcacctgccttcaggttgcttcaagcctcctgatccccgctctgctcttgcctcggatctcgcagtggactcctgggccaccttctccctcctcatccttcagaaagagcccttgcagtatatctgagaagagcgaacagtcagtcccatcatgggccgtggaggattctcctccagttggccactttgccactcactgcaagtgaggacttaagcgctctttgggggccttaatttctcagtagatccagtgaaaatcataacacataacaatacctgtcctctcttcctctctggggagttgtgcagatcaaatgagataatgtgtgtgaaagcatttcaaaaatgccaaaaccctctgccaggattgctgtgactgcgttattgatctctgtccatacagcagccccagcaggggtctctcttcaatccaccatcagctgtgtgtgtaaatgagtgtcagatcttttcttgaaaacaggtttggattgggggaaagagaagaaagtggctctgagaccctataaacctgaaggggtgaaggggtgggcctgcagggagggaccaccaagagaaggtaaaaaggaaaggagagaggcccagggagccagctccatcagcttcagctgctgtgtgctctgccctgagccctgaggaccaggaggctgttgatgaggccaactggtgctccattcgggcatctgtgccacctcccacccctgccacctggctcccagccactgagaaggcctctgtttcttcccttgtgtcaggagcaggggacacgtgtgaggacaggtgtaccatctggcagggcagattccagggaagattccagggaagattccagggaagaaagagattaaattctcaatcttggaggggcccaccagcctggggaacaattttcccttgttcctttcatccctctgtgtctctcttgcatgattgcaaagaaatcttgcagatcgcttgaacactgagtgctcctgccagagccccctgaggtgagctgccactctctgtcctctgagccacgacggtcctggttctacttctattgtggcatctgtcctaccatattgagattatctatttccttggttttgttctcaactgaaccatgggctccaggagggaagagaatgtagccctgatgcctaacagagggttgagtacaatgtaagtgctcagtagatgtttaaggactaaatgggcctccggcatgatccactgtcagaatcatgtgaggttttctgctttcacctcaggcgtttctccagaagagccatagaagagctcagaaccatgtgggtccttccaggtgtccatatagggtggcagagatgcagtgttgattctctgtccccaggctcacttggcaaagggcgcttgttcttatgcctaccattgggaaactcttctgtggaaagggtgatgtgtctgctcctgatgggagtaactgcccaggggctctgtccaggatgactcactcttagggcctctgaggctttcctggccttaccttggatggtccaaacactacaggtgtgccatgcttttcaagaccttcaggaaagaggctgggtccagtggcttccctcagtgacttgtccccactgcctctaataattatctgataatgtgtctggctatactgggcctgacactctgtgggctactcgtgtgctgaattgagagagttggtcagggaaggaaaactgccccacactctgcactccctgccaagtccctcccacatgtatcttcagccccgctgaatcaggccaaggaaggcaccagagacgcggggccccggggccaggagagccaagaacacagtgtgagtcacctttaaataagagtatttcttaagtaaatgacttaacaggacagttatattcattaaaggtgtaattacaagccataagatcaagcagaaaagaatgtcaagcatgagggtggaatccagtttgaagcagcactgcgggtcctggggagaaggccatagggggcaggagaagggcctcccattgtataattcccattgccacactcacctgccagcccagccacccccagatcccagcactcagagtggagggggccaaggagcctcaggcataattaaaatgcaataatagtaaacaaatgctaattaaagtgtcatagagtgtcccgttaaactctgagtcagccctgacagagggcgcccgacgcggtggacactctccaggagaaagctccctttccttcttgagtttctgaagacatctccctccccacccgacccagccctagaacaagtgctgggctgtcacctggggtacaaagtgaagtggctcctgactgcggaggcttgaacttggtcctttatggacttcatagatgcagaatgattagaaccaatttctcactgggcataaagtagtccccagagcactgttgccttcccctacacccctaaaatccctctaattccttccatagcaccaaggaagagtgatattctgtttcttcctggccccaggacctaacatttaaaaagacccactcggagagctggagtcatctatatcagtggttggcctgcgtaagaatcggttggagagttgttaagacccatttcctggacctcttccccagtgtttctgatttagtgcaccctggattttcatgttcagtaatctcacacgtgacaccaatggtgctggtttgagaaccatacactgagggccattgctccttgagggccccagacctgcctcatggaggacattgttttggccaaggctagaaggcttggaggcatcacatattccagctctgtggtctttgcagttcttcccatggtcacccagactcacatatccagacttgcaccatccctcccttgccctcaccaaaggtgtttgaagaaaccctgctttccagtgtctgcttatatggttctttccacctggaatgctcttcatctgtctaaatattcttcaccttttaaggcccggacacatactgtgtatactccgtttagggcagcactgtcagatagaaataaaatatgagccacaagcatgaactacatgtgtaattttaacttttctagtagccacatttcaaaaaggaagaagaacaggtgaaattaataatacatttaattcaagataagcaaaatatctcttcaacatgtcaataaaaattattgatgtaattttttcccttttttcttttcctctctaaatcttccaaatccagtgtgtattgtagacttacagtacatcttaatttgtcctagctacatttcaaactcaatagccgcatgaagctagtggctattgtactgggcagcacagatgcaggcagtgttttctcgttgctctgaattccctcagccctctttgaatacttgtcttagaacacgtatcgctttcttctttttattgctagcctgttcgcaacttgaaggtgctagttgtgttttaatgctgtcgttgtttttattctgaagtgcctagcactggcctggatggaggacacaatcaatgaatattgactgacaaatgaatatagaagcacatgaatataagagacagaggaggctcctgggaacatctgactttgagggtctccacccggtcactgtgacatttctttcctctggtttgtgtgtggctgttacatcttagaggacagaataattcaagttttagaccaccccccctccacccctgccaacttacaagtttcctgtttcactttgctcttcaactcagtgcattaaaaaaaaaaaaaatcaccaggagggcccaggaaacaggaaaaatagttgtgctattggtttcatgtttggagaagaacagggtttcactatctccgtggcacttggcgtgaaagtgggctttgttgctggagacactgctcccattcagggccccttttcccagctgctgagggctgggctgtgttttgacagacgggccgaatgcaatgcagacagttgttttaatttgcagccagatgcagacatccctcacaaggagcccgaaacccaagaaaaggaggctaggcactggaccaccattctcaggcctcagagagtggtttggagggggccagcggaagcctcccaggcagccagggtctctgttatcccagagggctgatagtcaccaggcctgggagacgtacactagaaggtctccggcagatacctgtctgaaaggtgtttcttgtaggcatcgtgggccatgaggcagggttcaagggttattctttaaggcggtgtgaattggtggtggtggtggtggctgcatgttatcttttaactgtagagttgtacaggacaaaaatcatcaacagtctcaaggaggagttagggaaactgtgggaaatagaaggctggaatgtcagaattggcagggactaatgtagccttcctctgagggcagaaatcctttcttccagcctttgggacgaatgtcaccttgactgcttatgcatccctgtgataggcgttcctttggaaagccaggcggttgcatgatgttgagcttttctgagcttttcacccatgagtcccactgcagccatactgctccccttcgaacactggaaaacagcctgcatgactactttgagactcttcattggactaaataaacatcccaggttcatctgctgcatcccaccccatcctggccaccctccaggaaggatctctggttgagcaacgcctctcctagggcaggctgcggagacctgaactccggactccacagtggggggtggcttctctcgaccctgatgctgtgtgtctatttatgcagcccatggtcagattagcttctttcgttatcacctcaccctatcaggtcacatcagattttgagttgagttgactttgagtcaactcaaacccttaggtctatcacacttgaactatttcaaatcagctatcccccgtcttaaacttatagtaccagtcttttttaaagctaaattgcaagattttacactcatctccctgcatttcatgtttttattattaaagggaggtgagggatgtttaaagctgatcatgtcactgacttacagaaaagcctcatatatgcaatgttaagtgtgatgatgtaggaaggatgggtggggacacccaagagaggaaaggcaggctcatctctctcccctcccacccactgtacaccctacacttaagtttatactgaacttatccatgatcgctttcgctcatcacaatccttcagattggcatgtctttccaggtctctgcatctgaccccctcttacccttcaaggcacccctacaccactggtcacctcttcgctaagttccccaaaccttcagcactcacagcaatcccacacaacaaaaactcagcacaatgtagagcaagtctcggtttgtcattaccaactcccactggaccgtagggttctgggagggcagaatctgtgtgctgttcgctgtcgtttctctgttgcatagcaccagagctccacagcgttgacatctgataaacatttgctgagtgaacagtgttaggatccatcctgaacctctcaggaggatgccgtggagatgtctccgtcatatcttttgtccccctgccagaggcagaacactgtgctactggaccacaggttatgtttttactttttacacatctggtaggtgggggacctctatgccctaacaaataagaacccattcccagcacagcaaatgtttttgcagcccagcagcctcctgccccagccagcaacagatacctaggacatatcaactggaacacttcagtcctctggcccccttgcctggtctttattttcacccctgctgtgcaagtaggggtgagtaatatccagacaggcccagctcaagcccctgcagggccccagcagaagaccaggaggagtgtgcaagggctacactctctggggggcagggtcttgatctacaaattcccactttccaggcaagactgaatcaggcagctcttttctgtggatgttcccatttagccagacttttcaaaggatgggagatttactagagaaactgaatgcagacatcagagaatgggataattggatccaggtggtatatttggttggctgtaaagagtctgtaccatactatgaatattatttgatgggaaaagtttctcctttccctttttgaatgttttctgtgtaggcaggatgtctcagcccaagcccagctgaaagctcttcagagatgagtttgtgccactcaatagcctttcaacagagttaaccattttcagtacttgccactggcttgcccagctctcgggaggatgctagtggagggcagaaatagatggagcctttgctgctacctctcgcgaaggcaagaagtcttagggctgccactcagagacacactcggcttagcctacctgccttatgcaggtaaagagattggggacattgaggccatgacttgccgcccagtatcacctctttaggggagttgacagtgcaagtgtgagtacacacaggactgtgtgacacacacctgctagtcgtcacagcctaacctcactgtaccctctttgctctctctgccaggtcaccagggtccccgtggagtcatgtgagcagtatacgacttgtggggagtgcctgagctctggggaccctcactgtggctggtgtgccctgcacaacatgtaagtttggggtatactggaaaagggtttggcatgcagaagaccggggctttccgggaatgatgggatatgacagtactttgcagagagaggaattgtcctcttcagagcagtaattctaatcgtggcttcagtgttgagagcaggaagaggcaaagaggccatgggtgggccttctttctaagtgcagggtctttgcctctcttcttccattttacttccaaattcagcccttcagctgctctgaagtgaggtgcttatatccttgtgtctttgaaagaactcacaagggatactgtagtctttaggtttccccaaaacttcttcagtgtagcctgaaatgggtgcccctctgtgccaagagtgtgcagatggtggtgcactggcattgggaggtttagactccagctagctgctgtgtgaccctggatgggtcccctgacaactccaggcctctgtttctccattgctgtttagggaaaatgcctatttcacaggtgaattgtgaagactgaatgaaataataaatgctttggtaataaggaagcccagaaaaggctacacaaatcagaataattatcatggaccctatacccttgggaggacccttctggtctcattattttatgattctaagaagttcacatctcacttcaactggcctcatgatctgccgttgaataccaactcaatataaatgctaaatcacacttaaacttcctaatttgaagagccccaggggaagagaaagggtgaaaaccccgaaagacaggagctggctaggaattctgttgcccaatggagttggaaactccagggctccatgccagctagcaaagcatctccatgaaatgagctgggtttggggtggaggcggaggcggagggccagagttcagggtcctgcacaatagctcttggcttccagcctctgcggcaggtgttgggagggctctggagggagggagggaagctggtgcctcacagatgcaaaatctggactggatttgagcccgtgaatactgggttccctgcttgggttttggaggtaaaagactgctcagaaagttttgcagaaatgctcttagcagacctggacagtgtgtctccatttaggtcagacaagtggtaaagatgctaatgttgtgccccagaatggcaaaagggggtaaatcttggttccctgcagtgaggctgacccaccagccagcaggcagggtctttcctcgagagaatttctttctccaaagaacctgacagcctgctgccagctctgtgcaaagggccctgggcagcctgccctctagctctgcagtggtcatgtccagcggtacctcctactccccatgcctccgccactctgtcctcccagcttcagtgcctgtggcacttctcccatgtcgaacacaccaaaattatagatcggggattatcatttattcaacagcaaggacgtctgttttccccatcttgaacaagtgcctatagatctatcagcaatgcctgggcctccccgctgccgcaaaccacctggtcttcctcctggtgcaggtcagccgtgactgctggaattagccacatcagaatagtcccaggtttcctctgtccccttaactccttaactctttagagaatcctccctacctaccaggacactcatctcccagcttctccgccccaagagctcgcggagaacaagatttttgctgtttatacccagaggtttctctgcatctggtcattctcttcttcaccagaccctcctgcagtgctctcccacctgccaagcagcagcctggtatcaggcgtgaggagatgggggaagctgcagctcccgggtccccacggtggcctctttaatggaggccgagggctgaggagcctctgaggggttggggggaattgaagccttcctgtctcttctgtatgccttgctcttgcaagtgtgttattgtctccaaggctatttatctctgttagggctgttgccataaatagtatgataaaaaagagccatttcagtgagtcaatgagataaaggctccagtcaagagctcactttagagctatcttaaggattcacttaaacctcaataattcttttctttgacagcattcatatttagatccattatgtgcctgaaaaggaagagggggaggagtttggagggagttagggtgcgaatcactgcttgattgtggaatcactagtgtcccgatggctatttggtttggacacgctggcaccagccgtggagcgggtttccatgtgacaaggcagacagtaacctgaagctcccgagtgctggtgtcacctgcccacctgctactgtgggcaggggagcctagagcccgagatgaagatgttgggagaaacagccaaacaagctttctgacagaggcagccctggctgcagcgccttgtctgtctctctgtctcaaggcattatttcgtgacacaaacatttatttaaaatataccatgtgacaggtagaatatcccaatgaataaaacatggccactgccttcaaatagccattaatccacccacaagatcatatgcacactgtcccacactgccaagaccctctcctattttcttaaaaatttctctggaggaaaatgataatatgaatcattatcagcatcattaatattaatattataagggctaacactgtcatggcacctactatgcgccaggccattttctaagcactaactcctttaattcttacaccaaccctgtgaaatacgtattatcatcctcctcctccttttttttttctttgagataaggtctcactgtgtcacccaggtgagagtgtagtggtgcaatcacagctcactacagcgctcaagtaatctaaccaactcagcctcttgagtaactggaactagaggcgtgtgccaccatacccagctaatttttttttttagaatggggtcccactatgttgcccaggttggtcttgaactcataggctcaagcaatcctcctcatcttagcctcccaaagtgctgggattacaggtgtgagccaccatgcctggccaatccttattttttttttacagttgaggaaactgaggcagagagagattaagtagtttgtccaaggggtcgcagctagtaggtaacaggtctgaggttggaacccaggctctttggccccaaagttcatttgcttttccatggctgtgctgcttctcaggtcccacaggctgccctcactctgtggtctcagcatcccacagtgctgtaaagagtcattctagggccaggtgcggtggctcacacctgtaatctcagcactttgggagactgacgcaggtggatcacgagatcaggagtttgagaccatcctggccaagatggtgaaaccccgtctctactaaaaatataaaaattagccgggcacggtggtgggcgcctgtaatcccagatactcaggaggctgggacaggagaattgcctgaacccgggaggtggagttttcagtgagctgagaccctgccactgcactccagcttaggcaacagagcaagactctgtctcaaaaaaacaaacaaacaaaaataacagagtcattctgaggcaggaaaacagggtctggaggcagggaacataaggctgattcacacttcagctctgacagaaaatatcctctccataggcgtacactggctgtaaatgactttgtaactttacttcatcctcttcatttacataagacatactccaagcagagggtatttaaactcccccaaaattctataacagggcctttgagcccctatgctcaggcccgctcccgcactgtggagtgaactttcattttcaataaatcccttcattccttccttgctttgtttgtgcgttttgtccaattctttgttcaagacatcaagaacctgaacaccctccactgttaattctttgtgtcgaaactggatctctcatgttggggattaatcctcttccctctcagtctgtccttaactgcgacggagactgtctgagagtcaccaaggccctccggagtacagtaaaagtcttcttgagaagacaggacacaggcctcagggcagcaaactcccatcctgcccaggggacaatggagccaaacagatgggtcccagaggcctgacctcttgtgaatctgtgtttatggcaggtgctcccgcagggacaaatgccaacaggcctgggaacctaatcgatttgctgccagcatcagccagtgtgtgagccttgcagtgcatcccagcagcatctcagtatctgagcacagccggttggtaagtaactcatccaggggcatggggagagggaatacagtgcatgcacctgtgtgggtgtgctccattcacgcttgcacaagtatctgtaaattgatcagactttaaatccagtaaggagactttatgtttatagcaaacgtatggcaatgcctattgtaaagggcatagtcattctccagtttccctgcaaattcattacccattgatctgttttgtaaatctagatttttgcatttagtaacaaacatctgcaacataatgcagtccaataccaaataacacattctttagtatctgctgcatttacaattctccactcactgcactcttaaagaaatctgtgagttgcatgtgtgtgtgtgtgtgtgtgtgtgtgtgtgtgtgagagagagagagagagagagagagaggaaagaataagagcaagaaagagactgcctcaattcgaagtcagtgtatgcttaaagagaatattaaagagaataaaatagcccttaactatctatcaaggtacaacccaaaatatttcatgtcctcaggccctgcattattatttcattctgaaggttttatgagcattcacgaatgttaattagttaatgaaccttccaagatttcagttcattcatccccaccaggagcttttggctccaagggagctgaggaaacaaacaggggagtttgtacctaagtctcttggccccatggaaacgaaactggggcagagattcagcagcaaacaaatgtatggaaaggttaggtgatgcccactgagactgagaaacccactgcaaataacaccactgggtattgataggaagatagagggaaacctacaggctgggcgcggtggctcacgcctgtaatcctagcactttgggaggctgaggtggagagggttgcttgagcccagaagctcaagactagcctgggcaacatagtgagaccctgtctttactaaaaatttaaaaaataaaacaaagggaaacctacctacgccatcatggtcctcagcttggaggccaccgagatgtcaccaccatgaaccctatgggcacacctcatgggcagaggaaaccagtcgcctttcttacctattcaaataccacttagatgctgtattgtggtaatttgagtacaaactcatttaaaagtgcaatggatttagagcagcattttgccattgaatattttctcaatcgacagattcctcagagagtctgtgatatttttactgttaaaagtagggtcttcaaattcaaaaaagctgaaaaccgctggcctagatgattggaacccataggtaatagcagacatcaagcagttggtggccacttctctgatcccctgagctccttatgaacctactggtccatttcaagggagctgctagagaacagagagcccacatggaacagagaagcacaaactctagggaacacgcagcctttagaagcagcctcttgatgaatgacagccaaggtgaggagctagctatcttccaccaacctagtgagctcctggtaaacctccaggttggtgatatttactcccatgagccatggctaaggccttgtctgtgaagggctcggctcaggacttgctttcaagtttgtgtggtgccttgcaattaattttcatgtcaaaatgaacaggggcttagatggattttggtacctttccctctagcgcccccacccctagggctttctaatgctggagaagatggaaacattaattaataataatattaataaagaccattgaccctacacacattgaataattaatgactgtaacttcagtgttcaaagctggaagaccacttagaccaacatccttcttttatagatgaggtcaggggagatcagtgagcaaagtgggtcacagcagggctggacctggagtccaggtctcctgaggcatttctttggcatcatctctttgctcctcccacagcttagcctggtagtgagtgatgctcctgatctatctgcgggtatcgcctgtgcctttgggaacctgacagaggtggaggggcaggtgtccgggagccaggtcatctgcatctcacctgggcccaaggatgtccctgtcatcccgctggatcaaggtaagaaatatctgccatgagagccacaaatgaggggcttctctatactgagggagctgggggtcacaagaactaggcacacagtcttcttataccagatactaatattggcttagacaacttgtttacgtttgaaagcaaactgtcatgccccaaagtgaatttcaggaaagaaaacacttgctccactttgagttaaggctgcacagaacacagcgtctttccagatagcccgtccctcctaggaatggagtggcttccatcagtagttttttagcaggtctctccacagaactgggggctcagacctaatatttctgaaatcctttcagtaatggaacatgactgacaaaggcaaggggctccgtggaatctgcttcttcctccctgcaggcagaggaagtctgggtctgaggggtgggctggtatttacccaaagaggcttccttgggaggagaagagacgattcaggcaggttccacatagtatctacatcctaagagagccctgtggtggcttcatgacttacattttatttttgtggctgtccactgggtcccccacgttgttacccaaccccatccttttttgtttgtttttccagactggtttgggctggagctacagctgaggtccaaggagacagggaagatatttgtcagcaccgagttcaagttttacaactgcagtgcccaccaactgtaagtgcttattagaaagggtcttgctctgggtctggatgtgggtatgggctttcttcccctcgatgctaagctcctttagggcaggaaccacgttgtagtcacctcacagtttccccatggggcctgacactttgtttggacagagtacactgtacataaatactaccatattaaaccaaatggtatttactctctatagtctctgaatccttggatgccaccccaacacacctaacccccaactctcaggccaagatagtaaaaagagagtcagagaacaggaaccgtaaaaaaagttcttcattttccatcacttggtggtgactttgaaggtagaggctgacagtgagtggagtatggacatgtcacccacaaccagatgaagagggactccgagatagcgactcggctatgcacacagtcacccacagaggaggagcagggaagggggaaagtagcctctctcagcacatgataaaaagacctggatggggaggtggagcagaggccttcactccatcattttttaaatccatccttcaatattttcaagaggaagggaaaccagacaggccaaaccacagccttcagtggggcttgactttagttctacggacctcaccagccattccagcagctgaatgcctgccagttggtgcccacacgctatgagaccccacaactgtgtgagaagctgggaacatttcacagggaaaaagcagaaatggagggagtgaaacccctacttagtttctgctgatcctccctggtagagaaactgagaccctttccacagaagctgggaactcatacaccatttggtttagaaagaaggaaacacaggcctctgtaatagagccacataagggtcataggaccaaaaaccctagacattcagcaaggggagaggtcaatcaacagctccatatcagaggaggcagtgattcggaatgtttacggactcatccttcccattgtccaaggcaggaaccacttgggatccacatcatagtcaggtcttcaggggtatccagtctgtagggtccaagctatgggcatgaaggactcagcaatcaagatgggaagagggtctgtttgcagctaaaccctaaaggaatctttagtcattagaagaggcaaataagctagtcctccttattctccatttttctgaacttgattttcataattagaataatcttctggagttctttggtctctacattagtcaaggaaggagccccattgggacaaataaatagatgtgctgagaaagacagaacaagtgatagaaatggcctggtgggaaccagggagggcagaaagggactgaagttgaaatagacaaagctgccctctaaccactgcatttgaatcccagcaaaccctgctttgggaatggcaagcatctgggcaacagaacttcttacctccttctcaaactccaacatggtggtgatggaatccattgtttgtgagagcaatcttatctccatggcaacagagtatgatgtcaccactttcaaagatgtattgctatggcaacacagatgctgtcacaggcagcaagttttaacagaaaaaaaaaaagcaggtctccttgacagcaaagattccattttaatgccaaacactgcctctcttgcccttctctactggaattcagttaaaattcatggaatcaagtatagtcccctccttttaataatttgctgtaataaaagtaaactgaggcccacagaaagattagtgctacaatgaaggtcacaaaagtagccagcggaagagccacatctagctagagccccaataaccatcctccttaggcccttggtccattttcattatttacttgctgaatcataagatgttaccaagaaccagtctatctgagagtacatgagatagcatgaagctcagaaactaaaaaagtctgggcaatggagaatgggataaaaatgctctgaatgggaagatgaagtgtaaatgggctaaccaacccaacatactatggcctgtgagccggtgacccctggatcaagccccaaccacccaaatgtaatcagagccccaccaggtggcgccagactgcagacctggtcctgtccattccaggttggcctagttgtgaaagactagatagagtaagggggctgcgaggaggagcaagactaatcccccctacaaaacccatttccattacaatgacctgatcacacacagagagccaaaagaatatacacagtctccaggtgaaattggaaggaaagaagtgctcaccctggcaagaaaagcacataccacacacatatcctactgttccatgcctgggggagtgggacaaagttactacttaatactattagctcccccaagcccaataatacagatgatatgaaccaattgttaacactcaaatgttatttaagaggttgaaataacaggtaatttaagcgcttgacaataatactcacatttagcatggcatttttcgaaaccattttctatgcattatctcatttgacaccaaacagccctgtggcatagacaggaatgttttattacaggcggatgaagatactccaattcagagggtgaagtgacttactcagtgtgaccccagtggcagtggcagaagcaagtctataatcagatatgcccaattcctgtccctgtactctgccggctaccctgtctttacaagcagtgaaatattgggaactgtttagctaccagcattcagaagaaaacctagtttgcagcattgccaaattctgtggcgcaactatttccaccatggccgatttcaaactaccaccatgatgtctatcagcttgcaaaattcctgaaaatgtgaataatcagttctcatgagcttatagaagcacacccctgctttgtcagttatactcttatctggtctcattttctttccaattttctgttcccatgaatatcatggatggagaatccacaattcttggtgctagaggatggcccaccagtcttccctcctgagaatgagactaggatttaaacacaggttaacagacttctatcatgacacatgccaccttccctctttgttctcttctctttgcctctcaccatctctgtccttgcaggtgcctgtcctgtgtcaacagcgccttccgctgccattggtgcaagtaccgcaacctctgcactcatgaccccaccacctgctccttccaggagggccggatcaatatttcagaggtaagaagggcttaccctaacatggcagtgttcccagtgagtctgagtggcccctccctctttagatggtcagtccaatggcttggccattttcttgccctggcccatcttggccgtcttgccagaaattctgcatgctagaaagccctgttattataaagctcaaaaaagtagcagcaaatgaccccagaggcagaggctatgtctactagactcctaagactctatgcattcaaaagcttgaaggtaactgggggttgagactgaaagcttagaggaaacatattcaaccaaacagactccctggtctagaagagtgtagtgaatggcatttattctttgagtctagccctttgcttggctgcagacatagtctagttcaatagaactttcactcgcaaccattctttcatgccaacttctcttccaactctaaaattcaatgattctttgactctgatgtataactgggtgggtggccttgtagaaagtgagaaaaaatcagctagtgaaaagaaccaggcattgctaaaagtcctgttttattatacagtcgaaactccatccctaaagcctgacccacctttgttattaacacagtgaaatatcaaattgcttatctttctaatgggtattccattcaatggttattcactgaagtctactttcttatatattcatagcatgtctcaggacagtgaagcctgcttgctcagtctccctttcttgtgtcgaaagcttttcataccccagcatggccagttggatttgaacaactatagagacattacatagttgcccaaatgcacgtgtgcatatacacatatttcttactctatattttagaaaatccaaaaatggtaataagtgacaatgtagcatttttatatacaactacagtctttttttttttttttgatatgaagtctcgctctatcgccaggctggagtgcaatggcgtgatctccgctcactgcaacctctgcctcccgggttcaagcaattctcctgcctcagccacctgagtagctgggactacaggggcatgccaccatgccagcaaatttttgtatttttagtagagacagggtttcaccatgttggccaggatggtctcgatctcttgacctcatgatccacccgcctcggcctcccaaagtgttggggttacaagtgtgagccactccgcccggcctactatagcctttctatacacatcttcctcttgcgctagactacaagctccttgaaggcaaggactacatcttatctttaaatcttcaatgtcttatttagcaaatgtttgtagaatgcatgcatgaaagaatggatgaacgaatgacctttctatttaaatcccattgatggcaattgtgtcaacttgtctaagatttcaagtaatggagtcttgtgtcttctaatcttgatagcagtgctggttgcttccatggctaaacataagaaaatagactctgaaaggtttctcaaacacatacccctttgaactcttcttagtttatgaaacaacaggtgttatgttcagtcagaaaaatggaatttgcctgtcttgaaagggagaaacatagatgccacaggtggcttttcaaacagacccatctacgggtgcctcagcatgacgaaaccaggcatctagtgccctgagaacctttcagaaaagcattttcctctagccagttggtatgctttgatgcagctggcctaaaaaccctacaccagccttcctggacactggagattaactccagccctggaattctgcaacagtatgaaactgctctgggggcagtcctttcacacagagctgcagggagaggtgggagtgggcaccacagcttggagccaatgaaagaatcgcttagaggggcagacctagccaggaacagcagagccaccatgggaggcctgggcaggggtgaagactgagcagtgagagagtatgagacacagtctcagaaactaaccttgacatgggccactttgaaagttccttaataaaatagattgaggtggcccccaggacacagagagattggatgaagtacaaatctagacaacaaagagcagctgctccactttctcctgaggctacccacctcaggccaagagaaacccaaagccaagcctgaaagcgacctgcagctgaagcaagggcatgcgagtgtcactcaaagcaagataaataaactctgctggggtgtgtgtggaggccagagagctgagcccctgcaggctaattggaagcaggcccggccttcctcacaccattcggaagtcactgaaatacagctccctctcagccatggatgagagattcaacattccggagctgggccaagagaagctgttgcctccctgcaactcgggattaaattaataccaaaagggacctaggggcaaactcagagactccccacctcctttttgtttcattttctgtccttgatgtctgtggcttagggttagagaagagcagtcccctttgtctcccttcatctccccattgccctgagtaggaatggtgtacggctgctctcttatgctcgtgtgcattggtccctggcatggccccagggattggctgtccggaggactgtgagggaagcccagactccatccagctcccaactttgctcaggaaaggaaacagggtgcagattcccagcgaggttgccagggccacttccggggcttcctaaaatactgctttggctcttaaccacagctggccacatgttccttttcagcaaacagcagccaggcccccctcttttctgtccaaagttctgctttaggagaaccccatccctgaaaatttgaggaacagcaaagatgcacatgcccaacttgggtaaggtttcccttactctctcaggcgtcccagctgatagtttcatgtagtttggggaactagaatcccctggatttccagctaactggaaatcccttagctatctctttaggggttcctagaatatctcttttagaattccagtaagcctcccttcccaactttgaatcaaaattttatgtctgtctgcttcctagaaacaatatataactgattagctccattgattaatatagcaacattaatatatcacacatttataatttcttcacatgtgccaggagttctcaaagtgtgcccagggaccggcagcatcagcatcacctgggaacttatagaaattcaaattcttgggccccatcccagatgaggctaaagattgagaaccactgacatttggcatttcaatggattcttgcaacagccctgcaatttcatataatttatatttgacatctgtagtaaccagaatgctaaaaatttcgggtttttgcccaaggctacagagaactcaggcatccaaaaaagctgagtacagtatgttttctacagaaaatcagggcccatgagctttgtttccatggtcacagccacacttgctggcctgacttcaacctggtcctttgctattggtcatgaggattcaggctatggatgggccagcacaaatccatctccacagatggagaaactgcccatagaagatgggtcagtggtgccatttccagataaaaagacagccagcatatgaggtaaatctgcccacatctttccagaaggcagatggaccaattccatgcttaggcttgacaatgaagaacagctgtgctagaacgaatgcaattcaaaaataaaaatattagtacttattatatatgcagcatatatataatttaaccttaagtactctatgaagtggattatattatagatgaatagactgaggcttaaataagttaaacagctttcctatgatcatcaaataaatgcagaaattaggattcagagacaatttttcaagctgaccttgaataagtgaaagtccactgattctgcagtcacactcacacgcacacacaccacaaataggcggtaatattaacaattgtcaatccagcatattaccacttacaacacacattgattttcctctttcatgcaatctaggtttgtcagatattattggcaccattttatagaggaggaaactgactttcaattaaaccatttgtcaagctctcttaaggtaatgagtcagacctttccagcactcagagcacagcagatctctgatgggggccccccaaatctcttcctccctgagtcagatcaggctgtgacatggtgttagcaagcgggtgtgcacgggaggatgtatggctttcagcttttaaagctcatctccctccatggctaagccaggcctagtgagatgtagatacataaatatctcctttatgccctgtcccaggggaaagatagaaccaaataaatccgattagcttcccaggatgctggctgctctctctttgaagtccagtgggtgaagataatgccatttccacatgggagaagtcgcttcagagggctaaagggtccccagcacagaacgctggcagagcacagctgaacaggtgggcaatgtgagcccaagactcatagggctcctaaaccaggtccctgctctccctgcagctgtgtttcctcttccccagcctaccgccacccctggggtattcctacaagtttaagtcttggtttaaactaagattgctgctgagaaggtgatcctggctccagttggcctagagacagaggagaaagaagatgacccaaagagatcactcagaaggctgtgaggatccgcggtagcaatcagtattttaagaatgtgaacaacagtcttaacattctgcaggaaaagcatcttaggatgatttgctttctttttcataagacaggtactgtatgtgtatgtacacatgtgtgtgcctgtgtgtgtgtgtatacccacagaagcaaacaggttggaagtggccttattgtatctgattaaacccttcaccatcctcaagccccacagatattgaagtttcaacaacttggcaattgtttggggtccagtctcctccacccactttcagcccttaccactgcaatttccacccaagattcacagatccttcatgaatatactcaccagaatcatctcataacccaaaaggcctgtatcttcccatttcccaagatgaagaaagcatacctggggcaccaaccgcttctttcctttgccttagagaatagaagggaaaaaatcctattctgtctgacctgagagcaattgccaaataaagaaacaaagcataagacattctttttctactagggcaatcttggggcctggttcagcatttgggaagaccctaattgttacccttacatttgattctaaaaagtctgaaacagcagaccatgggaaatttcctaaaattctagaatcccttaaaaaaaaaaaaaactcatgtaatagtactcataaagtctactcatgattctccaacctccaggctggactggacttagcccagcctaaaagatgaaagtgtgtgtgtgtgttacatatagataacatatgtgttatatataggtattacacataacatctatataaaagtatactttttttggtccacattaaaaggattcaacaatctttttttactaaccccagacatcatacttccaaaagcacatctttaagatcctgctactgaaatttgaatttgttgtctaagctcattagagatgaaaaacaactgctcgtcatttacaattcatcagctggttcggagtaagaaaatctctctctctttctctctgtctctctgtctgtctgtctgtctctctctctctctctctctctctcacacacacacagagagagagagagagagagagagagagagagtgcgagagagaccattataccccagccttatttctaacttaaattctaacattagatttgatgcagatattttagctgctaacaggaagtgttatctccttttctatgagatgcctgggcttccctaaagtggtgctcatcttttttttttttttttttggctataaatatatgaaagagtctgtcaagagtgcctgcagggaatgaaagtgaaagtgcagtaaagagcaagtttatgagttggcagcttgagtgactggctcctaaacagggacccatctgttctggggttgccttgtgattctctctcgtggatgccgtgcctgcctggagtcctcacatgcaggtggccagctgacaagggatgacactggtgagcctgccggtgtgtccagaccctcttaggtgggtttctgtgcagaatttcccccagatccggctcttcagaaattgtcagtagtaaattatccttagtaaatgtggacatgccactttagaaatcatgtgactccaaaacccatgactatttccaactccagcttttgagaaccaaatgccttctcaagtctcttcaagcccagaaggcaggctttacctcatctctaaagaatctacaaagttggagctaaaaaaaaaaagattttttcacaggttgctttattttattttctatttaccctcccacaagcaatgacatgcttgacatgtccgttacatgtcaagcactggcagaaagactggggagatggaggtgagtaagatgcagcctaatcctcaagaagctcacagcccagtgaggaaagcaaatcaagaaattgtaattctgtgtgtcaaaagcaatcatgggtgaatattcataactcatcctgaagccagtgcaggggcaggggcagggacggccttgcagagaagaaactgggctgagtttgaaggctgattaagaggtaatcaattattaattctcagagaaggtgatgatttaaaaaaaccaaaaaagtaaaagaagaggtaatcaactaaaagaggggctgaagcagggcagcagcaggaggaagacaggcaggagtgtgtgtttctaatagacggaaaagcatgttcaaagggccagaggcagatcctgtaagggagagggcatctcagagttaaccatacattcagtatggctggactattatgtgcaagaaccacagagttcagagggaggtaggcaagggccagatgctgaacggcttgcaagtggggcccagagaaaagaggcaacagcccgagccacaccatgacaagaggtggccacaggagattccctgtgtgaggctgtgccggcattgcacaaggcttcttaattattgcatttgccattaggaggacaatatttttgtcattgaacatgtcctacaccttgtaggaaatccagcaatcctggcccctggcatcaatgccagtaacaccctctgcaggccctgtagcagcatcagcccccagacattcccagaagttccccctaagaaccactgcccaggagaaggggacagagaaaggggagcctcctatgagaattcccctagtgattccctgtggaggtggttcccacatcatcactgccaggggctaccaggctcatctgcccgaggagagaaggagaaagaggagattggcacagtggggtggccctttgacctctggtggaaaatcagcatctagtcatggagctccataaatcaatctgtctttctcactgtctctctctcatggtccttcccaaagcccctccctaccaagactttcttttttggttttgttttccaaagcaacatggcattcacgcagggcctggtaatgaaatgagattaaaaaaaaaaaaaaacagagcaagtgtttagagtattgctgggagggcttgatccaccttctggaaagcctagctcagtcggggctgggaagctgaagctgctgataacggatgccccaggcatcggcatcagacaatgcaaggggccgagtatctggagctggggaacaagatgaaacccagaggtaggggtgccaggttggggacagggacacgtggaggctcttttatccagtgtctcaggagataaaatccacagcttgccacactgtgcttgaaaattaattcctgaattgtaacacacacagcagatacaggacaacttgtgggacggggatgacaatatcaaagcccaggagctaagagcgattccattttccctgcccattccacgggccttacatgaggtaatatcctgctcttgggcagctcacctgatacaagaggggcctgcctgtcccaggcacataggacagcatgaacaggggacagatggagcctcttcgtttgttcccccaggactgtccccagctggtgcccacagaggagatcttgattccagtcggggaggtaaagccaatcacccttaaggcgcgaaatctgccccagccgcagtccggccagcgaggctatgagtgtgtcctcaacatacaaggagccatccaccgggtccccgctctgcgcttcaacagctccagcgttcagtgtcagaacagctcggtaagaaaacgcaggctgggccctgcctggagcagggcttcctctcacactcgtgctggggcctcagtatggccagccctggcttccggagccttccaggttcacaggctgagcccacatccccagggatgcaggagccagccagcaccccagccgctcagccagagcagggcaggtgactggtgccagaggagacagttccgtgaggaccctcatggcagacactgagatctttgtgccctttctgaagttgattttttaaattttaaatttttttatttttaatttttgtgagaacacagtaggtgtatgtatttatgggctacatgagatgttttgatacaggcgtgcaatgtcaaataatcacatcatggacctttctgaagttgaaagagcacctctttgtcttcagtgaaacttgaaccagagcgagtcaactccaccctacaccccattccacatccccattcagggagtgaataaccaggagggtgctccacaggcaaaagctggagaagagagggacaggaagtgagatgggaggaggggaggtgggaggggaggggtaggaggaagcagtgaatttcaggagcagcaagggttaaaccaatccagaatggcagacagagagcatgaggtgtttaattataatactaaccccaagaagatctttttatctgccagctccctgtctctgactgtggggggtcagctggagatgagggaggggaggatgtgacaaaggtgttgagggaagctaattcgcctgggagagataaagggaatctgggcctcttatcagggagctgtcagattcccaggtcacaggcgcttgatagatagaatttgtaatcggtggaaggccgccaagcgcaaggggaaggcaggatgagaaagaaaagggacacaacaaagggaggcagtgggcaggggagggcgggagcagaaggctgacagtgacatgcccttcagagctgaagagtggggggtcgggaagatgccccgaggtctccatcacagggtgccaggactggccacccaggggtgttatttctgaagtgtgaaggggctaaatgtcttctgtgggatcagcacaagagagaaagtcatagactcctggccacagctagaggactttaacgatagggctgatgagatctgtgcccggaaagctgtgggctgatgaggtctgtgtccggaaagctgtgggcacttctccctagtggaccattggctaaagtaaggctcgtgcggaaatagagggccaccgcaggggttggccaggtgactgctcgatgagactctcggccttacaagagtagtaagagggcattagctctgcctctggagacacatggactttttagggagacacgtgaaaagaggcacagcagatcctggaaagtgccagtgcaagacagaaagtggcaacaccaggggatggacagtttgaggcagatctgcagggttgtgggagaggactcctggggaaagtagagctgagctgggctagaagaatacgggtgggttaaaaggatggaggttgtagggagacggttgcattccttatgagataggaactcaacaaagacagagaggggcttaagaagatgtgtttggagaaaggtagattcaaagctttccacgggagagcagtggaggagaaagctggaggagtcagtttgcatccgattatgcagggcactgaatgccaagctaggaggcttgggtgggattctcttggcattagtgactgggattcagggaaagagcgtcataataatctgagcagcatgcagggtttgtctgcatccctgacccctgtgatagagagccacatgagccccatgcctctgcccgtctccctatagtaccagtatgatggcatggacatcagcaatctggccgtggatttcgctgtggtgtggaacggcaatttcatcattgacaaccctcaggacctgaaaggtaagcggctacttccgggtagaagtttgatcttttcacgaccccgggaaagactggggctagagggatcagagccagccagccgctgtgccatgaataatacactccctctgtcggcggaactcttcagaggatcctaaagcaacatttggagtcatcaaaggagtcctgttgggagccctgttttattacaaccagagcatccgctgggcggccgccggcccatccacgttattctttggctcctgcaggctttgaagtgtctgtggaacctgacctaggagaacagcaggcaggaacgtccggctagtttccctggaaatggagatattgtttccagtcaggctcttgttcccctgtccttggccctggtcacaatcactgcacaaagagggtttttaaggctgctctccagttcctgaggtgggcgggagagagcagcatgcagagtccagctcacatcgggagcaaagaattcaggaaggggatctggctgaagaaggaggggtgctccatgagggtgacccttattcatcgtcctataaactcatgtcgagctcctcccatgtgccagttaggcccgaccctcagtgcagcaaatgccaagattccaccctgctctcgagaatgataaaagtgactccaatatgatgaggactcgtgatgggtagacactcactaagtaatttattagagattattttccttaagcatcacaataactctgagaggtatgtactattattattctcattttctagatgaggaaactgagacccaaagagattaagaaatgggccacgagtcagatagtaagagctgggattggaaccaagacagtctaatttcagagctcgcaaactgagccacatcactgtgaggatctactacttaggccactgtaggatttaaactccttcccccctggaatatattcctatcccccacactcctcctaccctcagccacaagccttgccacacttcaagtagctagggttgtcacaagcctctgcttccacctgacggatcagccaatggagatggggtagggggcaaggccatagcaggggctgcaagtttttcagcatctttagggctgtagctccctgtcccaaatgctgccattaaaatcaaggctacttagactgggagaaaggaacggagccaggaggattatttttttctatttctcctcatacccaggccaaactttctcactgctaaaacataggagacaattaccctgctggggatctgggcttagatcccagaggttgccttagcacctggagcttagagagcagccacatccgagctgttgcatcggaaactctacttgtgactcttgcaatgttgaagaagctctgagagtgcacagacagcgttgtcttcacattcgtatcacctccacccactagcctgagtgtctctgccggctgcgcattgggctgggtggagaggaccacaccatttaaagactcaggttctagaatccagcaaagtggggttcacctgctggctctttcacttacagctgtgtgaactcagatgaatgactgttcccctttacatccagtctccttatctgtgaagtggagggaaggatgcccacttctcagggtcaccgtgaggatcaaatgagctcatgggtatgaaccatgtggtacatatttatagatgctcagtgtgtactcattcattttaagattcccatttcctgccctctaccttacaaagcgataagcatgagggtatttaaatataggccctgcagctgggactaaaggatgctggacatagcagaggaacaggatgaggacctatgggaagaattttaaaattaccctttccctggggcatgtgtctcactttcagcaacggcataccacctggtcctgaaagcttacatgtgcttgaccaaaagagtggaaaaatgacttttacgtgttttgcttttggagaattctacttgtaactcaaaatctcagcaggcaaggagctaagaccaggttcctgaacctgaagcacagttcactaattcgctggttatactagcacttttaagtcagcaggagacaaaaaaaaagacaaagggtttgcacactccaaatgttactatttaaatagccagtttgccctctctggggacatattctccattcataagggctgggaacagactgtgtcacccccttttttttaatcagcaatgcttccctcactgctagccacctggcctttctttaaccccaagctgactcccgtctcaaacccatgcaatttccagtttgccagacaacagtcctcacttctcaggacctaccattaagcagcaaagcaagttggagtttgaagattccagtttgggtcactaattttactaagctctaagagtcattatctctccctgagcctcatttttccttcaatggaggaaagcagcccttacctcctgcatgaggaccatatgtgagagtggagaataagagagatggcagcataagaatatagcacgagttcaaagaaaacataataaacatatatagggcatcagatatgttacaggcactgtgctaagcacttaatatacattatcttattccaacctcacaaaaaaaaacaacgattatcttcatgttagagattaggtaagtgaggttcaaggaggtggaatcctctctcacattgctaggaagtagtgaggccacaattaaagccctaatctgattcaatctagagccagaattcttaaataatattattcttcctagtgcccttaagtgactggtaagaggctcaatttactaattcctcagtcattcttgcaatgataatgatgattggtggtgttatccatggtggggaagagtttctatcatttctatcacacctgcaagaggagggtgcattgtgagcagccctttctggtttcatctgtgaccacctgctctctttgcagtccatctctacaagtgtgcagcccagcgggagagctgcggcctctgcctcaaggccgaccggaagtttgagtgtggctggtgcagcggcgagcgcaggtgcaccctccaccagcactgtaccagcccttccagcccctggctcgactggtccagccacaatgtcaagtgctccaaccctcaaatcaccgaggtaagtcctgcaagtctctagagcaggaaggggtggccaagagctgaccccaagacagtgggagaggagtgcaaattgagactctgtggacaaattattggcgtacagtgagtttaatgtgggggggtgtaggaaacctctcgcgtgtgtcttaacggcccctgtctaggtataagaggtaagtgtatggaagcgcatcctcatgcctgcgcatgaatgtacaagcgcattggtgtgcacgtgcacacgacaagggaggcagagccaacccagtctccctgccaggctggctgagccaagtgaggaggagaaattggctccatggtgggtgaacatttcagaaaacaggtttagcttttctcagcagaaatgtgatttcaggagccgcaattagctcggagttgcaaagctgaaaatggaagaagagagtaaaggcaggcactacattagccaccgtgccatttcccaggatttactccccgtcccaattttttcatgcattttaatggaaagaaaaggaagttaattatcctggggaaaaaatgatgtttccaaaatagcaaattccaaaggaagatgatgtggatgaaaatgcaattgcttgggtttcaaatggcctgggagaggagttgctgtatttaactttggttgtgttctgtgctccctcttcactgctccctagtctataactgtcactcatgctttgaaactaactgcactttcctggtggtggctaggaataaaggcccaggcaggtacccagtgatctgcatgtttaagaaaggaggaagaggctgctccttttctgcctcttccctgagctgctgcaccatccttttccctgcttcattttccctgctggccaaggaaagcaactctggtcctcacctatgtcacagaatattgggaaacttctagaacgtctctatgattatatcaaaaccccagatcagttttaaaaagaaaccctcaagatagaatgggtgctgctaacctacagataggttatttgaagaggtagaaattatttatttaatgtgagtaaattacatttaatcctcacaaccaccatgggaaataagtattctcacccccactgtacagatgaagaaaatgaggctcagagaaattgagtgacatgcccaagtttataccgctgataagtggcagagccaacatttgaactcatatttaattataaaaccatttttaaattctttacaatattcccaagtaacataaaagaagaagtggtgcttccccttccttcatatccggacctttcatagaccagatagatgcaatccatccacaagacaccatatcccggacaatgcagggctgtcggtgggagagctcttactgcatccaggccctcattcatctgtgcagagaggagttaggagagcacagacactgcctttcaaagacagagctacttcaatcccattttattcttgatcgtgaccagggatggtgcctcctgactttctcctgtgtctttatgtctctggaagagaatgtttgcaggggctgttggtggtgccccagcctctgccctcagacagctagcttcctgagctgctcagggctccgtgccttccccctgattcgagtgatttccggccactgctggcctgagaacttgcactgttctgtaattcttgctgctgcagttgtcagtctctacatctgtgggcacccatggtgtgggggagcttaaattaggcagagacttgcttctatcagcaccacccgcctctgccagccccagcagctgcaccatccactccccaactggctggggcccctttccagccgaaggcaagcttctcactgggaaacctctgcctcagccgcccctgctcgctgaccgggggctgacgggctgctctgttcacagaggacacccaggctacgcgaggctaattaaccccccgaggtaattatgctgtaattgattttcccagtgaacatatcagcaggcatcagaggccccaatctcctgctggtacttttcaagtcaaggctgttgtgaaatgaaggagcatctttggagagagacaaatccatgctgtgtcccaagccactcgggggaggtcactctgaacaggacatgggggagggagcatccaggcctggaatgttgtattcatgattatctggaatattttctttcatttcattattttcatttcaatattttttttcttttcattttctcctacccctaccccatcctcctttccctgtgaaagtcattgtctctttctttaacttttcattcttgaaataattttagacttataaaaaggtacaaaaatagtacaaagaactttcatatacccttcacccagatttccaaagttaacatcttacataaccacagtataattatcaaaatcaggaaattagcatggatacaataataccatctaataaacgtgccttattaatattctgccaattgtcccaccgatgtcctttttctggtctaggatccaatccaggatcccatgtggcattctattgtcatgtctccttagtcttttaatcctcagtctttttttgtcttttatgactttggtactgttgagaagtacaggctagttattttgtagaatgtccctcaatttggatttgtctaatgcttcctcatgatcaaattcaggttacatattactgtggcaaaagtaccaaaaatacctgtatggtacctatcaacagggcacctgacacaacttgaaggggatctcagaagccgaatctgggcaatttgagcaagaacataaaaattgatagccgtggatttcaccaatagaataagaatccatggttcttcctgaaaaaaagaaacaaacaagtaaataaataatggggggacagctgcagtggctcacacctgtaatcccagttctttggggagcagaagctgagaggattgcttgaagccaggagttcaagaacagcctgggcaacatagcagaatcctgatctctaaaaaataataataataattctaaattttgctgggtgtagtggtgcatgcctgtggtgctagctactcgggagactggggtgggaggatcacttgattccagaagtccgaggctacagtgaactatgatcatgccattgcactccagcctgggcaacagagcaaaaccctgtctcttttttaactttttttttttttttttttgagacagggtctcactctgtcgcccaggctggactgcagtggcgcaatcttggctcactgcaacctccacctcctgggttcaaataattctcactcctcagcctcctgagtagctgggacaacaggcatgcaccaccacgcctggctaatttttgtatttttagtaaaggtggagtttgccatgttggccaggctggtctcaaactcctgacctcaagtgatccgcccaccttggcctcccaaagtgctgggattacaggcttgagtcaccatgcctggccaagaccctatctctaaataaataaatagagagaaaagctcttctttacactagattccaactaaaaaatgtagaagtaattacggaaatagaaatcaccatttggcacagtacacaagtaataattgtttcaggcaaagaatggtcaatgaacactaaaattagtagatgaaagtatgatgagaaataggatatttacataaccttaagctaccttcccataagatacttgttaattatgacaagaacaatagtgactgggcagtgaagaaacgtggtagacctcacctaaaccaattgatgaaagtaaacaaagccagtaatgggaaaaatcaacctcatgtacctttcaatagaatgctctgagaaggacacaacctcatttctatggtgtttttggcaagaatatgtaatttgctaaaagcaacctttaaggagattttcttttcttattatttttttttttttgagacagagtctcactctatcgcccaggctgaagtgcagtggtgtgatcttggctcactacaacccccgcctccgggttcaagggattctcctgcctcagccttccgagtagctggtactacaggcacgtgccaccacgcccagctaatttttgtatttttgctggagacagggtttcactatgttggccaggcttgtctcaaactcctgacctcaggtgatccgcccacctcaacttcccaaagtgctggatttataggcatgagccaccatgcccggccaactcattttctttacttcagctttcttggctaatccctttgcactggcatagatgttttccccaaacctctgaatcatcggacttccatgaggcccataccctttgatgcagacctccttgtccccagccttcatcttcagaatgggtgtcctccttagtgcagccactctgtgcagtaaatagaagccatttactacaaagatccttcttgaaggatgaaaagagaaggattctaagatggcctgtgatggcagttgggggtggcagaatctccagtcctggaaataagtggaagctggaatggatgctgtccttcctgggacagcagagaaataaatgagatgatctcaaaggagttctacgttagaaaaagaagtgggctcacgcatagttagataaacagctgtgttattccttaacccctccttaccccatcttctccatggcaaccaggcccacccgagggacccatcttttatggcagcttcatgtagaacaagttgtacaggctattgaatttcacagtttgcataaacttcaggttaggaccccctcaggacttaccttctgctcctcagccagctcgtggtgtgataatgatgctgtcccccatgggaggcctcctgagctgctcccatttccagctgtcatcgtgggtgtctgtgcacgtgtcacctgttcaaccctaggaacaggagacgtgcagaggattggaaagcccatgagatggctggcccgccacgtttccgttcccccagcctatgcttcaggacctgctgggacctcaaagaggagggtgttaggagccacagactggaaaggaaggcccagagaaaaacatttcttaaggggccatgagtaggcaggatccagcagaaaaggaagagactgaatattttctcaggaagataaactcagggagggtaaagggattttggagctcacataacagaggtcttcttcactccaagcgagtgtatcagtttcctagggctgccctagcaaagaaccacaaacaggtggcttaaacaacctgaatatatttggaggtctgaacttcaagatcaaggtgtcagcagcgtgggttccttctgagcgctgtgagggggaatctgttccaggtctctttcctggcttctggtggttgctgggaatctttgctgttccttggcttgtagaagcatcaacctgacctctgccttcatgtccacatggcattctatctctgtgtgtgtgtctgtctccctattttttttttttaaataaagaccctgtcatattggattagtgcccactctaattatctcattttaatacgattacctctttaaagaccctatatccaaagaaggtgccattctaaggcactgaattaggtcttcaccatatgaattttgaggagacaagagtcaaaccataagagtgagcattctgatcagaggggggagatgccaccattccaaatatgttaattcactcattaaatgaatatttaattaatgactactgtatgccatgaactatgctgggcttggaagttgtctgtcacatgtatatgtgactcctggttaaggaggctaggttatgcagcctcttccaatgtagccccagcctatgcttgaacattggccacctggaagaggctggaaactgactgccctgcaggccattgtgcttcctccaaaaggcctagggcagacttctaatctccaccctctgcagttgtgtcctgtgtagaaggactgaagcagggatacaggtcttctgttaatgaggacactaacctcaggacctcaggcaagggacatgagcagaccagccaacattctaattctgggagtcttcatgataattgcttctctttaataagactctcccatgtgccaggctctgagcctactccttcaaacaaccctgcaagttggctattattatcttcacttaagagttggggaaacagttcttagagaagtaaagaattagcccagtgtcacacacacatctggttagtggcagagcagaaggccgacttcctccaccacaccatggtgagggggatggagggctattccttggctatacatttccccacctcatcccaccccaagagtacctaaaatgtctctgcgtgcaggatcagaatcctcttggaacttaccaagagatgccagataaattgggaacattggctaccctttgtactgagccttaaagtaatcttcacctaactgtcttcctaaatgtaatgaggtccacacttactcctatgagtgggaggaaaaacaagaaggggatattggggcatgtgagcttggggcagtcatttcttgccttttgggggaagcattattctaacctctaccccagttatttcttgaagctatcacactcagttgggttgtttttttggctatgcccaccaatgagatggccattaagctaaagtgaaagctggattccctggcctggcagctctgacctctcaagcatctcagcctaatgggagaggccagacaatggggcccaggtagttcacacttgcaggcaagaacagagatcagggtgaagccaaggcaaatcaggcttaagatgcaggagatgaacaccagagttggtgtgaccaggaacccaccacccttaagatgtgaaagaacatgactgtgtgttcctgaagtcacctggcacattgcaccataaggccacattgatgccaggcagtgggggtgttagtttaacagctgtttctccaatgaccaccatgtagcttttactttgtgaatttttcagcctcagtaacttctccaacacctccctagtccatgcttagggaatataaattctctttaacattatcttacgcatcttaggtacgtgtaactgagaaagaaaatcaattatagaaaaccatgtacactggcctccaaaaccaagctcaaataatttttgataccttaatagtttgagatgatccatcactcctgctggctcctgttctccactttcacaaataatttaaagtagattggtttcgcctagattctctcagatgcaaatgcatttgtgaaactgtttgggaaactgtgggacatttaaaagtatttatctgcaaggctgcaccaaatctctgcaggaaaggccaaaagccacctgcccaggaccagagtgactcactgcaaagtcccccacaaataaataaataagtcagccagctttcctgagaaacaagccggcactctgatctttcgttcatttatttgcaggcctcattaatataacatcactgcaacaaacagctaacaggggatggtgtcaggatgaataatggagttactctgctgagataacagttaggttttgaatgtactatcagctaagacagagccagcaaggattcacgccgggcaggagagctggcaccgccaatgccatagattcctacagagctcgtcagctgggctctagcctactgtgaggagtgcagacacaggcacacacacacagacacacacacatacacttcaagtggaaaagaatgccacaatttgctttctcagacccagcatccaggtgtctttagaagccaggagggaatgaaaatgtgcagccacgaagttggcatcactgccctgtaaagtcaaaggagtgagaggattaggaaagagaggagaagctgtcaacacatcctcgacttgtcctcactcgttggtcctgattagggggctcctcagggcagaaccctcctgaaatcccaatctcagacacaaaagcttttaatacagagtatgaacatccgctgaggatgctgatgggactgagaccattctggagtggcttcttcggcacctcttctccttctgggaggctctgacattagtttctcctgtatccttttacaaatccagtgttggggactgatcacctgctggaaaccatggtgagagctgtgcaggcccatagaggggcagccaatgccacgctgggcaatgtccccaccaaccacctcccctcctcgagtcagcctgcctgcccctgccctgagtccccaccaagaacaatatgcagaggctccacctgcacaggacgctcgtgaaaacaaagctacttttcctttggacctcagctaacccagcttccctctggatttcttcatcataaaacagtcatgagaaaaatcatagctaactttcactgaatgcttagcttacacttagctcagcacccatatatcatctcatttcgacctcaaagcaactgttatgaaatagaagttagtattgtcattagacccattttacagatgagaacactgaagcactatgaggtctgataactttcttgaagtgacattgagaataagttttagcactgaaatttgacctgcagctagctacttgactcaagagcccctgtgtttgaccagtgtcaaaccagtccttcatctctttcctgagctcacttggacaaattagaactgtcaatctgcagagccagaggagagaaaggagctggcacctagctcttcctcaagcctgctgcagaaatgggaagaaagccagtagtccccaatcccagcattgtttggggagactagacatgcacaggaagagacaaaggggcaaggccaagaggggagtgtggatattgcctgggtgaggtcagagaggagtggggatggatgctgagaagttcagggagccagagagagcaggagtaaaggcagtgaccagcaaggccaactccagagctccttggaaagcagcaaggcatggccttagccatgtcttaagtcctggctatgcacttcttgatctgtacatcttaagcctgctgcagagatgggaagaaagggaaaggggctggagtgcctaagcagacagaagcgaagagcaggccagggcatgcattctcatggtggttgaccaaggatgggggtgtcccctggggcagtgctgtgtaaggcaaaaagcagcggttagataaacctggctgagctctgccccactcactgtggaaccttcaagaagttacttaacctctctgggacactatttctcatccgaaaaatgggaatgataataacacctcacagcttgttttgagcgcttagtgggataaaatatgtaaagcccctggcacaattccttactcattataagcacttaacaaacgtgaaagcagcagccatcattctcagaatcttcaataccttggagctgaagccctgcttctggcttctttcccgctatctctatcagcctggagatataaccagaggaagatagggtctctagaacgggagctgggctttgtgaagctcccaccaagctcctctgccccgataagcccctactctgaagttggccccaaccctgccctgacaaggctctgcctgaggctgaacctaggaacagcccacctgagcactcactccccaggctgccaagcccctgggccttccagcgcctccccagtgcagcccttcgcatctccccagctgtaattaattggctgcatctgctctcacccttgggctgctttgtggcacagttccctccaaactgttcaattagtggctgcaagaatgaggtcgggtgcagcatcaccgcggctgctttccaggtcatggcacccacggaggaaaacaaacatgacagggtctggcaggaatacagatttagctgtggtgccctggcgctctcctgggttcagttgggctgtgcagctgtcaaggtggggtctgagcaggtggagaagtgactccctaaaccagaagttcctggaagctttgagagggcctcagcagaagataggaatctgctacttagtcccctgccatcgtcatatgtgctatgacctaggcatgcctgcctaatcccacatcctgctgacctagtcttcctggcttaagatgtacagatcaagaagtgcatggccaggacttaaactagccacctttatacctgggcgtggtcactgactgctcctggggcagggtttagggctgctagcctgagctctctaccctaaagtgtttcccttgttttccttctgaatcctgcaaacgatatacacactttttattctacaaccagtcaatagatatcagtgctcttaaggccaagtaataacacaacttaaaagtcccattaagacgcaaatacagctttccgtacttgctgtatacaaatacagaaagggaggagggaacagctgaatgaaaggtgcctaaagtgggggaaagaaccccagggaggaaaacacaaaagaacatgggaaagataccaaatgtttatcctccactgggttttgcccagggccagcctggttaatggcgtgtgtgacaagcaaaggaagtcatcttcgcaggccctccttactgcacatcaatcaatcaggcctttgctgaaggcacgacccgagtgcgggtcactacactctcaaaagatgcatagaaatccgagagtccacagaaaagcatccaaaatgatcaaagggtttagaaaccaagatcttcggtgaaaaggctggaaggactgcagaagcaaaggccaggggtgacttaattgctgtcttcagtagctaaaagatgtttgatgaggaggcagctgttcagtcctccattcgatgaggaatcaaaccagaaattggcttaaattaaagcaagggagattgcaggaagagctgtttaatgatcctgatgttaaaatactacatcactctcaagcaacagttaggtacctccactcatccagtcatcattaaagaatacagtctgttctagtgtctggttgagaccagcatttccttttaacagagaattggggatatttattgacagttactcgttccaggcagcgtgctaaggattagtttcctaagaaaagctagatagtcccttgtcccaagatagttatcgtcttattgagggaataagcagttacaatgcagtgtggcaattgtggtcctggaggtgttcatagaaggaagtgggagggtagaagaaggggctagtaaatctactaagggagtccagggaggcctccctgaggaggcatcttttgagtagagacttgaggatgggtaggcatttgtcagtggacatgcttgaccagcacagggaacagcatgtcaaatgcatagaggctttacaccctataaagctatagctgtgggggcccttgagctctcccagcgagcacatgtacagtcatgcatcgcttaaccatggggatacattctgacaaatgtgtcattagacgatttcatccttgtgtgaacatcatggcatgtatttacacaaacctagacagtgtaccctactacacacctaggctgcaaacctgtactgcatgtgactggtcctgaacaccatgggcgattgtaacacaatggtaagtacttgtgtatctaaacataaaaatgggatggtaaaaatatgatataaaagattaaaaatggtacgccatatagggtatttaccatgaatggagcttgcaggactggaagttgctctgggtgagttcagtgagtggtgagtgaatgtgaaggcctaggacgttactgtacactaccatagactataaacacagtatgcacttaggctacactaaattcattaaaaaattgtttccttctttaattataaattaaccttagttattataacttttttttttttttttgagacggagttccactcttgttgcccaagctggagtgcaatggtgcgatctcggctcactgcaacctctgtctcccggcttcaagtgattctcctgcctcagcctcccgagtagctgggattacaggcatgcaacaccaagcctggctaattttggatttttaatagagacagcgtttccccatgttgctcaggctggtctcaaactcccgaactcaggtgatccgcctgcctcggcctcccaaagtgctgggattacaggcatgagccactgcgcccggccagttactataactttttactttatagacttaattttttaaccttttgactctttgtaataacacttaccttaaaacacatacattgtacagctgtacaaaaatattttctttctttatatccttattctataatattttttctatttttgaaattcacttttttactttttaaatttgttttgttaaagactaagacacaaagacacacatcagcctaggcctacccagggtcaggatcatccatatcactgtcttccacctccttatcttgtcccactgtgaggtcttcaggggcaatagcatgcatagagctgtcgtctcctatgatgacaatgccttcttctggaatccctcctgaaggtcctccctgaggctgttttccagttagctttttttaaataagtagaaggagtacactctaaaataacaataaaaaatatagtgagtacataaaccaataacctagtcatttagcatcattatcaagtattatgtgctgtacataattgtatatgctaggctttcctatgacttatgactgccacaatgccacaaggtggtaggaatttttcagctccattatgatcttaaagaaccatcgtcgtatatatggtccgtcattgaccaaaacgtcaatatgcagcacaagactgtagtccataagaggacagggccaggactctgggggtcccaagtgtgaggggcgggcagaggaggggcacacaggcagtgccagcacagcacagaggggaaagcctcagtgacccctttcgccccaacccaacagcagcaggctgcttctaggatattctttctccaatcccctccttctagctctcacttctgaggtccacatggggagaattcagatagacttctagtccacagtataatatggggagaaaagcttggggctgaaatgagtcagtatccaaagatcttccctgctgatttgacaggtttcacttcccttccctctctctccacatccccaccacacacacactcactcacacacacacacacatacaccccccaaactgtcaaatcatttgtttgtgtgggtgtctcattcagaagtacttccctgaaagcattaattgagttcattgtggaatgctgcacctaccccagaatggctgatagccagggaaagaagaaatggccacaagggagggaggaaagaataaagaacatcttgtacagggccagtgttcttccaaacttattttgggtgaaaggatgatgtctcgctctgaatctgcttctgtgcagggcccagaactcaccaaagccagggccctgctctggcggcatcactactccctgcccaagctcaggcttcgggcattctccaaacggcccatgagcagctctttgtaccccgggtcaccccagtgtctgtgatgcgctccctcatccatgtgctgcccttccagacggataggaagacttccatcatctctaaccctgccaattctaacatcccatgttttagtcatctaggaagacagaggtgcagggaaacacagggaaggagattaccaattatcaagacctactctctaaaccagcatactaagaactctccagatgttatctcacttaatcttcacatcatccctgtgaggcaagcattattatctgtttttgaatgaggatattgagattcaaggtcacataacttgtaggtgtcagagctggtatttaaattcaggtctgtctgattccagaggttactctcttccttctgcagacactgtcccagcatcagatggtctttcttccctatccgactgtagccagcagcatagagctatctgaaactgaccaagacatggatctgcctaacatgctggccatactttggtttcccttctgtcattggggcactctgtatgactccaccgcagcctctcatcctcacctctgtgggagacaagctctcccctcccctgcagcctctcagctccttccagatctagaaggacttgcttaaagtcctgcaagcagtagctggggattcagccaaattgcccctctatagatccatgtagaaaggccagacttggcttccaggagagccaactttgtggaatgcaaccctgggtgccctgcaatcaaaagctgcttttaagagagagccctggggacacagtctctgtgtgtgttgggcggggctggtgggggtcgggggattgggaccctgcagcttcctggtctaaggtggtgtcctgcaagatcctgctcactcccgctctggagaagaaattctttgtcaccaagcctcccctccctggccatctccgaatccttgatcctaagaagaaatacagaaggcaggatgcagggtccttgcttcccgggcccaacacagagatggcatggcccttagactcattctcagctgcctggaaggcttacagaagctgccttctacagggtgcctctctctgttcctttgcactctgcacacagacctccaccttgagccactctgatttttaagctggaggtgaatgggtaacatgtccaaaggctcagggatttttaaacagcgtgatgtagaaaggaaccaccgatagggcagggcatgaaggatgtgctattgaatggaaagtgtggcagaaggggtaaaagggatcagaaccagaaagaccacacctgccaggccagccttaggaattagggactttgccttggcaatggtcagagccatggaaggtttttagagcaagtgactagtaacctggtcaagtatgtgttcatgaaggtcaccctggcagctactggaaagtagatttacatgcaaacccttggggttagtgtgggtaggagatgatggagtcctcctgaacacctactctggaacacatggactcaaaagacacctgggagtgagaactgatagggcctggcgaccttctttattatttgtggtagatgggagaaagaaacagttgaaggtgcttacagaattcctggctgggtgcatggtgagtccattaaccttgaaagaggatctgggagggtaattggcttgggggtgggaggaggaaaaattaagagttcgtttttagacgtggtgaaatgtgaggcgcctgagggagatacatggggaagtggagatgcccagtagcaattggatatatggctgtggagctcaggagaggggcctgcgccaaccttatggatttggaagtcatcagtaatggaggcgttgggaatccacttgcaaatcaaataatcaccacttcatctatgttttggaaattcaggcttttacacgtcagttttgctttaagcaaggaagctataagctgtgtctcctgtaagccccagagcatgatagttgcttagttgtctcctgaactcccttgccacctaccctgggtgctggcagcatggtacactgcatagaaagaagacccccataaagaccctacactccccagacactttccaagccctgtggacctggtttaatgacccacaaggacactcattctcccggcttggattcccccagctgctagctggaactacccatctcacttgtatcttcatgccaagattataatgcttgccaataatttacccaaaaaaagtcttcttctctaaacaatataagctgaattatgcctctgagcagctctgtgctaacaaatagaccctacagcaccccagtgcccacgaccatgtgtctgccactgatccttgaatgttggaagggaaacactacagtgatttaccagcaggaggaagctaccccgtggaacctgccagtgcctctgaggatccacaatgcggtccccacatgctacctgcaagacagaaatatttttaggctttccagaaagatttcatttcacagtttttctgaaaggttgtaattaactgcagcgagcaaaagaatgttttttaagaaataaaagtaggggaaggagaggttttgtcagttcctttgggtaggtgggttcatgccatccaggtggctagggaaggggatggaggggctggtgaagctcattccaagtggattaaaagagaaccaggaactaaaagcaaattgtctcctgctgatgctctcctgcagcaggtaaggaagcagccctttccatttctcattaacaagggttcttttcccagagcccaggagtcccaggtccctgaggaaactgtgccaggggagactggaacagccagggtggattattgttgcatatttttagagtgcagggacagatgagctatagtggctgtcagttcctcctgccagctccttcctctccaagttgtccttccttctcccaccctcacccccagcatacagagacacctctgagcccccttgactatatctcccttgattcatttcatgtgtgctgtttatttttattcataagggggatattttattttcagacaagggagtcagagccatagacaaggtgacttggataaaataagcctccagataagagcattcagggcctggatgggacagagggaaggaggcagcaccatctttggcctacggaggatagacaggcaggaggtctgggttcaagtcccggctctgcagccaacttgccgagagaccgggagtctgaacagcatatcagctgggcagtgagggaaggaggcatcttttctctgctcactatcacttggtggttggtggctgaattggcagcacaattcatggtgcccacatcacaggaagggagcagtgcacctgccgagaagccaggagataagaagggtctccagatcactctacagcatgctcacctgtactcatccatcatctccacctgagggtacgctgaccctcccaccccatcggacactccaccagcacatacagggtcaagagggagactgtccagaagtgtccaaaaacagagaggctgtggctctgcccaggtatcctcttctgggagattctagaggacgctcgatcttcatcaagtcccctttttttttgctccttccttcatccatcctgccctccctatggtgtagtaaaaagaacactggacctttttacaactgtgtatacaagttgttcaaagctttggatatatccctgacttctctgggtctcattcgtcttgctgtaaaaagtaagtatcttagaataagatactctcagatcccttccagttacgaaattctgtgttcctctgctatctaggattgagttcacttcgagttatttttcctacttcagataactattggccacaaagtgtgaacttactcactgggatctgttggatcccaaagagctacatttttccaagagcctggtctgttcccagatagaactttattacatcttgagagacctggattctgctattctgtttccagtgtttggggtctgaattaaggaatgaataaataagcaatccttgccaacaggaagccagcaaagatttggaaaatcctaaagttatttcttctttgtcctagcatgtgtcataggatgttttttgcagaacagtgtcaagtgcactttccatctttgatcttctcccctgcagccacacctagtctctactccccacactcccactgctttccctctgtatctcttatccgtgtataccccaaatcagtggtattcatgaactgcctttatctcatcctcgactctaagtttcttgaggccaaatttcctgtcatattcatcattgtacccccaacaggctgtagcacacagcaggggcaataataacactgtcacaattacaaagccctctggtttccaaagtgctctcaagcacaccttctgtttggtgcttccagactccctttgaggttggcagaaatgattatacccccttcacaactaagaaagctgaagttcagagagattacgtgactgatcgcaatcaggcaactagtgaattagagacatgtctcaaaccatggttttctgccttgagtctagtattctttctgataattttttaaataagtagatgaatgaatgactgacttaaagaaccgaggaagcagtgtaaaacagaacatgatgtcaagatccgagataagctaaaaagtggacaaaacgcactcactcaccagaattcctggtggaggaatttaagaacctatggaggttcttaaacctccctgggggagggggaagggtgctgctgtttctgttcctgtgaccaaaccaaattgctaatcccatttccctcctgcagattttgacggtgtctggaccgccggaaggagggacgcgagtgaccatccatggcgtgaacctgggtctggacttctccgagatcgcccaccatgtgcaggtggctggggtgccctgcacgcccctcccaggggaatacatcatcgctgagcagtgagtccgccctggccagcccttttcccatgggagcttcagagtggagactggagactctcccctctcccttcctgggccttttccatgattgatctcccattacattctcctcccatggacctgccccagaagcctccccagggccccctcctccctcacctccaccctcagggggtctcatcctgtttgattccctgttccctgactcttctggcatcagggctccggccctgaccgtccctcattcagtctttgcctgcccgccagtgtgactgagcatttcctcctaggtctcccccagcccttcccctgtcagcccccattggaatgcatcctgtatggtgggctgcaggcaacaatttgtttggtgcgtggggctctgacagcagcttaatccgagcagggcctccgctggagcaaattcatttatttcactaagggaaatgtcagctggaaattagaaaataggcatgtagttgcggacaggcaaacggggctccaggagtgacatatgttccaatttggggtgttcatttggcagtggtggctgctgtggagttggtgggcaggaggtgggcacgaagctgggggtcagaggatggaaaaagggaggctacccctccaaaggagaaagcgggggagcagccaaatcattctgcatgatttatcagggaagttgggtcaaaccattctgattccactgtgaacacagctctgcagggggtactgggagcatgagcaagagcatgactttggggcagggacttccttcccttatcctaaccctctgccaggtcaggttgtttcctctgatcccccccaccggagccagcctttagtggcaaccataaaaatgacatcgctttatcttccatcagcactttgcagttaacagagcactttctcatccactatctcatttttaattggtaaggactctgagaggtaaatattgttatcatcattctgcaaagcaggagagagcaaaggactcatgagaagtgaaatgactttccccagttcattcagggcataagtggctgaggcagaattagaccttgagtctcctgacccctaatgcagggctacttcccttccataacagtgatggggcacgactcctggacaggagcagtctgaaattccacgaatcagtgtgtagctctgaggcttacaggccgtgattctcgcagggcccagagaagggtcagagtccaaaggggtgaattcccagactctgagggctgtgtgatgcctgccagccacagcagggagaagaaagagctggcctgatctctcagatccttcaggtctgatccttcaatgacagccttattcctgcaaggaatgagtcctggaggaaaggctggctgggcctataggacagagatgaggaagatggaaaaagggaaaggaaacaaatagtgcttctgagccaaaaaagaggtgaaagctgttgtggcaggagccagggcacccacagaggtcctcctggcagaccatctttacagagccccgcaccctgccagactaggcaaggtgctcagttacacgaccccaaatccacctcaacctcaaggacctcccttgggcccctggacacagacctgtatccaacttggtgagatgccacaggaatccaaaggaaagggctagggtatggggtgagggtgggaggtaaggcttttagctgagaagtgcaaattcctgggcaactggccctcagaatcacatgaggtttggaatgaaaccgtgttttagacctgcctcctctactgaccagccccaagaccttagcaagctgttcagtctctgtgaccttcattagcctaatgtgctgcccaaatgtaaggaatttcagtgctatttatgaaaggaaatgtactgcactcaccccacacccagggccacggggaagaaagtgtcgagagaagctgcacgtgaggctgtgaaaggagcctggggaggggaacaatccccatgcattcctgcagaggctggtggtcgccccagaaaaccaccacttcaggtatggggtaggcagaagacagagagcacaccccatgcctcgctggatgcagccctggtttccagctgtgccaggctcattaccactcccgaggtttcagagtttgctaacatcattaaagcctccatcccgggcagtgagcagcaggcacaatcgttacagatgtctgtgagagatgaatttggctaaaaggacccggtgcagagtcctgggcgcgggcaggattcgccagcacggtaatgattcaccatatgcttgtgctgcgccatctatcactcagcaattaggttaatgtcggttaaagggccccgcttagtcctgcaatcagcaccccacaggtctgtggagggctggatgattcagtcacaggaagtttcctggaccatgggatgcatgttgaggctgcagctcagcccctcctgggacaggggctccacatggagcagattccccttagatcctcaggctgcttccctctcatctgctgtacctgtgaactcagccattgcgggatggatgtgagatgtgtgtgtgcttccgccccagggagcgaggcaccatctatgcaagtctatgggaggtggtgtagtgtggggcaagggtactgggttgcattccaggagactggtgctcaagccttagctcagctgtggatgaaccaggtgactttgagcaagtcactttgctccctgcttctcaaacatctcatctggaaaacaggtatttaggaatagatgatttctacatttgctttggtggtcctctagatgtccaaaccagtaaatggtatgccccatggaatctgcagctcccattgtaaagattatctgtggcactaaggtgcctccggaagccccctgccaccaggaggagtcaggtcttcagatgtcaaagctggatggctgtttggtccaacttcccattttataaggagagaatctaggcatctccagcgattgtctcctaacaatacatagggaccccagagccaccagagacacagggaggagacagggaagacaagaggcctcaagaaatcaaaccacaagaaatcaaccaaccttgctgacttgcaaggcttgaaggaggtggtggtgcacacaccactgcctatggttgtctacaaccaagaaggtagaggggacaagtggttagctctcagaacctgaggaacccagctcagcctttctcaccacccctgccaacaacctcacctctaccattgctgccatatccatactgtcccttccttgaaagacatacagagcatcccattaaatctattggcagtagaggggagtggtcagaagcatgagctctggagtcgagctgacctggatttgaatcagggctctgccacttaccagaattgtggccatagataagtcacttagcatccctgagccttagtttcattgtctgtacaatggagataagacccgctctgtagcagagcctgaggatggcatgagatcctgtcttgtagagtgcctggcagaatcagtaaactgtagttcttattattattaagggctagaatttgctttggcataatactccttcctcaatataaccctttccactccctgcagctgccctagcttcttcctttaactccctatcttcctgaactcaaagaacaagtgcctgcaacaaatattttcaagccctttccaccctggcctgcaggcactgggtcccaggaatgaaagggaagaagagttgaggagattagagtttgtctgcaatgctgcctgattttcttaggactctccagttcttagatcttcctgcccagacccttttctacaacccactgctgaccacagccctctgcccactcattccacagctgagaagggggctcggctgatgcccgaggaaagagacctatggccagctctgatttctccccagtgcagcccctggacccctgcatcctgcctttccaactacaggtgcccttccttgcacacttgagtggcatccatctctcagtcatcactcttctcctaggtgcttgaatatactgcttttcttttgaaacatgagccccaagcaggaaaatgtcctagaagagacagtgtgccaagaggccctggcccatcattagctccacacaggggcagctgaccagggctgttccaggccttctcctttcctacacagacccagggcccagggaagaacatttccatgctgcccgtgaccttcacatgttctcttttttcttttttccttaacttcaagcctgtgatgatttcttcctccttttcttctctaagatcactccagcagagtgtccgagggtgatgactgagtaacaagcacaccctcattagaagagagggagagaaacttacctactccctcctgttctcttcctttgtcttccccagcactgcccacaatagctagttgattctcccctggagctccttgagcatggtgggcatcgtttgcaggatgtcagggacctgaaacagcagcgggttgccagggtccgggaaacaggatgagagagtcgttaaccacacgcaggtagcagcatgaagataaccacacagtaccttaaattgagcttctcgaatgctcccctaatggggtttcaggagacagttacgtgtaaaatattaattgatcatcactatcatgtttccttgggtttataattaattgattgattcatagagaaagggaagagagactattcttccatatgcgttcagtactttcttgttgaatctaatatgctaaaacgtaataagacagttattgcatgttaagtaaatattcgctaggagtgaaagtagttatttgggattaactgttatgaaggagatggagatcagtggcgtgccatgtgtgtgagcatgcagcgtatttgtttaatgcaagttttattacatcgaaatgaaatctctgtttagttaccttccttcctagagaagctgttgagataagcatcgctcggttaaacacggatcttccccaccgtgccaggataatgctggggattagtggagatggggtctgtttttctgactccccactaagcaaacctaccaggagcaccagactgctctgaatctccgaaatgatgttgggaggaaaggaaaaatccttccctccattcccaagctctttttagctgagctgtcagggccctctcccacccagcccaggcccgaccattccaggcaagagtttccccaagtccctgatgccttcatctctccccatcctcagctgcccaccctttctagaagggtaccgtggctaaggcaaccagtatctaaatgtgcttgtgtaactgttctcaggcgccagggaagtcatcactaggggtattgatctgggctgctcgagagagagcgctgcacacttcttccctccagctctcccgttagtgtgagacgtgactttcgctcagggccgtgtcactgtctctcccaccgggtgtgctcagcccttgatgaagtgagaggccagtgtcacctgctggcctaatgaacttgtccagctcccacccctttgcctactgcggcaggactccacccctcccgttctgcagggagctccttctctgagctctcactatctcaccagattatctctcccctttttaaaactcactacaggaagcaaaccacaactgaatcggcttggcaaacatgccctcacccactcctttagggagtgtagcaatgtctgcttgttacataggagagagcgtcagctagattgctgccccgagatctctgttagacattccctttattctataaattctgggtccctacccaatgccaggcactgcgctaggcatggggaaccacagaaatggccacagaattaggcagcagagcatatcagaggcacacagggctttagagatgatccggttcaaccttcacactgtgcagatgagaccaaagcccagagagggaaagcactgtacccaaggtcacacagcaagatggatgaccaagctgagtcttggtctggcattattgcaagactgtgatgagtcatttgccatgactgggagagcaagtgaacagcgatgccagcccttgcccagtccctcaccagaaggtttgctttctccccaggattgtctgtgagatgggccatgccctcgtgggaaccacctccgggccagtacgcctgtgtattggcgagtgtaagccagagttcatgacgaagtcccatcagcagtacaccttcgtggtgagtactgggtccagggccaggtgcaggtgcccagggaggagacacacatgctccagactcctcccaggaagcccccactcccctccaccaccaggcttcttgcagaccaaggaggagaaaaggaccctccagataaggcaacttctggtcttgctgttttgagagcctgtctttccgggatgagatgggcatgtgataaacaaagctgtggagtcttgggagtcccagagggccacaggtcagagttctaaataaggcaaaatccagcctttcttagaaagtggatcctagactgggggcggggaggaactgcctcttgtcccaccagtgtaatatcttagtctaattctagcctaatgaggatgcatagcctgagggacctaattaaataagtctatatttatccgcatgctttgttttctgccaaggatattttaagtgggagtttagaagagtcactgaaatctggcagggatgtgtatctgcacaggaccaccagagtcactctgtatgtgtaactcgctactgtggttacacgcacacattcacacagtcacacctgaaaacatctctttatgcgcaggcaacaggtagtcaaattgcaaagactttctttctgtaatggcactctattcatactgaatcaataacttgcttctggggccctggagccacccagggctatattcatactgaatcagtaacttggcttcttcggccccgaagtctctcttctgacacctacattgctacatcgaatatttcattaaaaggcattaacactagcagatggggtcaaaccagccttgctgagagttttaaaaaatctttggagcacaaaattctattttctgtaaagcattttgctgattgtttcaggttttctagcctctgccttcttatcttggcatctccacctttttcttatactctcctctctcagactggacagtaccttgccctatctgcagccaacctactccatctcttacccagggcaggggcagtgggcatttgtgtgagaagcaaacacaggagaactagctggggagaatgtcagtactctgacaatctggagcaagtcagagcggagaggggctttagagataacctagcccaccctcctcacttgacagaggggtaaagaatgatctcagaacttgcctcaggacacacagcggatgaatggctgatgcaaactagaattcatgcctgtatagttgctcagttaaatgcattttccaattcactccactccactgccctccaggcagaagcaattcttttctgattcaggtcagccacctgatgcattttaggttaagcaattcttttaagcttcaggctgaattttactacttagtgagcttagtagaaagccccagccagtgatgcgccatcctcctgatgagggtctgagaagccatcctaacatttactgacagctctctgcaccaggtgccctgctgtgcccttcttatgctcagggaaggacagaagggcatgtgcatgggccattaatggaggactttagcctctcggtggcccaacccaggcagggatgctttattcagccctatcgattttgtgcccaaaaaatcagtaaaggctctagatagagaagcattttcaaattgttctcaatttgtaaacgaattgatagattagtcagtgtcacctctgctttcccttcattgttatgagcatgagactctggggagttaattaatttcaccccacatgactcttctgccttcccggacatgcccagagatgattcttagaaagagtctcacctctggggtaagcagagagagcatttaggattgaaaaggacaggacaagtaccaccacgcccagaatgaaaacaatctctcccatccttagatctaaccatggtccatccttttggagaaaacctaagctgtagtcatttctctgcttctttccaaagaacccttctgtgctgtcactcaacccaatccgaggtcccgagtcaggaggcactatggtgaccattaccggccattaccttggggctgggagcagcgtggcagtctacctgggcaaccagacctgcgagttctacgggtgagataaacttgaagggccaccagaagactgcacatctgggacatgtgctgttcacatgttactgtgcatgttcattcataggcctgccccatcacctccatgttatttgctacacctagacccaaataccataccggtcactgtgagaaatatatgccacttgtcagtttatatcccgtatatcaaaggggctggatacttctaaaaataatgagaagtgagggccatgagaacaccagatggaggaggctcctaggagctccccagtcaccactaggatcaagcattcattgagtcctcactatggtgacttgaaaaacacggagattgcatagcctcagttcttagaaagcacagacttatgcttagggaatcctctgtacataaaaaattgaacacctaccatttgccagcactcccctagccctgaagatgtagagaatttggaaagaatccatggatgagaacccagtttgcccaggattatctacctgataatctccttggaccgtaaattccacaagggcaaggactgtgcattcactgctatgtacagtaggtgctcagtgaatatttgttgactgcctgaccagattctaagcactgactaaatagttacattctagaaaaatccagaaaaaaggagtttccccgaagcccatgaaaccctatccctgcccctcattttcaaacccccgtctccaatttgctgcctccctaatccactggggcactgatctatactgatgcgggatgtgttccattgttgtagaatataaaaggatgagagaacacttctgtggccttacccgcagaccaaggaaagccccttgtcaagccagtgggcacctcttgttgcccatgcctttcttctcaaccctcctgctgtctccctgtcaggaggtcaatgagtgagatcgtgtgtgtctcacccccatcatccaatggccttggcccggtccctgtttctgtgagtgtcgaccgagcccatgtggatagcaacctgcagtttgagtacatagatgaccctcgggtccagcgcatcgagccagagtggagcattgccaggtgaggtggaaggtgggagggatgcacctggaagccacccagcatgatccctgcagcccaagtctggctcatgagagggatccctaaggtggaggttcaccatgccagatttgagggggttttttacctaaccgagcctctgcctgttttcagtggccacacacccctgaccatcacaggcttcaacctggatgtcattcaggagccaaggatccgagtcaaattcaatggcaaagaatctgtcaatgtgagtaactgttggtctgccccagcctttggtaaacacagctctgtgttgatgttttgcaatgggatgagctctgggttaggcactggagcctctgaatactggagaggaaaactggcttaagactctgagcctggaatcatggtccaaatacctaaaccttataatttttttttttttaagacatggcctcaccctgtcacctaggctggagtgcagtggtgcaaccacagctcactgcagccttgacctcccgggctcaagagatcctcccgcctcaacctcctgagtagctaggaccacaggcgcatgcttggctagtttattattattattattttagagatgaggtctctctcttttgcccaggctggtctcaaactcctgggctcaagtgatcctcccgccttggcctcccaaagtgctgggattataggcatgggccaccatattcagccctacaatgatttttatattataatgacagtacaatttcttgtcagaaggtgatatagtgagtgtatcaaagtactggcttctgagtttatgatacagcacaaaaggactcctgttttatgacaggttgactttgaggtccagtgaaaacccatattggaagtggttggagaaattctggctccagattcagacatgtctggagaggaagcagggttctgccatctattagctgtacaagcatggtcaagtcatttaacctccggatcctccacctctcagctatgaatggtgacaagcagacctgcctcagcttcataacctgccagcccgtggctggcataaggttggcagttgataaatgctagtcactgcatcagataactccacctaggttgctaagatgataagtttggacattttatattagtcttccatgcatagccatgtaatttttataatttttaaaaagttgtctgtatcgtagggatagaatgtctgatatgttgtcaattttttatcatttttctaggctccatctcactctttcagccaatattttttgaaacatgattgtatttgtaattatattatagcagatgctactatggccattatttttcatagaaattactatcattactgctttgaccttcaggggcttgactagactaagatggagatggagaagatggtgttatgtctcccctcttacccctgacacatttccagggtacttgaggcttccataagaaacacagagatacacaaaatgacagagtgttagaaggttagatatagaaaggtctcagggatcatctgatgcaaccccttcattgtgtagcagaggaaactaagtccagaaaggttaaatgacttgcccccaatcatacaggtgactggtggaagggccaaggtggatcccaaacatccagactcttcgtaactaggccacatgaaatgctggtgggcttgacattaccatcctgctggagatgttggggagcacttgtaccacaccttcagtatccaccatggtcactcctttttgggctaggtgagcgcatgcctccttctgccaggtgtagaacttgatccatgggtaaaagagcctaggcccccactccatttccagactgaagctcagggtccccagaaactcccaggtaactccagagtctagggtgaggtatgggaacaagaatggtaagttcacacccaggaaggatttaaaaaaaaaaaaaaagcaagcaaattaggtacatgttttaaaatataggttttattgttattcaggtatggcaaggccagagtataacttgttctactcatagatcaaatcccaagagaagagggaagtccatgccccaggggtcacagggggaagcaccagggttggtctgcctggaggcggagggagaaaccgtggcaagagtctttatgtggtttctgcaggaaggaacaggcatagcagggtaagcaagtttaggatcagctagtttgagtcattttagcaggctctggggcccagggctgtccctagatgtttggtgcctggtcccagaatgatgagggcatgaggatagtgtggaaaggggcagttgagctgtggggtctggattggttcgtgcatatgaaaggcacgctcacaggcaagttatttgctatctctaggattttgccctgggagggacattccctccccagtcagcaaggccccagatgtcaaagcatcagcatacagaaaataaaagacgtaattaatacagtccagagaaaattctggagagtgagtacgtgacctccaaaggcttcagccttagtcctcaggaagccattgaagagaagcctgggctgggaagcccctccccttccccacacctgacacctgtggccaaagactcaggtcccaagccccctgctccctcaccaggactcatttacagtactgggcaggaatgttctcagcgcttcctccagccccatgcaccatgatctcaatgttccaaggacttaagaagcagttctgccctctggggagctgggggccctcagtttcagtggtgacctgcctggtatctacaggctggcagacccagagggaaggatgcaggaatgtagatttccatcagctggctccagaatgggaggctcagaacccctgccctgtgcttctgctttcaggaatggtaggagagaggcactttgcccctgaagccctgcctggttgggccccagctcatcctcagcacacctgggcctacccctcatctttgggttttgaagctgccccagtggatagctaggagggccagagtgaagccgccaaacccagaggaatgtttggcaaacaaaagtgccgacgcagcacggggcaggcagcgtccagaggcctcttgcttgggagtgatttgcttattcatagaggagcctggtctagggaagctagactgggaccagcagagaggaagatgttggggtgaggctcaccaaggctcggtgtcttcttgcagaacccaggaattgggaccccctggctcagctgtacccatttcaccacacccctcaacctccccatgcctcattgtaccctgctggaacatgaaaggggcattaggttcataaggggctgctgaattgcaccacaaaaagggcaggaatgtgtactccctcccactacagcataaaggccgcagtgagccgctttgtttaaactcttaaattccctttggaaaggaagggttaagacttggacttgaagctctgacataatctctatgcaagtgtcagctttttttgcaatttcacacacagtcttgttttctgaacatgaagctcgtgtgtgtgtatgttggccagacgcataacatgtgtggacctgccaggacagtgtgtacttgagcagtctgagttctcagagatgccctggctgttgccgggaccccactgctcccaaagctgaaactgagctgtgctgggtgggagccaggcagagagggagtaggagtctgggtttttcttcccaagccccacgtgggccctttagtggtttctgcagtctggctgctgtcttgggcagccccagaactaaacctccacaggagagaatggcacagctcatgctaaggagggactggaccagcccagccaggattttagttggcaccagagacctccaagagaaaaaagatatcatgaactctgtgtcaaaaccaagcttctgtcccagtgcagggttaggggacacttggttagagaagagagagaggtcctacataaaacatttgaagaaggctgggcccagtggctcaggcctgtaatcctagcactttgggaggccgaagcgggcggatcacctgaggttaggagttcaggaccagcctggcaaacatggtgaaaccctgtctctactaaaaatacaaaaattagctgggcgtggtggcacgtgcctgtaatcccaactactcaggaagctgaggcaggagaatcactggaacccgggaggcggaggctgcagtgagctgagatcgcaccactgcactccagcctgggcaacagaacaagactccatctcaaaaaacaaaaaaacaaaaaacatttagagagttgcagaatcctatttttcatcagtattcaatcaacattaactgaacacctactacatactgagcaaagtgctcatctcgtaccacttcctgctccacactctacacacacacacacacacacacacacacacacacacacacacacactatgctgttctgtcctacttttttctcaaacatcccatgctcccttgtccccaggccttttggtgctgttccctctgcttggaacttgttcccttccccctccctctccttatctaggtaagtcctactcattcttcagattaaatttcattcatttcttccatgggaaaacttccatgagtcactcctaccctgcttcaggccatgcacacacacatacacacacacacacacactcatgcacacacacagacactcctagagtagctggtacttccctaccagggcatttatttttcacatctctgcatgcatccaacagtgctgtgtgccccccatgccccaggccctcttccaggactagattgtaatgcttctttgtcttccctccagactgtgtctgccgctctatagccccacctcctagcacagtgccagcacaaactagaaactagatgcccaaatagcgttggtgaatgaattaatgaagaagctaaaatgccccccactcccccaaaatttcactgccctttcctggagggctttcccatggaatggagacaagcaagtaaacccagtgacgaggcacaaaagcagagagagggtgggagagcggctgtgggcccctgggctctgtgccaggcactccgtgtgtgaatgctgcgctctggatctcttaggtgtgtaaagttgtgaacacaaccaccctcacctgcctggcaccctctctgaccacggactaccgccctggcctggacactgtggaacgcccagatgagtttggatttgtctttaacaatgtccaatccttgctaatttacaacgacaccaagtttatctactaccccaacccgacctttgaactgcttagccctactggagtcttggatcaaaagccaggatcgcccatcattctgaaggtaggagtgcccgccagagggcagtgccaccaggggcagcaatgccagagggcgcccctcgctcctggcctgactttctttctttctggctctcctttctatgcaattgaacttgcaaagctgtctccttcctacagaaggagctcatgggtagatatcgacccatcaggcgatatagcttgcacccaggcttcttaagaaatactttagaatatttctgttagttcttgtgagctttgggaaccagaggtactgcagtgagttgggagtaactgtttccttttctgtccactctgtggccacaggagcccacacacacatttccagaggtcacagtccctggcactgtccatccaagtgatttgttgccccactactttcgtgaaatcccatgcatcctcccccaaaattttctcttgtttagtgttttgtctcctctgcatttttcccactctcttcttcattttcattctctcctgcgtctgttttctctctttctctctagatcatggctgttagaagtcccctccacaaaaacttgccaaggagtcatttcctggtttttgcactgctgcccttccccgtctccttaatctctttttaagtaggcaattaacttgtgcgtgcatgtgtcaattatgcctataaagactgctattctctacagggcaaaaacctctgccctcctgcctctggaggggccaaactcaactacactgtgctcatcggagagaccccttgtgctgtcaccgtatctgagacccagcttctctgcgagcctcccaacctcaccgggcagcacaaggtcatggtgagtgagccctgcgtctgtaatgcctccttcccgcctcgtggtgcatgtgtgatctgtcctaaggaaaggctctcttctgtctcgttgcctgactcaccccctccatatctcctcatctctgggtcctacatcaaattgggtataagctgagaacacaagaaaagaaaggcagatgccgaggcaggaaattgctttttatctagagctgcactgtgtggttgtggtctgtcatgtccttcctcgcactgtaaggatctgctggcatgcccgggctctacacctgtgtgcatccatgtgcgtctgtatgtgtacaatgcacaggttcacgtgggcgggatggtgttctcgcctggctcggtgagtgtcatctcagacagcttgctgaccctgccagccatcgtcagcatcgcggccggcggcagcctcctcctcatcatcgtcatcatcgtcctcattgcctacaagcgcaagtctcgagaaaatgacctcactctcaagcggctgcaaatgcagatggacaatctggagtcccgtgtggccttggagtgcaaggaaggttagtggaagcacaccctcatttgctgggtccctctttctccacctgccttattgcccttctccctgcagacaactcctatctttactcccatcgctgccagccatgcctctgcattccactttcacccctgttttcccagaacttcttttgcttatagggtcagagatgtccaatgaagaatgcccactgcatgaggacccaggtccaattgcattgttctagtcccttctttgccctgacccatcccacaatctggcaaacactttctccctctcagggcctcaatgtccccacagtcagagtccccaggctccacagccccagactctagatcccccatgggagtgtccagctcttgtttttctgcacactgtcttcgcagcacgtgggagcagcggcagcaaaggcagacaagcacctgcctcatctcccccagggtttgttttccatcagtgctgcaggctgagcgctctgaaggccgccacttgctggtgtccttggctgtggacgtgtgtgggagtgcagattgtgttttctcccatgtcccacgcaaccacagcctcgaggtgacgagtgtacctggcgtcctctcaggctgaggacctggcaggctctctgggtaaacagctcaattaggaatgaaaacatttctccttttgctgcaaatgtcaagatcagaaacaagccctctgctggatgacagggaagagctgggctgggaaataggacatgtggagccaaggttcctcctggcaacagggctggtgagtttggcagaggaaggagccaggaagacaggtgtgccaccaccaaggtgaggcttctgaagcccttgccttcccaaactcggctctcagctgagcgtctcatgaccagacctcccctaggcttttgcatcttgatttattaccttgattagaaaagggcagcactttgcctgttctggtctttgctggaccccctcagccatggtctctcacctgcctccagcatctccgtgatctttactaaacggcccaatcatgatacttttttttccttgttgaaactacacttgtaatatgtaaagagaaaatttgaaattatagataagtatagaggagaaaataacataaaaatcacccatttccccaccacctaaaaacagctgggagtagccccgccctctggagacacactcccgtaatcctcagagtctctacaaaaggtcctcccctcgtcctttgcaaacttcttctccctctttctcctcccccgactggggcttccccacgagcctctccgtctgcttattctcatagcttttgctgagctccagacggatatcaatgagttgaccagtgacctggaccgctcaggaatcccttacctggactatcgtacctacgctatgcgagtcctgttcccgggcatcgaggaccaccccgtcctgcgggagctggaggtaatgcctgcctcctgggcccagccacccagcagggatgcaggcccagggtatcctaggaaatccagatgagactcagcagtactgagtaaggttagcagggaagaggggtcagtagtttgtaacagcatctcagcaacagagctatcaggaaggttacggctgagggggcacccaggctccttgggatggttccagggtaaagctcattgtttgtcattttttaattaatgactgaactaattaactaagatcctgcctcattctaaaatggatttaagatggcttaaagaaagacacaggattctatgaggtttgtttgttcatttgttggtttgttttactaaagataataaatcaggcagaggagattaaggggagactagtaaactgaagaagtttgagggggcatctcctattctatccttgggaaaatcaggcagcctcccctctgagagctccgcatggagcccagcctccccggcccagtgcaaggtcagagcagactgtcgaccttagagccagctgttcctacatcatcacgggtgagtggaatggggtggggttggttataggcctcaaacatagggtcctacagctagtgtcatcgccagcaggccctcagtgagaccctcaggtaggaggcccgatgcctgtcctctgagggcgtcgcctccaccacaccccaccccaggtacaaggaaacgggcagcagcacgtggagaaggccctgaagctctttgcccagctcatcaacaacaaggtgttcctgctgaccttcatccgcaccctggagctgcagcgcagtttctccatgcgcgaccggggcaacgtggcttcgctcatcatgaccggcctgcagggccgcctggaatatgccactgatgtcctcaagcagctgctctctgacctcatcgataagaacctggagaacaagaaccaccccaagctgctactccggaggtctggcccgcagcagtgggtggagagggtggcaggagtctgaacctggacagagcacctcattatagcaggccccacaagcagcatgagaaggcccactccccagaaggggcacccattcagagcagcctgtgtcctcacgtctctgcagggcagaatctgactttccctcagcccagggagactacagagtctgaagtcacccaggtgtgatggatgagctcagacccttgctcggatctcagctggagtcccagctctgcctcctgctagctctgtgatttctggccagtgttgtaaccactctgttgtttagtttcctcctagacaaaatgagaaaaataattcctatctcacagtctcttcctcccggtgcctctagagctgtgctgtccggcacagcggcccctagccacaggtagctgctacaaattaaaatgaaatagaatgtaaaatccagctcctccattgccctagcacctagccgctttctaagtgcttggttgccacattgcagctagtggccaccatacgggaccgcacagatagagaacattcccattatcgcagaaggttctattgcgcagcactgagctagggatttggacagcctagaaggccgtgccttctgagctcagcttcctggatctgaatcacagcatccactacacatgcccactgcatttttcctggcaggggagagggttggagacctcagtatcccctgagcccaccctctctagaggccgtggggagccgggcacagctttggagtcctctgggcagcaggggctggagggctgcacctccgttcaccacccctcctctttagccttcctctagcaaggtctcaggcttccaggccccacgtggggtgaggagggaggaagaatggctttgctttatgagtactgagcccccatcctgccaatctgagcattagaaactctcattaagaactgttgtatttaaattagagctaatctcaagcacaatgcagggagagggtgctgggaggagccacgggagaaagctacaattttttctgccattgtcactctctcccaggcccagattgctgagcagccctggcaaatgcctgggatttactgcaaccagaggatataatttgcaccacgtgcagggagttaaaatacccctccggcatccccttcactgagggtctgtcacagccgctttgttccttcccaaatccccagatctgtagccctgggatgggaaggggaggggggccagcccttgcatgagcaaatcccctgttggcaaaacacttaagcactgctctctacctgagggctgggatccaagaccccacatgacagcaataatgacagctaatggatagtgcttagcaggtgccaggcacttttcttagcactttacaaatattaactcattcaaccctgacaacaaccactggggttggatgttattatgactgtctccatttagtgataggaatactgaaaccagagaggttaaatgacttgcccaaggtcacacagccaacgtatggcagaatcaggatttgaacccaaggaagtctaaccttgagtgtttttggaggggaagggaccaggcaccttccagataggcaaaacagggtactcacacatgcaagaaagcccagagggactgggaaactctctagttatcaccctgaggccagaagtgagttgggagaaccggttctttatagccctgtgggatagtgaggtgcctttatccacagaccctgtctcagatgcagccaaagttcagagcaccacggaccatcagggctgaaaaggccaacctctccattttcataggaaattgaggcccagaaagaagccacccctacccccaggtcacagtctagttactgggtgagctgggctgggacccaggtgtcctgactcccgccctgcgttctcccatgctccattgttctcttgggagacctcatggcaagcccaggccccaccacggagacccctctgtgaaggactgccccttaccctttgtcccttccccaggacagagtctgtggctgaaaagatgctgaccaattggttcgccttcctcctgcacaagttcctaaaggtgagaaagggagtgagacggggcctagcgtccagggcaggatggcactgctgcttagatcctggccacagggctgcatggggaccccctccctcgggagcaggaacctggactggctgtgctaaagcccttccttccactggcctcgctccgagagaggaaagggaaaacgtacaaacctgaggaggccgtgcccacacctcctgccctgtctgtgcccacaggagtgcgcaggggagccactcttcatgctatactgtgccatcaagcagcagatggagaagggccccattgatgccatcacgggcgaggcccgctactccctgagcgaggacaagctcatccggcagcagatcgagtacaagaccctggtgaggaagccggaagctccgggcccgcctgtgtatcttctacttctgccccttgctctgccttctgtccataaaagcagtctagggggtcaataaagaggatgggaggctggtctggggtgagcccaaaggacaactaagtgtaccaagagcaaggtggcaggcccgcccacccatcccaagcactctatgcctcggtttatcctagataatattgggggagaaaaaagttcacccatcattagttattgggtaattggtattatgagaaagatgtatgttggttcctaacatagaggctttggggaagtgcatgactagtctctgatacatgtagagccatctctaaacactgagggtgcctcattccaggactatagtctcccctaagctgtccaggagctagaaagtagagtcctggtgctttgagaaagaagaattggacacaatgactcagactctcatttggcagatgttatgaaggtgagggaaactgagtcacagaccagaaaagtacccttatttcccctataaggagggtgaactttggaaaaagaagattctgaggtcctgaccctctccctcaaactactccttcaactcctgtcctgctcaccctctgtcccctacttgtagatcctgaactgcgtcaaccctgacaacgagaacagtccagagatcccagtgaaggtgttaaactgtgacaccatcacacaggtcaaggagaagattcttgatgccgtgtataagaatgtgccctattcccagcggccgagggcagtggacatggacttgggtaggaaacctggactcagagtgtgagggcaggggttgagaggtgaaggaagggaagctgccatgcacacaacccttgcaggggcatgactgtgtcctggccagctgaggcccgtgtgaaatgcttcccgctttgagcgctgcctgttcagatgtggctgtctctggggaggtctacgtgtttcctctgctgcctgggcccatggagccctagatgtctctagcctctgttattggtaccagcttgagggggccgggttgccaggtccctagagaaggtgcaatcgggagacactggctcacagccctcatccctctcacgccgctccctgcaccaccccctccacccagagtggcgccaaggccggatcgcccgggtcgtgctgcaagatgaggacatcaccaccaagattgagggtgactggaagcggctcaacacactgatgcattatcaggtgagagggggtgtcttttcccctcttcagcttcccagaatgttcccttcccgctaagccttgctctaaggcctcaaaagtctaaaaaggattttcctctccctgctttcctcctcctgctggagcatagaacagggattcttagccatggctgcccattggaattactgagggaactgataaaaaacgtgagtgaccaaactccaccctcagaaacagatttaacaggtctggggtaaggcctaggcatttctattctgtgtacctctacatttgcaaaaaaacaaaacaaaacaacaacaacaacaaaaatcaaatgcatattgcaaagccctccacatggacaactaccttaaggtacctggcactttctctctttagcatcttactaacacagcccacacctctgacttacagtggagcagggaattgaatagacttctcttcaggtcttacattcttcctcttagtagctggtgtccttgggaaaattactcaggctttcttgtctctcatgtgtaaaatggggctcctggtgaaccctgctccgtacagttgtatagaatagattcaagatagaaggtgaggtgtttagcacactggcagacacattgaatgagcagtcaaaaaaaaaaaagaaaaatcccagcaaaagaacacaagatcaaggaggtatctactcccgcctcttctcccctcccatggtaaccactcgcagctgggggtctctgtaagattaagcacaggtagacaggttgggattcagaaaaaatactaaaatagaaactggaaataagagacaccaagggaaattaaaccaactagaggaagcgcctcaggctgcaagacccgtgggatcgtctgattaataacatcctcccatgtccctgtctcggaaagaaggatctgtagaggggctggcaggctgggctctcaggcactgagctgccaaccaccaggcgctggagctggcaggagcctccatgggcacagaggaagctgtggcacaggggtccccaaaaatgctcttctccaggctccatccccctgactcgcctgcacctcccatcctgacaccctgcctagacccctgcccagaggacatgagtgtggtgtaatgggaagagaagaggctttagaagctgtattcaagccctgcttccccactccttggtggtgtgactttaatctctctgcaccttgggctcctcatctgtaaaatggagataacaaccctgacttgcgaaagtgtgaggtgcccaggattgtacttacagataaggtagctgtcatcactccctgttaattctgtacacatacacacatgcccaaacaccaccatttcatatggtgcttaatgtatccagtagaacaattgtaatgaaccaattaaagctgaataagaaagtacaaaagaaaatagcatgatgcccccaaatcatgagtttctaaagggcaggagtggggtctttctgcttctgtctctgatactctaatgcttgttactgggctttccagcctacggctcccaatcagaagaagggactattttgttctcatggtgctgatcatacaaagcactttcaattccctgatgtcatttatcattcatgtatgcattcagtcctcaaatatttactgagttttactgagtgcaagtcacttcccacatgctagccctgagtgacaggggacagcagggagtattcttccctttgggagactgtgatgatgatgatgatgatgctcataatagcaacgctaataccaacacttactgcgtgctcactggatcccaggcactgctcgcagcctttccgtgttttaacttctttaattctcaccacaaactacatgcaattattatccccactgaccggtaaggctcagagaggttaagtcctggagcgggtaagcagcagagtcaaggtcagacccagccaggcatcttgaccatggacttgcaccacctgttggttaagacagagaaaaaccaaggacaggagcggtttagtgactagacctgcaatcaagttgaactgtggtcatttgagtcaccttgtgaatctttcattaggtgacaagaaactataaatgataatgtaatctgttctccctgggagtgtgaactcctgcccctgccaagctttccaggtatcatttctgggctgtcagttgtaaggagaattcctgaaagacggaggtagagactgcccccctcccagtcctagtgctgatggtaccaacagctgacaagtccagggagctggtctagctgggaagtaatggagccttggcaccttccaggcacaggaccttggagctttataccatcaagtcaatgcactgccctcttgttaccctctctggagtcaaaggtccttggagcccttgcagaagaaaatctgcataatcttaattaacaaagagatgttaaaaaacttcccaggcttctgcagatttatagggagggtaaaattaaacaccaccactaaaacctgctatcagggaatctcgttagcactaatgttcatttatagtttgacttccccacatttaattcttttttggtgggagagagggactgacaatttaagacccagaaagatggttttatgactggtgcagctataaatcaaacttataaagttcataaaaattgttaaaataaaaaatggtttaataggaatgttttatggcccataacattattatagctgttttattccctctgcgttaggggtttaattggatcaccacgattctggggattctctgtttttactggatggagggcaatcttaaatcaaaatggccccaaatgtcttcagtatggctcctcacttatccgccctctcctgcaggctgggtgctgagctggggtaccctcatagaggatgggacaagacaccatctttctcgctcagtccccaagagtggctgcccttttgatgaaactatttgaagtgatccaggcattataggacccaggtcagaaagaaagcagagccaaaagggaaaatgggcttcagaccagtgtgactcgaaataaaattccaagttagaatatataatgaagagaacatgtgctctggagcctgacatacctggctacaaatattggctctaccatgtatgaattatgtgacctttaagaggttgcttagcctccctatgattccatttttttttttcatctgtaaaatgggaatacttgtgcatagctcgccaagtggatgggagaatgggtctggcccagtgctgtccagtagaaaattaatgcaagccacatgtgcaagccacatgtgtaatttaaactttttgtattagtcacattaaaaaggtaaaaataaaaagatcaattaatgttacatattttatttaatctaactggtctaaaatgattatcatttcaatatgtaatcaatttaaaaattatcaataagatagtttatatttgtattcatactgtcattgaaatccagcatgtaatgtatatttatagcacatctcaatttagacacagctcatcttagttgggattaaccacatttcaaatgctcaatccacacacatggcaagtagctatttgattgggttatgcagctctaacccaataaaagctcaaaaaacagcagtaatggttgtttctggtattcctgtactccttgctctctaccccacagctatcttataaccctctagaaatacttgactatccaacttcccaagacacctacattcaccttttgtactgtaccttttgtacccttctcaggtgtcagacaggtcggtggtggctctggtccccaaacagacctcctcctacaacatccctgcctctgccagcatctcccggacgtccatcagcagatacggtgagaaccacgagggcagactgggcagctcagagcagagtcttctgagacctagcagggcccactcgctaccccttctaacagcaggcagcccttgctgctgctggcccaatcacaggctcctgccagttggtttctgtcctccctagtccaggcattcccaggcagcctgcgccctcagagccgtgggagcaggtggcaccatgtgccctttgtttgatatcccagcctggtagaggagtcggagtggcccagaaccaggaaggcacctggctgggggttcatatatcccaggttgcctgggccagtccagtttatgcttgttgtcctggctgaattattaagagtgcccccttttactctcagaagtgtcccagtttgatcaataaattagtccgaggagtactggggcccccaggccctccgggcaatgaggttatggcacctccttgtcccttattttatttgctctggtttcatgtatgcactaaggccttgggcttctcaaccaaagggcaccacaggactgaacccagcagcaccaaaaagggctcaggaaatcccataccccaggccccatgcaagaagagacccttaactcccaagaggagaattacaacttgcagctctttagtatccagatttctattaaaacaccgacgaaaatatcctattgacattttacctattaattattcattgctgggagtgtcagagtagaggggactcccaaattcccaaggatgtctctaattcacaaaatttataaatccttttctaaaaaagccttcaagctcttccgtcctcatgccaaccaaggatccctaaaataacctaccatatatgaggtcccaacggtcccctttcagctgaaatgagtttattctgagtggatgcagcaggcgggcagggattctggaaggattctacaagcaaggctggtgactgttactcacagccctccaccaaccccttctcctcagactcctccttcaggtatacgggcagccccgacagcctgcggtcccgggccccgatgatcaccccagacctggaaagtggggtcaaggtgtggcatctggtgaagaaccatgaccacggtgaccagaaggagggtgaccggggcagcaagatggtgtccgagatctacctgacccggctactggccaccaaggtaactccccctctgcccagaccagggagtgcttgttaaaggagcacatcctgcccctccacaacacagaaaggatgtctggagtgtgtccttcaagaggacccattcagacagtccaggtacagccagacctggtggctcatgcccataatcccagcactttgggaggccaaggcagaaggatgccttgagcccaagagtatgggaccagcctgggcaacatatcaagacccgatctccactaacgaaaaaaaaaaaagaggacaaaattggaaaaaaaaaaagagagagagagagatagtccagttccctgggcagggcttccaaaggatcaggccaccgctgttctctaccctttggcaaaaatagcaaatatatctttgctttctgcgtacttcttgagactactgtttcacttcagaggagtaactctctccctctggaccccttaagctttaggaaggcagtggggtttcttgctgatattagttggatagatatgctggcctttctatcccctttctggccacaatgggagggaaagcacagaggcctggccctgccagtaatccaaggggaggcttcctcttcccatcccatcccaccccagctacccccaaatgttgatggaagtgaggcttcatcttttagccttcctagcaggtagcaaaataagcctgtaagtatgacaatcaaagagccaatgttttccacgcagggctagatttcaaatattctccccgatggaccctccaacaatggcactgaagttttaatacagtggcatccaacttacagctctcacacttgctcccagagtggcccagaaatattccacgagaccccatgtctccattttagctttgcctaatatgctcagcataacaacaagagaccaacaaagagataacagaaaaagctagaggtttctgctgaccctcagaggtgtgccatgagcctgtaaactgtgggagccaggcccagtcttattcctgccccagagaccctccaaagccctgtggatcagcactctgcctgtggggaggtggttcttgagtctagacccttcacccacattccacattccagataccacttgtctcaggtcactaacatcctaagcctcttcataccttcctaacagactctcctggtcctgctgtgctcctgccaggaggcacccagtcctccagcttgttcctcggacactgtttccggactggcttgcagcctgtgccccctcattcacccatgggaagcccggacccggggcacttcctgtcttcctgtcaaagaccctgagcctacaccctgtgtggaatgtggaatgtggctgcaggttggaggagagattcttccccaggattcacagcccacccagtttctcccacctccccagctaaccaatagtacccttccccaccccgcaacactgcctgcacagcctcgtgtcccagacaaatttccaaggcaggatgggtccaaggcaccatctggtatgcctgtctgctacctgccgtcacccccctccatcttactctcccccacccctcctccagggcaccctgcagaagtttgtggacgacttgtttgagaccttgttcagcactgtgcaccggggcagcgctctccccctggccatcaagtacatgtttgatttcctagatgagcaggcagacaggcacagcatccatgacacagatgtgcggcacacctggaaaagcaactggtaaaccctcggggagctcagcaggaggtgcagcctggagaggcctggagctaagagggatgaggaccaggagatgggagggtgggaggatagcctattctcggctggggctgggtgatccaaagctcctggaacaaacagtgcacatatgctctgcagagcccacacggtccccagctgcctgtgccaagtggggcctgcctggcttgaggcacagcaataggatgcacccttgaattctgcccctccaggttgtgaccagtaccccaagaagagcctcctcccctggctctgagatctctggttctcaggagaagggagctgggggaacctatgcaaagagctgcatttgaagcctgcagcagagcttcacagccagacatcgtggggcattctgagtggggcagttctaaggcacttcctgagatggggaatccctgaattaaactgagacgcccggtgaagttggtcagcaccggagagggagttcacacctgctatagacttgagcccactgacagggaggatttcattgcaaacttgatctcttaaggccaagtgattatcctggcgccatagctttcaggaagcagcaggcagaatgccctgcaggcatgactctctcccctaaagtcatctctgcaaccagaccagcagtgggagaagccctcaggcccctggtatgagactttatcctcatgggttttgaacctggaccacagaccaagctaaggactggctttcaggtcagacaggacccggccaagagctggcatcaaaaggcttcctttgggaaagagcacagagaggggagaggggaggtccaggcatttgggttgggcaggcagcccacgcagctgtctggagttagcggtctcctcagaaaacagagccgacacagatgggcccaggctgttatttgggaatcaaaagtcctagcaaccaacaaaacactttggaaaaagccaaccccagccccatctcttccttcctcctcccgggtcttgtggtcgctgagccttcctcagtctgcagctttgatcacagtggagtgaaacgaacaggctggggtggccctggggttaagagcccacagtccactttgccaggacaggccttccatctgcattccctggacagcacatgcctgtcccctttgctttggagcatccccggcccagcgctgggagagggcacttcaggggaaatcaagagaaagtccagggttatccgcatctctgtgccttctgtgtgctggccagatccaagtaatagaaatggactaccctggcatcgtggtgtggagagagtttccttaaccagacctcaatagcaaatgtccagggaaagattaccagaaactacccaaggctgccagaagaaggggagggtagaagagatgagtcagctctcagctgcagcagcttctcccaggctagaggaaagtgagggatcctgttgtgttttggaagataggcagaaatcatcgtggaagggcttgaggctgggtaaagcagatcttccccaagacctggcactactgagacatttgggaaagtttggggcccatgagagtcaagagaagatgaaggaggggagagaagaagaagctggggagctgggaacatcatctcaggctggaggacaagcctgtgacaggaccggttccacagaggagtcaaaagagttaaagcccagaaggcagctggaagagaaggcaaagctggaaaaggaagtaaaagcagcagctgttctgattttgaaggagagtaaatgggcttatttgctttatggtctaaggagcagagaaaactcattctcctctggttataaattcccgagttgcagaaggaagtctcctaactactgatcggttcctcttggggtgggaaaatctctgagctacagtgagtcattcccaggatgccaacaatggcctccacttctccctctgcccctgcccagatacaagaacgccctggggagagtcatgaaagaacttcccccaggggagcccattcctcggcccagccaggccaggccagccctgggaagtagcttgggcagccgggctgggcggggagcgcaggtggcgccctttgtgcctgctccgaggctgagcctggggctcctggctgccttcttccggacaatggccacgggcactgtgaagggactccaggagcctggtggctttgtgtgaagccctgagaaaatgtgctgtcctctgttcttgggcttgcctaggggcacagagtcctttagaaaagtctcccagaagggaacagaacacacccaggcccacccctcggatgttagagatcagggtcagtgcccccattagggtacaaagtgcctctccttccatttctcccaggtcagtaacagctttggctaaattaaccctggctggacccattttcttccattttactcctttgccccttcaggtggacaatttgacctttgatggggaagaatatcagtgggcagcagaaggggcacggcccgcatgcattctcaagtcttctctgcctttccccacagcctccctctgcgcttctgggtgaacgtgattaagaacccccagttcgtgtttgacatccacaagggcagcatcacggacgcctgcctctctgtggtggcccagaccttcatggactcttgttcaacgtcagagcaccggctgggcaaggactccccctccaacaagctgctctatgccaaggacatccccagctacaagagctgggtggagaggtcagtagcaccctcaggacaggcccatgcccttgtctccctgcccattccccgctctatagtcatcactgactaaggactcagacgacggtgtctgtcatctcttcaggacctcccactcccctccctgccacaccccctgctgcgggaggaagggtggctttgtgcccgtggaagtcagatgattatcatcctaattactattcattgagcatgtgctaagcattcagcattctgataaagattttgtgtgtatcatctcattaaaatgtccagcagagttgtgaagccagtattattattatccccattttactgataaggaaactgaggtacagagagggtaaataacttgccctgcgtcacacagctagcaggtagcagagctgggatttgaacacaaagagcctggtgagagtctgggcttttaaccactctgttgggcaccgcagccacgagctctcggctagatggaatctactgaagaaactctggccttcagcctcaacctcagcatgaagcaagaggccagaggaagccacatcagaagagaaatagggaggcaggagcaactgggtacatcagtgccctcgaaggacctgggcccggggtagctataggtaaatgtttgctgaggcctccaccaaggcgcctatcctgtctctggcagatactacgcagacatcgccaagctcccagccatcagtgaccaggacatgaatgcctacctcgccgagcagtcccgcctgcacgccgtggagttcaacatgctgagtgccctcaatgagatctactcctatgtcagcaagtatagtgaggaggtgagacagggccccagcagggacagaaaccaacaggcaaggagcaggaagcctgactcagtccttaaatagatggcaatttagaaaacacattcagggagtcagaagcccatgagctcgaaaattatcattcctttatgaggcaactcaactcctgattcactgaaggctttatacacttcattgtctttcactcattgttaacacaataaataacacttttaatcatttgtttttcagttcaaagtatggtataattaatttcattctctcttaatgaatcaaactattctttgcattcgggcagatcctgtcagttacatttcagatagacaggtggaccctaatatgaatagagattgattaggatacctttggaaaactcacaaagcttctttagcattgaacgtgaaagtagtagtagtagtagcaataattaacacttgcatagcacttcctatgccagagaatgtttgaaacaccatacatacatacatatatataggtgtgtgtgcatgtattcattcagttaatcatttaaattatttaaggttatgtgcatgaaggcagaatggaaaggtagacagagggcaaagagggaacgactccagaaaatggtgtcttctattctgagtcctgaagtcttcctgcctttgtttttgctcctcagctcatcggggccctagagcaggatgagcaggcacggcggcagcggctggcttataaggtggagcagctcattaatgccatgtccattgagagctgagaggaggagcctcgcattcctgggaagagggacctgtccaagctgtcacactgggagtctcagatggaaggacaagtgatggggatcaggccccagagcttgctgtcccctgagaccccatcctggggagaggggaggactcctctccctacgccagccaagtttcgtcatagccagttccagctgggagagacagtgggcgtcgtccatcctcagtgagaacaccagagaacccggggccgggagaaggtggttcttcaagccgagaggcacgagctggggacagttctgcctctgtgactgctgctttgcatgaaaactcatttgatgtatattggggaaataatgagaactttatttaattttttt

SEQ ID NO: 37838 - DNA, 3075 bp, Homo sapiens; identical to SEQ ID NO: 36503

SEQ ID NO: 37839 - DNA, 43411 bp, Homo sapiens
ccccgcccgtttgccagcgctcaggcaggagctctggactgggcgcgccgccgccctggagtgagggaagcccagtggaagggggtcccgggagccggctgcgatggacgccgtcttggaacccttcccggccgacaggctgttccccggatccagcttcctggacttgggggatctgaacgagtcggacttcctcaacaatgcggtaagatgaagggtctccgttcccgttccacccctcggcacccgtcctcgcggcgcgcctgggcccctagaaggacccgactacacatcactgggcaggagccggggagagggttcagcgcagggtctccaggagcgacatgtgtttggagctaagcgcccctcctgggggctcaatctttgaatacactggcctccaccttctagggggaaggggccatcgaggtatcgggtccgtccgatcctcggatctgagctcaagagacaccaatcccgccctccacccacgtcttctagccgtccccaacccaccccaggttccaggaccagactgggcgcaaagtggcagcgccctttcctgcgcctcccttggggcttcggtggctcataggctggatctccgctggggggcgcaccggggaacgttcagagggcctgagacccgacccctcggggaagccaggcccagaaatttcagggtgctaccctggcagccccagggaatcaggcccagagaccccccaccccagggagggacctgaggctgggggctgggaagaggcggtcagggcaacatagggtgatggctcaggaggagggagccatttctctccatctgcctctagatctctgctctgtccctctgttcctggagtctggctgactttctccctctccctatgtcttcttgactaggtccgactgtgagcttgtctttctcctctttctcactcttcccctccctccctaaggaaacgtggcttctctctcttcttccctccctccctctctcaggctcagccctaaggccttgatgggggaggggcacggacttagaatgggagaaaatatttgggttcagaagggcctgcccagatgaaatgtggattgtttggggagtctagtgggagccccctcttcagtgaaccaccagttgcgtgtgcatgcctgttcacacgccacacacacacacacaccctgtgatcaagcacttgagactctttacctgctgacctctacctcccaggaccaagataaacttggccaggcaagagtcaagtccttagaggacttgagcatcttggacttccacctaaactgtcccaggccactagattgatggtgaggaaccaggccaagggacaggagccggagtcaaggaggcatgggggctgaggtctccctgttctccattaagcagcacatcctggtcaccctgcgctctgaggaaggcccctgtcccaggcagagagagcataattcagcagacaagacaagggtataagggcagagggcttgcattgactgcagcgagacttggtttctagtcctggctctgcttcccctgtgagcttggcccctaccactggctctcctccctgagcctcagtttctttgtctgtaaaatgggggagaggttggatcaggtcttcctatagatggttctggcacagatcccaggaataaagcagcagggatcgggggatccacacctcctcttgaagctggtaaaagacactagtcagagggaaagaggtttgtcagagctcggacccttgaagtcaagcagggcagtagagccctgcagtaagcttctctcggcccttggcagctctgagttgggctttcttctgaatgaactcggccgcccgaagcctcttcctgctgctccattcagccctgcatccccagctgcttatctgggccttggtccagcacaggaaaagaggcacgaccagacagtgggatccagcactaggacactggggaggaaaagccctgctggggaggctcctgatctcgcacctggggcagcgccaggagaggcagcgggagaagatggggtgcctaaggaaagagagaaaggactcttgggctgggaatcaggagatttaattctgtctctgtttctgccaccagccagcgggacaattcagaaaagtgacttttcttttcttgtttttttttttgttttttgttttttgttttttttcagacggagtcttgctctgtcgcccaggctggagtgcagtggcgcgatctcggctcactgcaagctccgcctcccgggttcacgccattctcctgtctcagcgtcccgagtagctgggactacaggcacccgccaccacgcccggctaatttttttttatatttttagtagagacggggtttcaccgtgttagccaggatggtcttgatctcctgacctcgtgatccacccacctcggcctcccaaagtgctgggattacaggcttgagccactgcgcccggccaaaagtgacttttcttcttctgggctttgacttcctcatctgaaaaatgggaatattagaactatagcattactgtaagcatttcgagagaaaattaaagtgaaggttatgtagcacaatgcctggcatgtaacgttcatcgttggcttgatccatagagactggatgggcgtgatagtgagaattgctcagctacgagttgctgtgtgaacatagcaagtcactttccttctctggggtctccatctccatatccgaggttctttccagctgagatcccattccaacccttcccccaacttcttcattctgcatgaggataggaaaatgtttccagggttaaggatgggtagggatggcgtctgtgtgcctctcagtctggaaaatggagagcagaatattcgctatcctccttaaaaatccagatacgggccataaatcatgtggaaatcatgtgtgctctgttgctctgtgcaaaatgcaaaatgtatgctcaccctgaaaacaactatgcaagaaatacgcatgcacttggacagacaggagagtgagtacacaaagtcaagacaagtgtgtttggaggtggctgggctgccttatttttctttctatgaggataccttcatgttgctgcaattctgtttatgcgattctcagagatcctcagaagggggctgcccttcctgtcccatgtgggggcatctcctccctgcccctcccgctctcccatggtttctgatgtggccacccttgagccactgtactctgtggtccttcagccccttggccagtatgagagagagggtctgggctccaagaactgggataaaggaccagagggagagcaggtcgtttctccagatggaaacactaggtctgtgtgctgtcccctccttcctctggctaaggggaagggatgtctggcttctctagagggaactggcttgggatcccagagaagccccagctgggagggtgtggggaggagaaggaggaggaagaaaaggtctgttttctcagaggggagcagcaggaagctgcaaggatgtttgcccagcacacccgtttactccctgcagctggggaggccaggtgtgggagtgacggggacccagggaccagcccagcattgcggggaggcggtgggggctaaggctgatcgctactccccacacgcctagcctggcttctcctgagctaactgggaagcagagaggcacccccacccccagccttcgggagatttagggagattagagaagtatgtgtgtttgggtgttcctatgtctgtgggtgggcctttaacagtccttaaaaggggagatttgtgtgtgtttctgtttaagttctcaccaacaggaaagaggacagaagtgctaaggcactctggtctcagagtgcaatctgctagaaaagatctaatgaaaaacctactggaggagcccaaatctcagggtgcctattcagaaaggagacctctgatacctactctatcaaaacattaagttcgttttgagcagaggtttgatttgggttttgcttcccccagtgttgagggaacagttccttgagtcaggggcttggtctgtcttgttcactgctgtatcccagtgcctaacaaccgttgatgaatgaataaatcgatggatggatgaatgaatggatggatggatgaagaaaaaggggcccaaaccagaccccacattcttagagaagagggaaaagtgtccttaagcccatctatttgcagccatcgaggtcctgcagaccctgcactgtctctggggtccaggaagggctctccatggtttttaatgagttctcattaccttgagccatccccctactgcacaggcctctgcagcccctggtctagaatagtctacagctggctgacccacaggggatttgaacttgtggctcaggtgtcactcttgagcactgtctctagggcttccgttttccccagtttcttcttcagattgctctaggactcctggatccatactcacccaatttaagactaagccttttccagccctgcctcagagcccttgcacatgctgttcctgtcatctggactgcttttcccccagtctgtccatctcagccttctgatcccagctcaaatattgcctccttagggaacgctccctgactacctaaagtgggacccccctgttcttttctgttttagtcttttgatatcttctagcccttaacccagtttgcaattattttaatggcctattgtctatttcctccacgagaaagtaagttccataagaggagagtccatatcagttttgtgcattgacataaacctagcacagtcacatgggacaaaatagatgctcaatgtagtaaaattctacaataatgcaataaatatgcccagtcaaaaatttccaattatgttcctttgcggtgactcatgcttgtaatctcaatgctttgggagaccaaggtaggaggattgcttgagcccaggagttcaagaccagtctgggcaacatagggagacctcgtctctacaaaaaataaaaaaaaaatgagccgggcatggtggcatatgcctgtggtcccagccacttaggaggctgaggagggaggatcacttgggctggggaggttgggactgcagtgagccataatggcatcactgcactccagcctgggcaacaaagccagaccctgtctctaaaagtaataataataatacaaatttaaaaataaattttccaattacataaaatgtggagtaatatttttgtagaattaacgaaaaacagtatttttcagatggtctgtactatcacaaaaagcaggaaagtaaaaattgtgacaccttactgcacaaagcagaccaaacagaaagagtaccacaggagcatgaggcagtcacttttttttaccagccccatagagaatggagttttgctcacttttatttgagaaggggcctgagcatagaacagaagtcaagtttgggtcacattgtagtgaactttgctctatttcaaggacttactatatttgtagagaaaattactttagactggggcaatccttgtaagggaagggaaaaattgttttaaaaaaatcccaggctggatgtggtggctcacacctgtaattccagtactttgggaggcggaggcagggggatcacttgaggccaagagtttgagaccagcctgggcaacacagaaagactccgtctctacaaaaaataaaaaataaattatccaggcatggtggcacatacctgaagtcctggctgcttaggagactgatgtgggatgatcacttgagcccaggagttcaaggctgcagtgagctattatcacgccactgcactccagcctgggcaacagagcaagacccaaaaaatcagatctaagtgttcaagaggtgtacttatgattcctgaagggatcctggggttttcaggatcctggactggccatcccttagggtggtggggatgctgggtcccacagaagtgctgtctgtgccccgatatgttgtgaggtccctccggcttccctggaccagctgggaattcacttgctcattcattaatacacatgtccattccttcagcaactgggcactgaaggaacatctatgctggtgccagggtaacccagatgaagaaaacacacttgaccctccagtcaatcgcggacgaatgagagagacagagagggaaataggcagtatcaacaccatggtgggcgccatgatggagcagagcatggcaggaggctgagccaggctacaggtcatgaaagctttctcagaaggtgatctctgcacatgctgccccaatttccctcttccttagtggcaaaggagttattagaaggcttttctggccaggcatggtagctcatgcccataataccaacactttgggaggctgaggcaggtggatcacctgagttcaggagtttgagaccagcctgaccaacatggtgaaaccccatctctactaaaaataccaaaaaaattagccaggcatggtggcatgtgcctgtaatcccagctacttgggaggctgagccaggagaatcgcttgaacccaggaggtggagattgcagtgagccaagatcgcaccattgcactccagtctgggcaacaagggcaaaactccatctccaaaaaaaaaaaaaaaggcatttccacagggactggggccatgttccttttactgaacacgtataggcattattatccattgtgcactctgctcaagggcaggagtcctatggagagtcaaagaggggagcaagaagaagctacaagcaagttctctcattgttctagtttgagatttcccctctagagcaaggaaaattcaggatctttcatatcacagggtccctgtcttcatcctcacccactcccatccttagggcaccttggatgcctagagctttatgggcaaaaccagatcccctgaataagctcccacatcccatttcacaccctatcagattcacccccaggatgctgttccccagcccttctggggacttggatctttgctctctgcagctcccaggactcctcaggagactctgtttctgtctgccctggcctggcctggctactgcaccaggagaggggagcataaaggacatccctgttttgtgtcttctccctgtatcatgtgcctcgtgcgagtcctggtaccgaggccctcctggagcatctctctctggaacctggcttgcccttgaacctccctcaagaaaccagctccagatgctggagaacaggctgtttctctggaagtctcagcactcctgggggcaggatggaggaggaatatttgggtggagttaagtcaagactgtgagctggaactctgtgtaaccctcttgagcagccctggggaagccagactgaatggcaggaccctggaccaggattggggaatgtgtgggggtgggattgtctggttcaggagaagctgggagaggcaggaaatgccccaggactctgaccctcagaggaaatatgtcaaaggtattgatttctttggaatgtcaaagatcttgatccccaccacctagacacaccatattgtctacaaggccagtttgatagctggagcaaccatgggcttccctgccgccgggttcagtgtgcctcctcccctaattcccctgggacagagccttcactgccgcttccttggccgttggctcgtggctcgtggcccagaagccacttcacccatcacagagagtttgacacatctgggctgggatgtgcggtccgacataacagctggacagcagcagccactggctcctcctccccttccaaaagaataacaaaaatgaaagtagcgatggagtgaggcaggctcttcaggccttcatggagagccaggaggcgggtttcaggcagtgattgacaggggctcgctttggaggcagacaggtctgagcctttgcccatgggttcccctccacctggaataccctcacccttctttacctcatttccctcacttgctgtgtgaccctgggcaaatcactttccctttctgggccttggcctcctcatttctgaactaaactgagggctccttgagagcagggtgtgtcagtcaattatttgcggctattccctaggtacagctataatgactgagtgctcaggaaatgtttatttattggatggatggaaggaaggcaggatggagtagggtggggacgatagaggaatgaataggtgggtggatagatagtaaaagaaaggacacttctacacttccagctttgatggccctcttttttaaagtagattgcttcattcgttcactcatttgattactcaaatcgtgaatgttagcataaatgccatctctccctttcactttatcatcatggccttttctattatgatatcttgtgcactggtagaatatatagactgtatatctatcagttataaagtataataaaattaatacatggaaacttacccagcttaagaatcagactcagggccgggcatggtggctcatgcctgtaatcccagcactttgggaggctgaggcgggtcagtagtttgagaccagcctggccaacatggtgaaaccccgtctctactaaaaatacaaaaattagccaggcgtggtggcgggagcctgtaatcccagctactcaggaggctgaggcaggagaactgcttgaacccaggaggcggaggttgcagtgagccgagattgaaccactgcactccagcctgggcaacagaacaagactctgtctcaaaaaacaaacagacaaacaaaaagaaaaaagaaaaagaaagaaagaagaaagaaaaagaaaagaaaacacactcggttctgaatatcttggtctctcaaagctgcatgagtttgggacagaggtgagctgtagaccctgaatccaccccactctggggagattttaaacaggaaagtcccaagacttcccaggtgcgtactcccaggctcaacgtgtgcagacagtgggtccacaggtcagatggcagatgatgaggcaagtgctggggaagtgatccttgcctgaggcgggacgtcttcagcactgcttagacctggggcctcccacttgtcacctgtgtgagcttgggcaggtgctttaacctctccaagcttattttcctcatccaaaagtagggttcatggtaaaacatagggttcttaagagaattccattagaaattcttgcagagggcctggtacaccataaaccctctataaacaatagttgccactgctgtttttattgttttggtttttaaatttttttttgagacagggtctcactctgttgcccaggctggagtgtagtggcacaaacacagttcactgcagcctcaacctcccggactcaagtgatcctctcacctcaaacccctgagtagctaggactacagggacataccaccatgtctggctaattttttgtattttttgtaaagatgttttttttgccatgttgcccaggctggtcttgaactcctgagctcaagcgatcctccctccttggctcccaaagtgctaagattacaggcataagtcaccacacctggacaatttttaatttttgtgggtacatagtaggttagatatttatggggcacatgagatattttggtacaggcatgtaatacataataatcacatgatgggacaggtgcggtggttcacgcctgtaatcctagcactttgggaggccgaggcgggtggatcacaaggtcaggagtttgagaacagcctgaccaacatggtgaaaccacatctctactaaaaatacaaaaattagccgggcgtgttggtgtgcacctgtaatcccagctactcaggaggctgagacagaagaattgcttgaacccaggaggcggaggttgcagtaagccgagatcatgccactaaactccagcctgagcaacagactgagattctgtctcaaaaaaaaaaaatcacgtcatggagaatggggtatccatcccctcgggcatttatcctttgtgttacaaacaatccaattacactcttttttttattttatttatttatttattcatttatttttgagatggagtctcgctctgttgcccaggctggaatgcaatggcgcgacctccactcactgcagcctccgcctcccaggttcaagcaattctctgcctcagtctcccgagtagctgggattacaggcatgcgccatgacacctggctgatttttgtatttttagcagagatggggttttgttatgttggccaggctggtctcaaactcctggcctcaagtgatccgcccgcctcagtctcccaaagtgctgggattataggcgtgagccaccgcacacggccctcttagttattttaaaattaagttataattgactgtggtcccccttgctgtttttattttgattgttgctgtcattgcttaaaaggaaggcccatggcatttgacagccctcgcaggaatatcccaccttgtccagccctgcagagccctgatcacggggattttatttttctgtctcaactctctggagatggaaggctctttcctttgggtaaagccaaaaagccccaggccacttctcagggctctttctgggcagcaggagagggatggccaggaaaggagcaaaaccggatccccaggatgaacccagtgtgtggagtgggggcccatattttgtatctggccctggactaggtgctgcaatggggcagcaggatcattctttcagcaaccagtgttgttgtgggtgcttaagagcgtgggttctgcaatcagagcttgggttcaaatccccgcttgaccacttgctaactgaatgaacctgggcaagctgcttaactactctgagcctcagcgtctcatccataaagtgagggtactaagaggacccactttatcctttgaagcttaaatgagatactacatgcaggaagttagagcagtgcctggtacataaatattcgctgttattatattatgatcattaccattaggcagagtatatgctgggccctgtttgaggctctgcagagggttcaaggatgaaatccggccaggcgcggtggctcacgcctgtaatcccagcactttgggaggctgaggcaggcggatcacttgaggtcaggagttcaagaccaacctggacaacacagtgaaaccccgtctctaccaaaaaatacaaaaattagccagacatggtggtccattcctgtagtcccagctacttgagaggctgaggcaggagaatcacttgaacccaggaggcagaggttgcagtgacccaagatggtaccactgcactccagcctgggcaacagagtgagaccccatctccaaaacaaaaaagatgaaacctgtccttgatctacccgaaagaagggtaacgtttagaaggacagctggatcccattgtgtgtaattagagttcagggcatgacattaaccaatgacctaacagtctgtaagtgctgtggtagaacagagagggagattactcttcaagcttggtgatcagggaaggcttcttggaggaagcagcatttgagttggccccttaaaggataggaagagttagaatgaggagataaaggacaaaacactgcaggcaccaggagaggtataagcaaaggtcctacagccatggggaccacagcaggtttaaggagctgggaatggtccatccaactagcctggagaggagagaaaatgagggggctccagctctagtggtaagttgggatcagtttctgacagtccttgagtatcatgctgaggagctgggagtttttcagcaggcaggagggagccaacgatagttctgggttgcaccaggtgatggtcaccagctcctctgaagggtctcagtgctaggaggcctgcggtccatcaggcggatctcagctgtcagcctgtctgggtgatcagggactctcccccagggggaacagagttgtgggacctccctgagcccaggacagcagctgactccaggtcccttctctcctctgatttctactattcagtgccctgatgtgactctcgcactgggccaggagtaccagttcccttctggctccttcacccccagcactgagagctaggctggcctggggaggcccaaggcaactccgcccttgcaaagggacaggctgttcctctttggggctgggagctccagcctgaaccatgtcctggctcctggcccaacaccaggaccctaacaagattcccccatctcctccaatacttcaggaccctctactatcagacaaagcatgtctctatgaaccccaggggcctaggagggtctgaaccctcctcctgagcccagcccagcctggcacaccagctccttgaccctcttacccattggctgggacaagatgcccagagccccactcaccatccttccagccctgccctctgccgccccaaggccttcacccctttctctccagggctgcaaatcacttccacatttgggatctggcatgcactatctgcttggaactctctcctcccagttagctcccatctccttccaccccacaagttcagcccctggggtctgcaggaggggaagggctcctgcctctgacaatcccttcagaggactaacagggagcctgactgtggcacggtgccagagggacagtgtacaggaggcctcccagggagagatgaaagaggaggagccaagggggtgggcggaggcagagcttgagcaagcaaggggatgaggggttgggggtggggaggcaaggaaggtggtagttcccagctcagcacattcctgagacatctggatgcactggaagggccccagctggcctgcataactgtggctctagcttctctgctctgtgatgtcaggacccagcactccccgctcccctcagagtcccactggcctgggggccacttggggctgagtactggggtctcttccccagacccctgaccctcagtgagcaagaaagaggcccctggggcaatggaggaaatgcttgccacagaggtgggccagggtatgatggcaggagggaggcactgaagacccagtggtttgcccatccgactgactcaaggaaaatgtgcctttgggctggtgccagtccttctcttctccttggaagggagatagagacaaatgaatgactctggaaacggctgcttaccttgggctgtgtgaccccaggcaagtgcactcccatccccagctctcggttttcttcatctgtaataataacagctacatttaatgagagccttcctcctatatgtcctgcattatataaagcacttcgcaattgttgtctcatttaatcctcacagcaacctggtggggtggatatgaacgttcccattttatactcaggactgaggcttagagaggttaagtaacttgtccaaagcctgcacagtgtatagcagaaccaggattagaaccaggtccgtctgactcccttgcttataaccattgaactgctttgcctcttcacgtaagagggggtggacctaatgatgccaaaattcctttcagttcgaaaattgtaatgatttcttttggccgttgcagggctcttcaagaagggcaagggcaagcattagtcacctactgggtgggggaaggaaggcagagacagctggctttgaagcatcgggtgggtcaagagtctttggaggtcccctcccttggaggcccagagagctccagaccccagggattggagtcaatagcctaatccccagctgagcccaggggtcccacaccttccctgaaagaagggagtaaataaggagagagaataccactccttccaaaaataaaacctgaggacaactcaggccaggaccgctgaggatgtcagaggctgaatgctgagtacactgaggagaggggagaggccaagggaattccagccagagtgaggcggtaggctccaggcgaggagggccttccagctggccaggggccgagagagcagccctggcgggttggccactgtgttctgtttatacccttaggcctgacagggtctggggggacagcaattccagcactgagtggagtctgtgcttcccaggtacctggtctgctggggcttaagaacagaaaggcttagggaaggaagaacaacccggagaatgggtacagcggccccactagggaggagccgagggaaggggtccaaacacatggaaactctgcctggagcagaagcaagctggcatcagagcaagattcgggacggtcattcctggaggctctctgctacagaaaaaagggcctgactccataagctctctgacacactcctttattcacacactcatccagtcagtcagtcactccgtgaatgcctgagcatccactgtgtgcggggaccaatgctaggctttgcagattcaaacgagaattggacacagcaagacatataggcaatacggctggatcatttgaagctacaccaaggaacctgtactctatcctaagggtagtagggagccatgattcactgatgatgagtacaagttcctcatcaatggagcagagaaatgacataggacttctaagttttagaagatcccgttttttagagacagggtcttgctctgttgccctggctggagtgtagtggtgtaatcatagctcactgcagcctcaaactcctgggctcaagtaatcctccttcagcctcctgagtgactgggattacccaccacacctggctaatatttttaaatttttttttttttagagatgggatctcgctatgttgcccaggctggtctcaaactcttggcctcaagcaatcttcccaccttggccttccaaagtgctaggattacaagtgtgagcccccttgagtggcctagaagatctctcttcatgtaaggtggagaatgctctggagagggatcagagtttgagacttggacttacccttcattgtcacaccattggtcagaaagccttttgagagcaggaactggatcttgttcatctctgtatccacaaagctgggcacccagtaggtgctgagtaaataccgaacaaatgcatgaatgatgaataaatgaatgtgactagatgcccttattctccagaggcccctgcgccaaccccggcactcggtttccggtgtcctaagctgccctgcagggatcccctggccgctgcctatagaccagcatctccagcagccagaccgtgggctgctgtgccctcggaggtgccagacacagctaatcccagccctgggcggcggcactcgctgccatcgcttcctcctgcccagacagtgcctggtgcccaccccagggttggaccacagcgcatgggctgcctggtaagaagatgccaggggctggctgggaaaatgaggaagctatggcctgaccaggacaaggttaccagtgtcaggaggggcaatggaagggccagactaacagggctagggggctgcagagaatacacaccctccccaggactctgctctgccttgaagtagcccgcggctggcgccagcctgctgattcctctctccttcctttctccagcacacactggcaaagaaaagctcagtccccatgttggcgctttcttcagtcccagccctcagtgtcccagccccatgcaagcccggggctcccaaatctccctcactggtgttcacatgactcagtcatctcaggcactgagatgctggcttggcagccaacatttagttctgtggttatgtgagatggtgtgtgtgtgacagcgagtatgcgtgaccatgtctgtgtgatcctgtgtctggggtgacttcgcatgtgtgtgagcgtaggggtgtgaatcactgtttgtctgatcacatctgatgagtgtgtcttgttgagtttgtgttcatacctgacagcgtcagcctatgtgactctgtgagggtatctgtatgtgtgatagcgcctgtacaaggctgcacatggaactggctgaatgtgtcgatgagtgtacttttcactatgtggtgtcagagaggtggtgtttccctgtgtacaaaggaacccctcagcccacatctgtgtagcatgtgcacatgcatgcgtgcacacacacaccgaagtatttctgcttatttggacttgggatctgtggtgaccagttcggtaggggaaaatatgaaacttcagcagccgccttccctaggcctatggggactgggggctgagagtgaggtcgggggtcagaacaacgtgctcccttaacccccatactctgccaggaagactcagggagggactggctccagggaccaggagaactggtttcacaccatccagtccccaaaaggccagggcagaggaaaaaggcccacgttctgaagactaattcacttttctaggcccctgtcaaccgcgcttccataaagacacagactgtaatggatgaggaaaccgaggccaggagaggagacacctgccactgcccaggtctcagagcacacctgggtcttgaattagggcctcctgagtttcagttcagtgcgttttctccttcacagggcggctttagctctgggaaggcaaggcctgggcctcgtaggaaccccagctactggatggcaatgcttaaggacaggggggtctgctgacaaccggggactcaaggggcccacctcctctccctgctctcaccactccccgccccctaggcacagcagtgactcagactgaaggcccttcagcttgaaatggggacaattttctagtgaccacgaggcaagtaaccgtccgggaatgcatgggtcagtgtgtgttggggtgtgggggggtctgtgggccccagcctgcggggggaaagaaagggggaaatgtgagaggcctctcctcccatctctccctagctctcactctctcggaaggaatgtccgggctcaggattcccccccaccccttatcccacagctcagcctggacccgctctggtctcctccctcctttccccaagcacagactgaaccagcctgggccgggggaggggcagaagttaggagtgggggtgcaggcgccaaggagccagggacctgagggaagagggcgcgctgaggctgcttctggtcagggaaaccattctcctacaccgaccccagcaggcagctgcgcccccagagctttaccctgtctctgcactgaccttggggaaggaatttagggaggggtaaaacaaggctagagctggtaccattactgccccgggagagtcccctctgccgccaccagagacagccaccaaagcgccccacggtaggacgattcgagatggagctgcaaggggatttaaggcccggctcgccctttgagtcggggtcgtcggggagaccctcggtctccacttctccctgcgggggtgggggcggggccgcgctactgatgaggggtttaggacaccgtgagacggccaggccatttctgcctcggccccagacgcagaaggggtcccatgcaggcccgagccagtgcaccctgcgctccctcagccgcgggccgtcggcgcaggccgggaccctcctccgcgcgagccctgcactcctccggtgccctccacgccgccaccggctgctgctcgcagcctcccgccattggccaggagctctgcggctcccaccagtgagcaggccggattccggtgaggggcggccccgggtgttcccgggttaaccctttgtgggccgctccaggacggcggcacccggatccttctctaaaatttaaagggcgggcggctgaggccaggctccaagagagggtgcagccgagaagaggggtacgcaggtctgcaagcaggagagctcgggaacctctcctccaagggagggaagccggcgccggctgcgcgtgacagccgagaaggagcttatattggcacgactataggaaaaagtctttaacgaggagggaaacaaatcataatatgtccttctccggcttcccacccccgttgcctggaaaggcacccctgtaggacgctcaccccctgcagaaccctgtcgccctcagagcgttgacacatggctcccctgaagttcgtgaactcctggccgccgaccccttgctcttgctccccaatttccatcggacaatctaaacctgaacttttgtgtgtgaagtggagggagggctgggtgtggttgggggtagaggggacaagggggcgtgctggagcggaggaggtctgaggtctccaaaatgggctttccagggatggggccaagtggatgcggtggaaggagtgagaggaccagaaggtcccgcacacgccagggcagccctggacttcaccagctcactttgcagccccggacatcaccagctcgctcactgtgcgtcctgggtagctgtgtttccctctctggactggagttttctctactaagaaataggagggggggaacgaggggcaggggaccgtcggggagctttctcccgtcccttctgcctctaacttggtgatagaaaccaaccctaccttagccgccatgagaggccaggcatcagacggaactagggccgcagagcgctctaggggagtccctgatggcagtgctcccaggagggcgaggtgggcctagggatgatgggacgcgcccaccgtccacccagcacctgaagaagcccggcgcaaagaggacctgggcgtcggagtgtcctccacccccaccccgcctgccccttggccgccctccccttccacttggctcccgttgctctggaagctccatcctgctgggttttggctgctgtttctagcaggtggggtggggactgctcacacaatggggccagctgagctctctaagcagtttcctgtgggcaccctaaaagggtctctgggaagaacctgggtcatctgcctgagccaaggccttcagggagtccagcccagatccgaggaagcatctttcctctcccaggccccaggaaggggcttggcaaacccttatcgcctgagaagcagctgctggagaaataccttagcggctgactcaccggctccctctgctcacagccccctcccactgggcccaacaccaggcctttgagagaccctaagggagagaactggcggaagcgcccccagccggcaggcccgggctctgcggagggtgtagccagcgcggccctggctgtggctggctgggtggttggggggtggttataccctgtaaatggcctctgtctgggatcacagtgattcttagaaactcattcagctctgacctcctggtactgcctcactccaggtattgatggacaattggtatgctgatggcattgccatctgggttctaaggccctgtccctccaccagtatcatgagccaggtgctggaaggcagcaggtgaacagggtgcaaaccctgcttcagggcaattaccggaccggggagggtctgctgcagttgtaaaagactggacagtgagggatggtgggcacctccctgctgcattagcgcccttggcctcagtttctctctctgtcaaatgccaatatgcatttgtcttgtctcattggataattgtgaagattaaatgaaataatgcataggagagcactttgggttaaaagcacaacagaaatgtaggatgatgattgattgctggcaaactgggaagtgggagagtacccctgccaatggggcttctgagctcattttgtcctggattatctcatcaggctttgtttggagggaaaggccaaacattccccccacaactcccaccattggttccaagctcagctcggggacagagtttaggggctgcagttttcatgatgacgataactaacaatgatcgagcattcactctgtagcaggcactgttctgtgttttatatgtacagtatttactcattttaccctcatactcctatgaggtgagtactaatctaacaaaattttagatcctcatggcaacactatgaggtaggaactattattttccccttacggataaggaaactgaggcacggggaagttaagcaacttagcaagtggtggagctaggagtcaaaagcacgtctatgtgactccagagctcgtgttcatctcctactccatgcagacagactcatgtggccctgaaccttatgctcatacagaaggcttctctgctcattaccttccaggttgggacaggctcccaatattccaggccagaaagggccaacaactccagaccttgaaggaatcccctggcacaagcctttaaccactcagcaggcagggcttcaggacctaaggcagccccccatcccccatctcttctgacccaccagcaaattcattcgttcaataaataaggaacaaacaatagaaacatttattggacaggcacggtggcctacacctgtaatcccagcactttggaaggccgaggcgggcagatcacttgaggccaggagtttgagaccagcctagccaacatggtgaaaccccatctttactgaaaatacaaaaaattagctgggcgtggtggtgcgcacctgtagtcccggctgcttgggaggctgaggcatgcaaatcacttgaacccgggagatggaggttgcagtgagccaaaatcatgccactgcactccagcctgggtgacagagtgagactctcacaagcaagacagaaagagagagaaagaaacatttctttacacatttataattctttagagagagaaaaataatgtacaagaacctaccatatgtcagccactggagtgctttactaacaataagaggcaacgtttattgagtaattactatgtgccagggactgttataaggcctgtacgtggattaacttgtttaatcctcatgacaatcttggaaggtaggaactattaatattaccagctgtacagaggacgaaatgaaacagagaggttaattgaccttcccaagatcatggagaccaagatttttcagacttttttgtttctaagaaatatattttacatcattaccaagtacacacatgtgcgttcacacacacaactgtgattttttttaattgccaggtatttaactccactgtgtgctgtgcactctgatattttctacttttttttttctgttttatttttacttaaaattctggtcgtgacccactaaattgatttcacaacccattaatgagtcaccacccacagtttaaacagcactgaatcatagctagaaggatggaggccaccattcgaacctaaatagtagggctccggagcctaacctctccatataaaggatggcttgggaaaggagagagaccccgaagtcttgaggacagatggacactgtgctgctgaggagactggaggcctcaagaatcccactgccctgcatcactcccttcccacattccagcaaaagatcatacaaaattcactaatattgcctttggaaaacaaacttgttggcgtagacacacggttgttcttttactttgtcttcacatcagcctatgaaggaagtaagaaggactgagaaactgactcacgcagtttaagtgatttgacaaaggtcacagagcccagtgtcctgttgcctggtccagggagtttttgatcccatcctgagctcacccttgcagataacaatggtgagcgtggagctggtggtagagagaatgggatgacagtggtaacggtcatgatggaaatgatgagagttggtgttgcaatgttggtactggggagattggtgatgttgctgatattaatgggaatgggcacagtaatgggaggttgcagggacagtggtggccatggtggggtgctgcaccaccacagtagcacctgcacccccttcccaagcaaagctgaattccctcttcccctcacctcttccttccctagcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaaggtaagaggtggaagaacctggggacagcacaggcccaggaggcccaggagggaggaagctctggggtgacaagagagtgtgcctgcagcctgagactcccagaggctccaagaggagccaccacaaaccccttaggaggtgctcctccctgcctttctgttctccctcagctcaaagccagaggagcacttctcaaaagggttttttgctgacttaagtcagtggtttacaaagtgtggttcccagaccagcagcatcacctgggaatctgttagacatgcagattctcgggttccacccccaacctgctgaatcacaaccctgtgggtagggcccagccttccaggtgattctgatgcacactcagatttgcaaaccgctgacttagaggagacagtgggggtaattcaataataactgtggggccgggtgtggtggctcacgcttgtaatccctgcacattgggaggccgaggcaggtggatcacccgaggtcaggagttcgagaccagcctggccaacatatggtgaaaccccgtctctactaaaaaaaaaatacagggccgggcgcggtggctcacgcctgtaatcccagcactctgggaggccgaggcaggcggatcactaggtcaggagatcgagaccatcctggctaacacagtgaaaccccgtctctactaaaaatattaaaaattacccgggggtggtggcgggcgcctgtagtcccagctacttgggaagctgaggcaggagaatggcgtgaacccgggaggcggagcttgcagtgagccaagattgcgccactgcactccagcctgggcgacagagcgagactccatctcaaaaaaaaaaaaaaaaaaaaaaccaactagctgggcgcggtggtgggtgcctgtaatcccagctactcgggaggctaaggcaggagaatcgcttgaacccagcaggcggaggttgccgtgagccattgcactccagcctgggtgacaagagcgaaactccgtctcaaaaaaaaaaaaaatacaaaaattagccaggcgtggtggtgcgctcctgtagtcccagctacttaggagactgaggcacaagaactgcttgaacccgggtggagaaggtgtagtgagctgagaccgcaccactgcattccaacctgggcaacagagtgggactccatctcaaaaataataataactggctgggtgcagttgctcatgcctgtaatcccagcactctgggaggctgatgcgggtggatcacctgaggtgaggagacgaagaccagcctggcgaacgtgataaaaccccgtctctacaaaaatacaacaattagcccagcatgatgccctccatcacatggtgcctccattacatgctgcctgtcatcccaggtacttggaaggctgaggcaggagaatcacttgaacctgggaggcggaggctgcagtgagccaagattgcgccattgcaatccagcctgggcaacagagtgagactccgtcccaaaaaaaaaaaatagacggggtgctgtggctcacgcctataatcccagcactttaggaggctgaggtgggcggatcatttgaggtcaggagttcaagaccagcctggtcaacatggtgaaactactaaaaatagaaaaattagccaggcgtggtggtgggcacctgtaatcccaactactctggaggatgagacaggagagtcacttgaacacaggaggcagaggttgcagtgagtcgagatcaagccactgcactccagcctgggtgacagagtgagactctgtctcaaaaataataataatactatcctggctaacagagtgaaaccccatctctactaaaaataaaaaataaattagccgggcatggtggcgggtgcctgtagtcccagctactcaggaggctaaggcaagagaatggcgtgaacctgggaggcggagcttgcagtgagctgagattgcgtcactgcattccagcctgggcaacagagcgaggctccgtctcaaataataataataataataataataataataataataataataataataagctgtagacaagttaccaagactctagaacctcactgcctcctcatactatgttgtcctctgagacgctacttgagagagattccttcttttattcctgaaggtagcattctctaaagctctcctctccccctaactccatcctttaaagcaaagagcaccctgagttcttccactcaggtaatcagcattcaagacccacattgtgccccacttagaaatggtcccttcgggcatttcctcaaatacaggtggtcctggctctgtcgcttttggctacgtgatcacagacatgttgcttaacctctgtaatccttagtatctatatctacaaatgcaaataacaataaacatttctatagtactctccagtctacagattgccttcatgttaattatcacatttatttctcatgactgacaggtgaggttggaatcacttttatcataatctccatgtgaccgataagaaaactgagacttggccgggtgcagtggctcacgcctgtaatcccagcactttgggaggccaaggcaggcagatcacgaggtcaggagttcgaaacctgcccgaccaacatggtgaaaccccatctctactaaaaatacaaaaattcaccaggcatggtggcgtgcgcctgtaattccagttactcaggaggctgaggcaggagaactgcttgaacccgggaggcggaggttgcagggagctgagattgcaccactgcactccagcggaggtgacaaagcgagattctgtctcaaaaaaaaataaaaaagaaaactgagacttcacaaaagctcagttgtctaggtcacgcccacagtaaaatgcagaacagagacataatagcacaccctgattctcaaccgcaaacccttgccaccaccacatttgccagtcaagaagggcagccagggctatttggttgggacccacaagggcattggtgtgcatccccgtgtctccaccagccactgggtgatcttgggcaagttacttaacctctctaggcctctgtttcctcagtgataaaatgaaaataatatacgccttgagagttctcgtcaggcttaaaaatatatatatacaaaataccctgctaagtgcccagcacataatatatacatcaataattagcagcagccaagtgcagtggctcaggcctgtaatcccagcactttgggaagccgaggcaggaggattgcttgagcccaggagttcaagaccagcctggccaacagatgaaatcctgtctctactaaaaatacaaaaattagttgggagtggaggtgtgtgcctgtaatcccagttactcaggaggctgaagcaggagaatcgcttgaacccaggaagcggaggttgcagtgagccgaaatcatgctactatgctccagcctggatgacagagtgagactctgtctcaaaaattaatataaataataataattagtgactattttcactgtgcacataaaagtcctatgaatactatgggtgggccaggcatgctgagtcacacctataatcccggcactttgggaggccgaggcaggaggattgcttgagctcaggagtttgagaccagcctgggcaacatagcaaaacaccttctccacaaaattaaaaattaaaaaattagccaggcatggtggcacatgcctgtagtcccagctacctaagagcctgaggcaggaggatatcttaagccccggaggtcgaggctgcagtgagctatgatggcaccactgcactccagcctaggcgacagagcaagaccctgtctcaaaaagaaaaaaaataaaacagaaacactatgggtgcttgtaacaatgaacagtgttcttcttattcctctttccctctaaaggacctggtcttgagtgaatttcttaattttctcacttgttaaatggtgagaacaatggtgcctgcccccagagagttgttgggaggagtaaagaagctcatttgcctgggcgcgtgactcacgcctgtaatcccagcactttggtaggccgaggagggtggatcacctgaggtcaggagttcaaggccagcctaaccaacatggagaaaccccgtctctactaaaaatacaaaattagccgggagtggtggcgcatgcctgttatcccagctactcgagaggctgaggcagtagaatcggtgaacccgggaggcagaggttgcggtgaactgagatcgcaccattgcactctagcctgggcaacaagagcgaaattccatctcaaagaaaaaaaaaatagaagctcatgtgtgacaagggcttagagctgtgctcagcgcaagaagtgtgagctgcgtctgatagtctttgagattccctaggggcaaagacaaacctttgtacctccccccaaaccccatgaaggcagggacatccgcccctcttaggtcagcccagcaactccttagccaccctaagtctttttttaattattaattttttggggggggcgggcagggtgacagggtcttactctgtcacccaggctagagtacggtgttgcaatcttggctcacctcctggcctcaacctcctggcctcaagcgatcctcccacctcagcctcccaaattgctgagattacaggcatgagccaccacacccagctcccacgtctatttttaaagcaatttgtctgtgggccctttgcagggggcagcttcccggaggccggtggccaggccctgtaatttgggaagattgtgggtattcctggagcccatgggcagcctgtggcccagagctggggcactcaggctcccaacagggtgcggcctggcctccaaggtggtcaatcagccactactgcctctccccgaccacagcaggccccaaagtccagagtcccctccagccctgccttgaatgttggctcccctcccctctcccctgtcttacccgctgcttcaatggctaccaggcagtgtggccaccatgaacagggctgacttagagtggaagactgtgggcacccatcaggaaaaggggtgatgcctgccagccctattgcccaggtgaaaccaggaggcccactaggtgggcaggaggtgggttcttccctcaggaaatctaagcctcacctctcactgctccccaccgctccccaccgccgcctcctccacccgcctcatacccccagtcactgggtcctgtggatgcttccttctaaatctgttccctcctctccatcacaactgccactgcctttgctcaggcctccccttctctctctcctggccgatttcaacacttcctgcagttctccctgcctccatcttgcctgcagccagtctagtccccacacgagggcagagtgatcttttatatatatatatatgtatatatacacacacatatatatgtgtgtgtgtatatatatgtatatatatacatatatatgtgtgtatatatgtgtgtatatatatgtgtgtgtgtgtatatatgtgtgtgtgtgtgtgtgtgtgtgtgtgtgtgtgtgtgtgtgtatatatatatatatttttttttaagacggagtctcgctctgtcgcccaggctggagtgcagtggcgcaatctcggctcactgcaagctccgcctcccgggttcatgccattctcctgcctcagcgtcccgagtagctgggactacaggcgcccgccaccatgcccagctaattttttgtatttttagtagagacggggtttcaccatgttagccaggatagtctcgatctcctgacctcatgatccgcccgtcttagcctcccaaagtgttgggattacagacgtgagccaccgcgccaggccatatttttttaattgatttaattttagagatagggtctcgctctgtcacccagctggagtgcagtggtctgatcatagttcactgcagccttgaactcttgggctcaagcgatcctcctgcctcagcctcccaaagctgggattataggcgtgagctaccgcacccagccataatctttcttaaaattgcaaatttgggccaggtgcaatagctcatgcctgtaatcccagcacttcaggaggccgaggtgggtggatcacttgagttcaggagttcgagaccagcctgggcaacatctctacaaaaaaatacaaaaattagctgggcatggtggcatgcgcctgtagtcccagctacttaggaggctgtggcgggagaaccaattgagccaggaaggtcaagactgcagtgactcatgatggcaccactgcactccagcctgggcgaatgagtgagatcctgtctcaataaaaaaaaaaaaaaaaattgagcacatacaaaactcttcagcggctccccatttgctttaggataaagtcacatctctgaactaacccagcctccaaggccaagccacccccactggcctctctgaccccatcttccactcccctttgcattccaactatgctaaactgcttgtgactcttgctatatccccagcatctagcacagtaaatgtttactaaataacagtagttgtattaacactggcttgtatttattgaacacttactcttttttttttttcaagacagggtctcactctgtctgtctaggctggagtgcagtagcacaatcttggctcactgcaacctcctcctcccaagcaattctctctcttttttttttttttcagacagagtctcactcttgcccaggctggagtgcagtggtgcgatctcagcccactgcaacctctgcctcccgggttcaagtgattctcctgcctgcctcagcctcctgagcagctgggactaacaggcacgtgccgccacaactggctaatttttgtatttttagtagagacaggctttcaccatgttgtccaggctggtctcaatctcctggactcaagcgatccacctgccttggcctgtcaaagaactggagtacaggcatgagccactgcacctggccgctcaagtgattctcccacctcagcctcctgagtagctgggattatagacacacaccaccacacctagctaattttgtgtgtgtgtattttttgtagagatgggatttcgccatgtttcccaggctggtcacgaactcctgggctcaagcgatctgcctgtcttgacttcccaaagtgctgggattacaggagtgagccacggcgctcagcctgaacatttacttctcaccagtgttaagtattaacactcacagtgttaagtgtcttatgtacattatactacttaagcctcagaacttctgtattaggtacgtcctgttcctttccccattttgcagatgaagaagctcaggctcagagaggttaagcaactagcctaaggtcacacacacagccaatcaagaggagtgtgaatctggtgcccaagctcattctgtaagctgctgaatgaagaggatgtcctcacctcttctggccccagacaactcctcctcacctcacaaccaccctctttcctgcctgccccctggtctaccctaacagctctcttcagttcagcctagggtagctcccagggggcaggcagggggctgagacctctgccctagagtcccctgagcctttccccttcccctagatgcagagcatggagcatgggcgctgggacacaaactgtgctccatcatggtgaagcaggagcagagcccggagctgcccgtggaccctctggctgccccctcggccatggctgccgcggccgccatggccaccaccccgctgctgggcctcagccccttgtccaggctgcccatcccccaccaggtgagcctgggaactgtttgtagcggctgagggagggaggagggctggtgggtctgtgggaagaggtgcccaaagccctgtgccctggggctctgtgaacaggaagacatgagcctcagggctgagggtgggaagcccccgcccagcccaggcctccgcctacccccctggctgccccctcaccataccgcaacgggcacaagccacagcccccttggagtaactgaggctctcgtctgtgcagaaaaagacagcttgcagggctccaggcaggggtggcatcaggagcccagtccagggtctcagaggtggagacagcccaggccactgacttttctcaaagcttcagtatttttaaaaaagaaaaaagaccaaaaaggaaattacaaaaaaaagtgtgctatattccaattgtttacatttatgagattaatatttttaacccacactctcaggctgaactccctcctccaccaatgtgtagatgacagcattcagctataaacccaagacccctctgggaatgtgaaccccagacccctggctcctagccgaggtcctgcctgagtcccaactcggtgcctcctttgtgttctgggcatgttgcacatcctccttctctgtaaaaggggctcatgaaccccctaaggtgcttctagccctgggattccacaggatgagcagcatcttaaaatccctagatgggagcgtggctggccctgccccctgctggccacacggctcacttgctctaactgtacgtggctgaaggcaagaaaggtcagcccctccctgccccaccacagacccgtgggatcaagggtcggcggcaaatatgcaggatcttttgagaccatctccaagactggctctgagactcctcaggccttgccaaagcaggaagggatggagtgacagcagcagcagccagggaagaggagacttcagaaagggaaactgaggctcaaggggttaagtaatttgcccaaaatcatgcagttagaagcaactgacatgccttccaaattcggcctgccagaccctgaagcccacgcgagtgaggtcataacccctagtggaaggcacaggagctggcattgtcaacagtgagctctctgcaccgcagtcccctctctgtcacttgagggctgagctgggatgtagaccaaggaatctccaaggtccctgccaacttgaaccttctgggattcttactcatcagcctacattctggattctgcgtcccacccacaatatcatgatctctctggggctgcagcccagggcctgcaatccagcccccaacaacgccttcctcagacagagcaccacttacttgcatgttggtagtcatgtgtacaaagccatgcatgctcttgaagtcctttctggaacaacaagtcagaatagaaataaagagaaatgcatgtttgttaaaaatgtccatctgattctatcaagcccttacttcaacccattaggagctctcattgcctccaacttctttgtctagattctacttctatttataccccgggactcatttcagactttgacttctcagggagcatcctcggagcccccagccaattaatgcctccttctgtactactgctaccagccattgaacagctacactgttccagacattacctcttgttttattctcatggcaacccacataccaaagcctgtgtggccttcacagttggtgtggaaggtggccccacactcagaggctcaccttctctgagcttaaggtctgagctacactgcttggccagcaatcctttctcttaggtgtgacttggcttctttaagctcaagagcttgcctctgttcccttgcagctgtgcccagaactccaagcccagccacttccccaactgtgcagggcaggcaaccagctttagggaggaggtgggtagatggcatggtggggacagacccaggggcagctaatggagctgggcttgtctgttcctcaggccccgggagagatgactcagctgccagtgatcaaagcagagcctctggaggtgaaccagttcctcaaagtgacaccgggtaggtgtgtccaggggaagggctcttttcccctccagtcataggcagatagcatccccacttccttggttcagcccatccctatctcttgacaaccttcccccacccagaatatcctctccaccctgccctacccactgtccctccatccatgcccactcttcgtctagtcctcttcgtttttgttttttgtttgtttgtttgtttgtttgttttttgagatggagtctcactctgtcacccaggctggagtaccatggcacgatctcagctcactgcaacctccccatcccaggttcaagcaattctcctgtctcagcctcctaagtacctgggattacaggtgcccaccaccacgcctggctaatttttgtattttttagtagagacggggtttggccatattggtcaggctggtcttgaactcctgactcaggggatccacctgtctcagcctcccaaagtgctgtgattacaggggtgagccactgcacccagccttcgtccagtcctcttcttgcccaatctactgctgccatcgctcctgcttgcccagcctgaccctatgagagagaggccccagtcaccttctggggttgctgagctagagcttagtgatcttctggagttgctgagcttaaggccctgaaccctgtgaagtcagaggtcacagaggacctcccacgaattcagctcctatgatgtctatgccaagggcgagcttgtaaaggagctgggcctctgtggtgtcagatgaggcagcacccaggaattggctacccagatgtcaactgtctttctgaccctgcagaggggcttctgatgtcatagctgagaccaagcgcctggcagtccgtgtcccacaatgtcagggctggtgcaagctcatgctcagctgaactcatgatgtccaagtggagctgatgtgcaacgttgctaactcggtttcccctgctctccccagaggacctggtgcagatgcctccgacgccccccagcagccatggcagtgacagcgacggctcccagagtccccgctctctgcccccctccagccctgtcaggcccatggcgcgctcctccacggccatctccacctccccactcctcactgcccctcacgtaaggagctgggggtgggctgatcccagaaatgaggaattgaatacatccacctgagcacactggccagtcaggagggtttggggagccccgagactgatccccaccctcatcagaattcagagggatgcttacctggcagatgggagttctaatccttttatttttgagtcttgctctgttgcccaggctggagtgcagtggctcaatctcggctcactgaaacatctgcctcccaggttcaagcaattctcctgtctcagcctcccaagtagctggaattacaggcacttgccaccgtgtctggcttttttttgtttgttttttttttttgagatggagtctcgctctgtcgcctggagtgcagtggcacgatctcggctcactgcaacctccacctccagggttcaagtgattctcctgcctcagcctcccgagtagctggtattacaggtgcacaccaccacccagctaatttatgtacttttagtagagacagcatttcaccatgttggccaagctggtctcaatctcttgacctcttgatctgcccacttcagcctcccaaagggctgggattacaggcgtgagccaccgcatctggtcaggaattcaaatcctttcgccctgcctcatggtgaacaggagactattgcagagccaggactagaacttgacattcctgacctccaggggatgacccaggctgcctccaaggagcgctgtgtgaggggaagtgcccagatggtccagaatccccaggaaacatggagctaggccctgagccctgggatgggtgtggagtctcccaagccaagattgtagggaggggtctgagggagatgctgtttggggcaccctggacaagtaagctttgagggtgcagtctcagggatgggatccaggaagccctcccgaacaatgcactaagagcctaacacctgagctctcagcatggccctggcacctgacacatgttactgaatttcacccagatccactccctttccagatgaggaaactgaggcatagagcattgtgtgccttgcccaggtcatatagatagcacatggcagagcttgaatttgaacccagggctgcctggctcctaactaccacatcatacttcctacagaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaaggtaaagcctgccaccctggggcttcagagggcttccttggtgggtgggctcccctggcataccagctctgaaattggggggcccaggaagtgaatatgtggcagtgctaacccttgttttcgggcctccccctctagatctcagcccaggagagccgtcgtaagaagaaggagtatgtggagtgtctagaaaagaagtaaggggcttgggaggggtgggcaatccactcccttgcctgacctgccctcccctaggccctccctcagggggcagcagaggcagggggcacagggagtgtgatggtggtgggctgggccgaggagctgttgtgagtctgggggctgcccctgagcctgtgcctgcttggcccctacagggtggagacatttacatctgagaacaatgaactgtggaagaaggtggagaccctggagaatgccaacaggtgggtagtgcctcctgcatccaacctggccccctgcccctctgcaacccgtgcctggctctgcatagctctgggagacaggggagaggagagagaactaagtttaggatgacagggaccccagaaacacaccctgcagccttgggccacttacatcctgcccctctctgtgttcccatttttcctcacctacacctggcagggctggggagttgcttaagtgagcagatgttttcaaagtgtggtcctcagaccagcaacaatccctgggaattattagaaatgcttattctcgggccccatgccaggtctactgaatcagaagctccaggggtagggcccagcgccctgtgttttaataagccctccacgtaattaggttgcaccctcaagtttgagaaccactggtgtaaatccttgttactcaaagccagctgacccagacaggcaacatcagcatcacctaggagcttgttagaaatgcaggctgggcacggtggctcacgcttgtaatctcagcactttgggaggatgaggggggtggatcatttgaggttaggagttcgagaccagactgaccaacatggtgaaaccccatctctactaaaaatagaaaattagctgggcgtggtggtgggcgcctgtaatcccagctactcgggaggctgagggagaagaatcacttgaatccgagaggcggcagttgcagtgagctgacactgtgccactgcactccagcctgggccagactctgtctcaaaaaaaaaaatgcagaatttcagaactctctccagacttactgagctaaaaactgcacattcacaaggtccttgggtgattcacatgtactatgaagtttgagaaacaggagtatagagacagcaggacagtgcctggcaggtagcagccacgtcaagtcacagctctgggttcttacgctgctctgccatttttgtgactctggagaaatcgttaaatatctctgggcccctgtttcttcgtctaaatggggatgatagaaacattatctcatagggccaggcacagtggcttacgcctgtaatcccagcattttgggaggcggaggcgggcaaatcacttgaggccaagagttcgagaccagcctggccaacatggtgaaacccccatctctactaaaaatacaaaaattagccggatgtggtggtgcatgcctgtaatcccagctactcaggaggttgagggaaaagaatcactggaacccgggaggcagaggttacagtgagctgagatggtgccaccgtactccagcctgggtggcagagtgagactctgtctcaaaaaaaaaaaaaaagaaagaaaagaaacattatctcataggatggatgtgagggtattaataagatcctgcgaataaaggatccagcctgatgcttggcatttagaaatgtgcaattcatgttagcttttattcttctttcattatttttatttatttattttcttgagatagggtctcactctgttgcccatgctggagcgtagtggggtgatcatagctcactgcagcctcaaactcctgattctcccccctcaacctcctaagtagctaggaccacaggcgcacaccaccacccctggctaattttaagtattttgtagagacgtggtcttgctgtgttgcccaggctggtctccagctcctggactcaagcatacctcctgctttggctcccaaagtgctgggattataggtgtgatccactgcacctggccttctttcattatttttacttttttatttttatttactttttttttttttttgagacacagtcttgctctgtcgcccaggctggagtgcagtggcacaatctcggctcactgcaacctccgcctcttgggttcaagcaattctcatgcctcagcctcccaaatagctgggattacagacgtgtaccaccacacccggctaatttttgtatttttagtagagacagggtttcactatgttggccaggctggtcttgaactcttgacttcatgtaatcctcctgcctcagcctcccacaagtgctgaaattacaggcgtgagccaccacaccccaccattattttcattccaaattcctgatagtgcccagccatgagcctgtggtaggtctttaataattatttgctgggattaattacaataacctagacaacagccttggtatgcagcaggtgctcaacacaagactttttccttctttccttccttctcccccagcttctccagcgggatccagccactcctctgttccctgattggcctggagaatcccacctgaccccccaccccacccctctgtctctggctggggttcctttctggcccaaagtaggtccaagcccttgtagttatttcgccacctgctgtacattgtgggaactgcaacccctacgtgcccgtttgggtggagagagattaaacatttgcccaccaagcctgtgctgaacgcattctgtatgcacccagaagattccacgctgagtgggacccggtcctcaccctcagggaggccacagttaataaaggagactgatgtggagatatataaataaacgaagtgccgtgataaaagcaaacacagcaataaagcaaaaatggctgggcacggtggcccatgcctgtaatcccaacactttgggaggccgaagcgggtggatcacctgaggtcaggagttccagacaagcctggcaaaaccccgtctctactaaaaatacaaaaattagccggcatggtggcgcacgcctgtagtctcagctagtcaggaggctaaggcaggagaatcacttgaacctcggaggcggaggttgcagtgagtcgcaaacgcaccactgcactccagcctgggtgaaagagcgagactctgtctcaaaacaaaacaaaacaaaaaacctaacaaaaacaatagctaccatttactagacactcactacataccaggcactgtgccaaacagctccttcttatcagctcagggtgctgggggtgccagggagggaaggtcagtgaaactgtggcaggtgtcggttaagcaaaagaaggctggcatctgtgcagctgggggcaggccttccctcctccaacccccttggccaggagcatcacagggcaggcctgagcttccacaaggtgacccagccagtcaccatgaggcaggccccaggcgccaggccactctgcagaggagccacgcaggaggtgacctttcctatcttgactgaaacgggcacctggcgtggaggccaagtctggagccagccccctaggagagctccaggaggcagagatgcctgcggggtcaaagcctgccagctgactgctgtgccctcctcaggaccctgctccagcagctgcagaaactccagactctggtcaccaacaagatctccagaccttacaagatggccgccacccagactgggacctgcctcatggtaggtgtggctccctccaccacagacccacaggaggagagttcttcccaaggctggctttttccagggttgggcagagctttaaggatcggtaacatcgtgggcagcgtcccagggtacaccatcctggcgcctggtgggctggttctagcagactccagactccttctccaagcccatggtgccttctgcctcacaccggtccccgactggttaacacagtgtagatgtgtaggtgactccagtggccccagctaggggacagctgggcaggttccttgaggaggcggcttccacaggccttgtgcagggaagggcttggggagactcagggaagaacggacatggttctttctggaacagatggcagtgaaaaggctgaggaaacccctggaaacccggaaggctcccagggcgtgtttcagacctcttccagtccctcttctatcttcttctggaaatggccagtctcttgccgcctggctcagcatgccccggccctccgagaccctcgagctgtcaggcagcagaaccaggctatgggcaggggtagtgtgggctccgtggctctcagcacctcccgctagccaggctcctcagaatcctgctgagaacgtgatgtggcggtgtgtccccctccctcgtcccagccccaagccccacctgcacctattccttcctttcctgattcctctaccccgtaaggggactccacattggccacttccctcttacttctagcactgcctgtggcgacccccctacaatgggctgggatggcctgggctgtccctgccttccccagagaggataggagaccccacatgtaggagggagtggtcgactggagcagctgcttccttgggaaaacgctaagacttttgtgcctgttggtttgggagaggaggagtggggtggtcagggccgtggcccctccttaccccagatctgatgccactctctctttgctaccaggtggcagccttgtgctttgttctggtgctgggctccctcgtgccctgccttcccgagttctcctccggctcccagactgtgaaggaagaccccctggccgcagacggcgtctacacggccagccagagtgagtgcccgcctgtcatgccagctccctgggctgaggctgccctgccccagccccagtgtccaggcagaagccagacataagagagaagccaagtgtggggtcagcattatctcattttgcctcattttccagatggggaaaccgaggcccaaagagagtctatgctttgctcagtgtttgtggtagaattgggactaaaatacagagctcccgatgcccagcctagctcccagagagctcaggagtggcttgcaggaggtgggtttaggggataacaggaatgttccagccctgggccccatgcattatggtgccagtgcttatggggcatctgctaggcaccatcagtatctcatgatagggacagcaagtgagtttcagctcaaaagccatttccaataaggtggtggtagctgcctgaaacactgagttaagaaggaccctgggccgggcgcggtggctcatgcctgtaatcccagcactttgggaggccgaggcggtggatcacctgaggtcaggagttcgacgccagcctggccagcatggtgaaacctcgtctctactaaaaatacaaaacttatctgggcatggtggcatgtgcctgtagtcccggctacttgagaggggtgagacaggagaatcacttgaaactgggaggcagaagttgcagtgaaccaagatcacgccactgcagtccagcctgggtgacagagtgagactccatctcaaaaaaaaaagaaggatcctgaggcaccattcagaattgacaggaaggagtgtcatgatccactgataatgtctaccatggacagaagaagggtagcggtggtgtgggttcagatatctactgtttccaagggggatagtaaacgtacagtggttaggagcatggggatgtcaagtccatcgtaactggcactgccacctgctgtgtgaccaggggcatgtgtcttaagctttcatttcttcatctagaaaatgggagtggcaattttgcacttactgagccatggctgtgagacagtgcatgaaatagcacagtgtctgtgcttatgaaatgagcacactcagtctcttagagctcacggaggagagaatagctacatcacagtagctggcaaagggagaaccagggtagggcccagcaaagaagagtgtggatttcagacgcagagaatccttcaggtggacccacagaggaacttcctggctgtccctcatcacttaccagtcagtcacttaccaagaaccacgtgtctggcaggacaggaggaggaagaggaaacagatgggaggtcagaggagggaagattaaggagtgagtttcaagaaggagggatatagcagggaggatgagctagacgttgagggccttgaggggaggaagctggtgtggggagggttagggaaagaggaagtagagacagggagagtgaaagctcctccccggacacgtgcaggctgaggaggagagaacggggtggtcactaaaggcgggtgggcagcagcaatgcaaggtctggagagccatgtgtctgcttttccaaggccacagaagccactggagaaaaaggagtggaaagagagctggggttgatggataaagccacagtgagaggaggcaatgaatgagccccttggagggaaggcagtgggttttaggcccaggacctgggctgggtggagaggaagacacatcccagcaggcagatggctttggagcaggctggtttgcagagctggcgcactgcgcagttccagggacctctgttcacacagactatgaggtcatggctgcagagccggaggggcagcagatcccagggccaggcagacctgggttcgcatcctcccttcagggaggacaatttccctgagtgcctggaacttcagctgcctcctctgggaagcggggctaaagaaacctcattccctagagtttctctaagattttaaccactctacttaggtctatgggccttggataatgcctaacaaatgatgggtgtccaacaaatgtttgttttccttctctgaagggcaaattaggatctagaatggggaagagacttattccaggtctcacagaaagtaagtggtggactggccgggtgcggtaactcactccggtaatctcagcactttgggaggccaaggtgggaggatcacttgaggcccaggagttcaagatcagcctggccaacatggtgaaaccccgtctctactaaaaatacaaaaagtagccaggtatggtggcacacacctgtagtcccagctactcgggaggctgaggcaggagagtcgcttgagctcgggaggcggagattgcagggagtcaagatcctgccattgcactccagcctgggcgacagagcaagactctgtctcaaaaaaaaaaaaaagggagatagagcaagtaagtggtggaggttagaacacagctcccagatgcccaaactcagtaccctctgctaggaagaggtgacttttctgagtatttcctgaacacagtttcaatcacttcccctgtattacctcatttaaacctctcatttacatgaggttggtcctagtatccctattttacagaagagcacactgaggctcagaaagtttaaagcaaagtgtgtggcttacctgaggtcacacatccgggaagtgtcagagctgggactcagatccagggcctgcgtccttaaccactaggccatgaatgtggccaggatgttgagggaatcttgggcacaccgctcatcctacactccctctccagtgccctcccgaagcctcctattctacgatgacggggcaggcttatgggaagatggccgcagcaccctgctgcccatggagcccccagatggctgggaaatcaaccccggggggccggcagagcagcggccccgggaccacctgcagcatgatcacctggacagcacccacgagaccaccaagtacctgagtgaggcctggcctaaagacggtggaaacggcaccagccccgacttctcccactccaaggagtggttccacgacaggtggggtgtgtggcccctttccctcctgaggtctcaggctccacctgcctcctgcccacccttggtccccacattggccacaccctcccaaggccccatccctacttggtctagatccagcttgcagagggtaagagggttcctgctggacagtcatcgctggcctctcttctctctccaggatctgggccccaacaccaccatcaaactctcctaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaaaaaaaaaaaaaaaaagatgcagcatc

SEQ ID NO: 37840 - DNA, 18133 bp, Homo sapiens
gcggccgcctccgcgatgccgctgctcgtcgaggggcggcgagtgcggctgccgcagtcagccggggacctcgtccgagcccacccgcctttggaggtgagtggggcgcggcgcggggcttcggggcgggcccgaggggaagctgcagggcgggctagcgcccccctcacgcgacacagacttgaaacttggcgctgttggcacatccggagccccggccgtcggctcgcgtcttccccttgaggggtcggggagtttttgccttctttagacttcagcgggctgccccggaggccactctctgacaagggaggggacgggggcccagagaggttaggtgacttgcccaaggtcgcacagcactgcggctcggggacacgccgggacccccattccccgacggggcggctgcagcccccatagggctgggtccgtttaggcaaatccggccgcccgccttcggggacccgcagcctgcggtgaacgttgcttcgtccttgcgtccccgtgaagcaggaggttattccagggtgggcttcggagagcgtttggcctgggggatcttggcggggacccccagtccttcctcctctctctcccctacccccggggcgtagggcgccgagttatttttagccgggagagagagccctgctttccgcagctgggccataggaccacgccctgatgcacgggttttgtttttgttttttctgcttttgtgctcaaatagatctctgaactcttgtccacgcttatgcagggactgttggcaagggggttctcaggttttaaaaagagcggggcgtggcggcgggggcagacgtcctatttgccatagatcctgttaaaggggaatcaatcagttccttgatttgagagtcaaatatcgagcccctaatatctgttgggcaacgtactgatcactgtccctgccctcggagtgtttatagtctagaagggagaatggtttctgatgaagaaggctcagatactataaactgttaagtaccataaagaaaaagcgtcccctttcactctgagatgggaagcacaggaacctgaccaagtgtgttgggttggggaaggcatttagaggtttcatctgtcacagctgtacagtttgtgattattttgtttgcttgtttgttctctattggtctgtcgccagaatgtaagcctcctgaaggcagataagagtagtgtcctcacttttgtatcctcagagtgtaggacggtccctggcatagaattggcgctcagtaaagatttgctgcataaatgaggtcacaaaatgacccctgaacgtgttctgaagggtgacaaggacttactgacggggagaaggcagacagctctgtgtgattctcagcttgcatttcaggaccgaccatcgtctgttagccaacatgcaccgagctaggcgtggtggcgtgtcactttatccttgcgttgtgttactgtcctgttagctagcgaagtcaagagtaggactcaccaaggaaaaataatttcagccgcctgaagaatttaggggatgctctacttttatgtctgtttgaaaatgtccgtgatagaaagttagatgggtgtcccgggctgcacacttaagtgtggagggagatttggtgacataccggggctgcttctctcgaaggaaggttttggcctatttaagaagacatgtcctagaaaggctgtgtactggggaccagtttgtgttacaggaactttggaagggggcgatcactttgatttgcggcagtgtaagtgaagaaggatgcaggcacgagagagatttgaaaaggagaagaagggtgagggcatcgcagctgggcaagccgcctggggcgcggcgggcaggaggggaagggcccagtgggtgggtgtcctggccagtttctccggagcagcccgggtgaggaggggaagcatggaaagtaaccttacaggggtggattgtacccagatgaccaaatgaccaaggggcttagatggacctttcacctacttagcaacagggagacattaaaggttgggttttttgtttgtttgtttggttggttggtttttttgagacttagttttgttctgtggcccaggctggattgctgtggcacaatctcggctcactgcaacctctgtctcccaaggttcaagcgattctcctgcctcagcctcccaagtagctgggattacaggtgcatgccaccacacccagctaatttttttatttttagtagagacgggttttcaccatgttggccaggctgttcttgaactcctgacctcaagtgatctgcccgtctcggcctcccaaagtgctgggattaccggtgtgagccactccacctggcctggattatttttatataataaaacagggtgtcctctttgtaggaaagcaaaatataataatacagaaaaaaaagtatgactacaaccattctttagtttggtgaaagtcctaatgaaggtttttctttgtatataatttactttttttaaaaaaatgatagcttactatatgttgttttataatgtgtctttttcatgtaacgatgtgttctgagtatggagtaccaacagttagaagcctgtgtgtagctatgactagcaaataataacaataagtcatacagtggaagctgccaagcaccacagcaagagttactgctattcccattttacagatgaggactgtggggcacagagaggctgggaaactggccccaggccccacatcctgggagtggtgaagccaggattggaaccctggcagcctgcccttgactctggagctgcgctattcagtacagtagccacgagccatctggttacttaggatttaacttaaaaatcaattaaaattagataaaattgaaactcagttcctcagttgcagtagccacatttcaagtgccgagcagacagcatggctactaatgagacagtgtgaatatagacggtggccatcccagcatgaagttcctttggccagagctgtttagagccctcccttagtcactcttaaccagtcactgggtactcggtaaccagtcctgcaacatcttgggtaatacggttccacagagtctacaagatgctcgcagcgtagcttagttcctgcttttattatttatttatttattttttttttgagagacagagccttgctctgtcacccaggctggagtgcaatggcacgatcttggctcactacaacctctgcctcccaggttcaagtgattctcctgccacagcctcctgagtatcagacatctgccaccatgcccggctaatttttgtatttttagtagagatggggcttcaacatgttggccaggctggtctgaaactcctgacctcaagcgatcatctcgcctcggcctccaaagtgctgggattacaggcgtgagccagtgtgttgggcctcataatttcttatatagcattgtgctttacagttcacagatcaccttcatgcccctctcctgtttataaaggaagaattgataaacaggacagcaggggtgagggtcacatgatcatcccccaggtcacagctaggtgattggctaagacacaggtcaacaagccacagctcatgggccggaccctgcttatgtatagcctataggccaagaatggtctttatatttctcaaaggttgagaaaaatcaaaataatattttgtaacatgggaaatggtattgaaattaaaacttcggtgtcacctataaataaagttttattggaacacagccacatctgtattgtctatggctgctttcacttcataataacagcagagttgagcaattgtgacagagactgcggccttgtagaaccccaaatatttactgtctggcctttttcagaaaatctgctggtcactgggttaagagaatactgccattgaataggaactgggaaatagggatgagggactgagggaaaagcttttttttttttaagcaaatattagtgtctagagcatattagaggttaagaaaactgggactacttgcatatgaatttataaagtaggactgtgtggttttccaaagaagggaagtttggctaaactctttttactacttaaaagagcaaaaattagccaagtgtggtggcgtgcgcctgtggttccagctactgcaaaggaggctgaggtgggaggattgcttgagcccaggagtttgaggttgcagtgagctatgatctggccacagcacttcagcctgggcaacagagtgaggccttgtctctaaaaaaaaaaaaaaaaaaattaaaaataaagtagaggctgggcacagtggctcatgcctataatcctagcacaagtgtggtggcgtgcgcctgtggttccagctactgcaaaggaggctgaagcaggaggatcacctgaggccaggagttcgagaccagcctgggcaacacagggagaccccatctctacaaacagtacaaaaactagccaggtgtgtcggctcatgcctgtagttcccagctccttgggaggctgaggtgggaggattgcttgaggccagaggctgcagtgagccacgatctcgccgctgcactccagcctgggagacagtaagaccctgtttaaaaaaagaaattaaaaaatagagcaaagcagtctactgttttagttttctggcattctctcttctgataatttttgcttttatttctttgggaaatcgtaggagctgtgttgaagagagacatgatttttggtctttgtgaaagcagtaattaatttctcacaaatagctttgcttttgagtggtgacccaattgtgaacatgagtgttaaaaattcgcctttgcgccctcccttctcttcccttccctcaaagaacaaagcagaaggtaagtatctcaggagtaatcaagagggaattctgaattctcccctgttattctgaactaagatgaggcaagaagtggaatgagaaaatgagaggctgtcacctgtacaggtgttctgagttttagagcagtcacacctgtttctcactgacttctggagcaagcaaggctgtcttgcccatctaattttacactgcagttcatttaatctttagtttgtttcttaaattaaggggcttgtctcattttcattgataccttgcttccagttaatggaagtttataaacagaagaaaacaccatgtaagtaatcaagctgatcattatgtttattacatctcttcttttagtttaatcttaatttttttttttttgaggcagggtcttggtctgtcacccaggctggagtgcagtggtgcaatcatggctcgctgcagcctccacctcctggctgcaagtgatcctcctacctgagcctccagagtagctgggactacaggcacatgccaccacacccagctaatttttgtaatttttgtagagacaggatcttccttgttgcccaggctggttttgaactcttaggctcaagcagtcctccctcctcagcctcccaaagtgctggaattacagttgggagccatcacacccagctgctcttatgttttattaagtgagcgctaacctaaattagcaccagtcatgcgaaatggcaagaagctgatagaagactaagactgcaaaactgtcttcctgtgtaggcaatacatacatacgttgtctagacatttgaggaagattttgttcatccaggagtttgttgcaagtaagaaggaaattatgatacattgtagtgttgtatcaatttaatattttgaaaaagtttttgttaaataaccactgaatttttaaccactgaattttttttacaagcttactaaataagtgtgtacaaacactcagattattgacacttagtattaacatacctttcgtaaatttgccttatccattttgtttttgtattctaacaataactatgtgatagaacattgagagaagagaggacaacagcaacaggaaatcactcatgtttgcttttttggcacagccatggttgtactggtgaaatttccttccagtatttttctctatgggtataagcatttaatcattgttgtattatggcacatttatagctctttaaaacattttttatacttttgtatcttgcttttcaattagcatttcaaaactctttttcccatagttttcatttctcatgactgtgcagttagtggctgtgacttggttctgtgcccaatttacttaccttttccattgctgctcccagctttttgccattacaaattacacagggggctgggcatggtggctcatgctataatcccagcaccttgggaggccaaggcaggtggatcacttgaggccaggagtttgataccagtgtggccaacatggcgaaacccagtttctactaaaaatacgaaaagctgggcatggtggcgcacacctgtaatcccagctactggggaggctgaggcacgagaatcgcttgaacctgggaggtggagattgcagtgaactgagatcacgccactgcactccagcctgggcaacagagcgagactctgtctcaaaaaaaaaaaataagataaaagaaataacacagggatgaacatattttgagttatttccttaggacagatttccagaagtgaaattactaggttagggactaaggtaaaaaagcggaggccaggtatggtggcttatgcatgtaatcccagcactgtaggaggccaaggtgggtggatcacttgagtccaagagtttgagaccagcctgggcagcatagggaggccccatctctacaaaaagtataaaaatcagccaggtgtggcggtgtgtgcctgtactcccagcactttgggaggccagggtgggtggattgcttgagcccaggagtttgagaccagcctggggagcatagggagaccccgtcgctacaaaaagtataaaactcagccaggtgtggcggtgtgtgcctgtactcccagcactttgggaggccagggtgggtggattgcttgagcccaggagtttgagaccagcctgggcagcatagggaggcctcatctctacaaaaagtataaaaatcagccaggtgtggtggtgtgtgcctgtactcccagcactttaggaggccagggtgggtggattgcttgagcccaggagtttgagaccagcctggggagcatagggagaccccgtcgctacaaaaagtataaaactcagccaggtgtggtggtgcaagcctgtagtcccagctatttgggaggctaaggtggtaggatcgcttgagcctgggaggtggaggctgcagtgagttgaaattgtaccactatactccagcttgggtgacagagtgagagactgtctcaaaaaataaaaaagaggggatgtgatttcagagccatccatccactattcctgtgtaatctgattctctttacaatggtaaaattgttaagagtctcacactctttagtaaagaactgtgatagctgggtgtggtgggtcatgcctgtaatcccagcactttgggaggccaaggcaggaagattgcttgagcccaggagttcaagaccagcctgggcaacatagtgaggccctgtgtctttaaaaaacaaacaaacaaacaaaaaactataataaaggatttttgcatctcatttcataggttactatgacatccgatttcataggttaaaaaaaccaccgcgcagaaccgcatcgttttctctgcattgttctgaatgaccgtggctgctgcctttttctttgagcctctctgtccactaacacactccccacacactagcgtgctgcccacgcagagcccactttggctctctccacatctttagtttttccatcctcactaatttacatcactattttattttttttttaattaaacaggaaagagccagacttctcagaggtcagtctgttcaacaagtgggaccccagggccttctgtatgttcagcaaagagagcttgcagtgacctccccaaaggatggtaggttaggaagcagtgaattgggcgttatcccaaaaggctattggatattttattttatttcttttttaaacaggctccatctccattctgggttctgatgatgccactacttgtcacattgtggtcctgaggcacacaggtatgatgagagaggtgaaggaaaccattacttaaactgacccaacctttgggaccattgaatttctcgtgttgagtttcctggtgtcttgttggaagcggactccgcttaccttttttctggtctgcatggtgtctccctggtgtcctggtcagaatgggttggctggggagcacagacctgtccgtttttcccctacaggatattcaaagatgaggcggtccggagggacaggcggagtctcggcctgcgcactgcactcgcatcagggaataacttgagtcctttcacccttgttcttcaggtaatggggccacctgcttgacacattgtgacggaaccgacaccaaagctgaggtccccttgatcatgaactccataaaatccttttctgaccacgctcaatgtggaaggtgagatctacgctgctctcataggtgaattgagatcttggaaccgtcgcatacaggacgtggctgtggaagctgttaggggaacacaggatgccaccactgccgtgtctgcctcgttcccctggaacagaacctggcacgacgtgggcactgcgtcagcagtggttgagtgaatgagtgggtgctgggcacaggcaaggagtctgtgctggatttgagatggaaggcttgactttgaacttgatgtcgtctcaggaacgtcgaggttgcgattttcacatcgttttgctctcccccgggtgtggtagctctccatgcagtcattcctcccgcagttgcttgttaaatgcttcctctcacctacaccttgtagtttctagggacacagcagtgaagagtagacagaaagcccggcccaaggtgtttgtattccgaagccgagagactgtacacaagatggggtgttgggtggtgaggcggggctgtggagaaaacgaggccaggaagatgtggggaccgctagggggcgaggcatgtagttttttttcttgttctctttttgttgttgagatagggtcttgctgtgtcgccctgtctggagcacagttgtgtgatctcagcttactgcagccttgactttgtggactcaggtgattctccgacctcagcctcccaagtagctgggaccacaggtgtacaccaccatacccagctagctttttttttttttttttttttttttttggtagagacagggttttgccaagttgcccaggccggtcttaaactcttgggctcaagtgatcctcccagctgaggggtatagttttaaattccagcagattggtagtttccccaaggattgctggataagaagcggcctctagcctgggtgcccccacagcacctcatcctctctcactgcagtaaagtagccgctgcctccatttgacagagacgggcaactgaggctcgatgtgctggagcacacaggagctaggtggaggccgacgacacaggcctgctgtcaagaccactgttcacacacctgtcccctctccttgctctttgtggagacctggcaggtgttgctctcattttactggaagtctaaggcagccattgagtgaactactcccatcatatacgaaggcttaatcctaggagtctaaaaaggaaagagagagttctctgggagagatttgctagtcaatactggtcgattctaaattctccctctgtggtctgtgccaaggctgggctggcttcatggacacgtgacccatgcaggcccaaaatggtattttcattttcctatcatcttggcccccgcagggggacgtaatcaatgccattatgttgccacacactctgctccgtggttctcagaacgtgcttgtcagctcttcctgatctgttgtagaactgtgatcgctcagggagtcagaggcaaacctggtggcccagtggcaaagccatggtggtcgcagctctccttactgctactacttggagtttattatgaggccccttgaggctgtgccctatgttgggtacatccaagcttctggttcatcccttaggaagattttgtgtctgagaaggcagcgtaaagtctggcaacactttgccgagcgtgaattcgcccacttgacgggctgtggaaaagggggttagtagatgagtgtgggaaacactgggttcaagaaagttagttggatttttcagtcgcaggacttctcaagagcttcactgtgcaatgcgcagtgtgactcctaaggagggcttccagcaggcagttgcccagtctttttgttttgttttgtttttgttttagagccggggtttcaccctgtcacccaggctagtctcaaacttctgggctgaagcattccttccacctctgcctcccgcgtagctgggaatagaggtatatgccagcacacctggcctcaaaccttttttttttttttttgagacagagtctggctctgtcacccaggctggcatgcagtgatgcaatcttggctcactgcaacctctgcctcctgggtccaagtgattctcctgcctcagcctcccgagtagccgggattacagacgcccaccaccacgcccaacttacttatttattttttccccctgagacggagtcttgctcgattgcccagagctggagtgcagtggcgcgatctcagctcactgcaacctctgcctcccaggttcaagcaattctcctgcctcagcttcccgagtagctgggattacaggtgtgccaccatgcccggctaatttcttttctttttttttttttttttgagatagagtcttactctgtagcccaagctggagtgcagtggcacgatcttgactcactgcaacctctgcctcccagggtcaagcagttctcctgccttagcctcccaagtagctgggactacaggcacatgccataatgtccagctaatttttttttgtattttagtagagatggagttttaccttgttgcccaggctggttgcaaactcctgagctcaagcaatctgcccgcctcagcctcccaaagtgctgggattacaggcgtgagccactgcgcccggcctaatttttgtatttttagtagagatggggttttaccatgttggccaggctggtctcaagactcctaacctcaagtgatccgcccacctcagcctcccaaagtgctaggattacagatgtgagccactgcacctgtcctgtgcctgtgctcttccagagcaaagttccccactggtgcatggaggcggcatcacatttgtgttcagatacggatcccctcagtcatcagggcccctgggcagggtccccagaagctcgccactggccttggcagtgtgctgccgatactttcttttgcggtggcacgaagatgacctgcagctctgctgtagagcaagtgttcatggaaactgagaatgaaagttcaaagtgagaccagcgcacgcaccggtgtcttcttctggcctctgacccgtctcatctctttgccaggctggaagtacaccttgttggaggcttcagtgacgacaggcagttgtcacaaaaactcactcatcaacttcttagtaagttcattttttttttctttcccccaaattggacataaatatgtacccatatttgcttgggttaaaaatcccaattggtacaaaacccaagaagggcacacccacttggagcagcacagagaaacagactgcccagcttggaatttcacagaaagactgaatgcgtggagctcatgtgtagggaggggtagcagggctggggacaagattttctactaaaacagcagtgaacacattccaaaatagtaagtgctctgaattgtgtgaaagcagagccaccctccctcctggcaaaaatgtccattttaatctgcagaaaattaaaacactgatgataccattttttccctattagcaaattttttctttttttttctttttttgagatgtagtcttgctctgttgcccaagttggagtgcagtagcatgatctcggctcactgcaagctctgcctcctgggttcaagcaattctcttgcctcaccctcctgagtagctgggatcacaggcgtgcgccaccacacccacctaatttttgtatttttggtagaaatggggtttcaccatgttggccaggctggttgtgaactcccgacctggtgatgcacctgcctcggcctcttaaagtgctgggattacaggtgtgagtcaccacacctggcctaaattagcaaatattttcaaaaaagaaagaaagaaaacattgtcgtgtgttgactaaccaccaggccatgaagcaagcttactcatatgatggtacagcctgtctgggaagcaatttggcatcatgactgaaggcctcactctgccactcaggctgtagtgcagtggcgccatcatggctcactgcagcctcaacctactgggctcaagtgatcctccctcctcagcctcccaagtagctgtgactaggtgcatgccaccatgcccagctgatttttaaattttttgtggagacagggtctcgccataactcttaaaaaaggttcatatccggccgggcacggtggctcatgcctgtaatcccagcactttgggaggccaaggcaggtggatcacctaaggtcaggagttcgacaccagcctgggcaacatggtgaaactctgtctctactaaaattacaaaaattaggccgggtgcggtggctcatgcctgtaatcccagcactttgggagttcaaggcaggccgatcacttgaggtcagaagttcaagaccagcctgaccaacatggagaaaccccgtctctactaaaaatacaaaattagccaggcatggtggtgcatgcctgtaatcccagctacttgggaggctgaggcaggagaaccgcttgaacccgggaggtataggttgcggtgagctgagatcacaccattgcactccagcatgggcatcaagagctaaactccatctcaaaaaaaaaaaaaaaaaattagctgggcatggtggcgcacgcctgtaatcccagctattcaggaggctgaggcaggagaatcgcttgaatctaggaggtggaggttgcagtgagctgagatcacaccactgcactccagcctgggtgacagagcgagacttcgtctcaataaataaataaataaataaataaataaatagttcatcctttgacccagtaattccccttgtggaaatatatgctaagaaaataatctgaaatgtgcatagagatttgaacctgaagatgagcggtagaacattacttataacaggaaatctggtgtcatcagaataataattatgtagtcgctaaaaaataacacatgaaagggtgagaattacatgggaaaatacctatgcacaagcaaatcaggatataaaattgtcgactgggcgcagtggctcattcctgtaatcccagaactttgggcagccgaggcaggtggatcactttaggtcacgagttcgagaccagcctggccaacatggtgaaaccccatctgtctctactgaaaatacaaaaattagccaggcatggtggcgcaagtctgtaatcccagctacttgggaggctgaggcaggaaaatcgcttgaacctgggaggtggagactgcgatgagcagagatcgctccactgcactccagcctgggtgacagagcaagactccatctcaaaaaaaaaaaaaaaaaagatataaaattgtctttatagtcagctctgctgagcttagaaaaatatggaagaaaatacactaattattaacagtgttaggattatggacattaaaaaccgacttccttatgttctcttgtatttttcagatctgttacagtggccagatttttgtttttgtaattctgataatcaggaaaacagtttagttaggagaaaagtaaaaatcttataaatccatgggtccccgcaaaactctcagaatgaagagaaaaatgggaaggctcagcccaggctccttcgggcctgaggctgagaatgtggccatctcctggcggtcagggttctgtggtgtcagctccctagtgtctggccccataggccaggctgtggcagtgtgggcgcgggctgtagggcggagcacactcagttggctgccgtccctccctgtcgttggcttgctcagcagtttgttctggtaactagaggaacttttctgacttctggtcttaaaattctcatcataggtgaatttgacaggcaagaagatgacattcacttagtgacattatgtgtgacaggtaagtcctgccatttgccccaaagcaaagatgtgggtctcaggaccgttttgtccccagtcttgcagtgggcccaagcaccggcacacactgctgtcactgcttggccaccatctgttccggctcttcctgtggtgggatggccttccccttccccttgccctcgtccaccatctgccgagcctcagttccagtgcagccccctcgtctaccaggaaggagggcactggatctcagaggagctgccacccgtgtggcagacagggtgcacagagaaggtggggtgggagtggggaccgattctgcagctgccagtttgttcagtataaacccccctgccttgggacagggtagggaaacagggccacaatccctttcattttctggaattttcctccctttctgcatcgaggagctcctccttcgcctttattatacaaagtaaaaataatcatttggtatttctttaaaaagtgtatcttaaacattcttattttgtagaattaaatgaccgggaagaaaacgaaaaccactttccagtaatatatggcattggtaagtagtgtgcatcttttgtgggttggagtcttggtcacatgtgcagttaaagtctaattcagcaaaccaatgaccccactgctgtcaggatgggacagctttgggttcagatcccagctactccgaacatctgctgtgaggccttgggcaagtagcttaacttctctaagctttacctataaaactgagataacattcacttcttaagactttgaagaagcaacgtggtagcaaatagaaaggacaggccatgcccacccttcccaggagctgggaaagtgcctggttttgtttccctctccccccagcaccccaggcccggcgtgcttttctcctgccagtgctctgggggaggaaggcaggcactggaatccttttatacatcaggaactgaggaaggttttgcttgagaacagaaatcctccaaagtgtaaaactcttaggctagagaaaacctagaaccatcctccctgcttggcagccccaggactcccgcggaaaaggcatcatggaatcggctctatttccgagggcttctgctgtagcggtgatacttgattgatttagctgggtggtaggtacacagtgttcactgttctattctctgtaacttcgtgtatgtataaaatactaaattgtgaagattcaaacagaacgatcacagttcacccagccacccctggccgtacaccagtagggatgaccagaggttttgctacatgtccgactgaaggaatggctgcctcccatgtggaaagcagctcttggtttagaacaaaatctcaccgagtccagctcgagcctcagcgattttcaccgagatgcttggggtaaaggttgcattttccccctccagggagggggaagtccagatacttaggagccattctgttcactttcctatctttctcttaggagtggtggtagaaatgtaagactgtgcagactttccgctttggtcttttgtcaattcagagtcatcctgttgtccctcacagctgtcaacattaagactgcagagatttacagagcatcctttcaagatcggggtccggaggagcagcttcgtgctgcgcgaactttagcaggaggaccagtgagtttcaaatcatctttgttaaggggttaaaaaaaaaaaggcatcaaatgtcaaggccttaagtttttgggatcttagaaaagtttatgctgtcagcttctttatagccgtacattatcagggaccagcacatacatatacccctccccacacttgctgtctcaaaatagtaatgaacatctttaggtcatcagctccagttctctgcctaaaaggtgtgggaggtaagtgtgaaccccagcatccgaattcaaagagaacaaacttctgttactttgtaagagcttttctataaagttctacaaagagaggagaactgggacgcaggagagaggtttctcccctctgcactcaggactatgcattcttttggaccgggtcactgaagagcaatttgctggaacaatttaattaacccaaaataatgatcaaattaatttaaagtctgattcccttagggtgcttaattaaattacactgtaattttaaaagttagaaaactgaaaacccaaggtttatatgccatttgaggaatgggtgaaagaattctttaaaaatgctcaaagtgtgaaaaaacggaaatcacattcaggccaccccaaagaaatcttctcatttatgaaatgctgatgttttcactgggaaatgtgtttggattcggagccaacccttttaacatttttaggacttctcaaggagtgtaacaggcctagtttagttgatattcagaacatatttcagtgtcagttaccaaagtgaatattgctaggtaagctgaggctgccattggcaaatttgggaattcagggactggatcatttggcaaattagcttcttcttttgatggggcagcaggcactgtatgcttttaaattgcaaggtgatcagttgtttggggtataaataatgaggcaatgggaacacagactttagtcagaagcgcctgggtttgaggtccagctctgaggcttactggacacgtaacctgggaaatgggccttgtttctctgagcctcaagttttcaccccaaatgggaaaaaacaccctcgtcctgtgggactgctgttggcgctcagcagtcgtgcgtgccccacagtgtgcagaagcagacacactggacgtgttcagtagctggcagcttttgttatttgagacaggttttaagaagcttaggcagataaatgcatgaaaggactacactggagcttgcgttactgggagggtttgaaaagtgggtgacattcctgaaattctatccttgacacgttcttttttagatgattagcatttatgatgcagagacagaacaacttcgtataggaccgtactcctggacaccatttccacatgtggatttctggttgcaccaagatgacaagcaaatactagaggtgagagtttacaggctgggtaagtcttaaatctctgcaccctggtttccccatctgtaagaaaaaaagggtttagaccaggtcatagctgctttccctttggcgggtagtaactttttggatgccattgacagaccccatttaacttgtatatcaaatggggatatgtcaagtcctagatggaaatgtgtgtgggtaaagcagtaagcaatcaacttttttcttactaattcaggccacctcatttcttaacgtattttattatatatatttgtgtccaagaacaaagatactttgacatctttatcacagcaggggacagtaaggttggcttctctaatgcccaccatcttgtgttttcagaatctttccacttcgcctctggctgagccaccccactttgttgaacatattagatctaccttgatgtttttaaaaaaacacccatctccagctcacacactgttttctggaaataaagccctactctacaaaaaaaatgaagatggcttgtgggaaaagatctcttctccaggaagttaaaaaacatgaattaccaaagaaagcaccttcttggcctgacagaccattggtggggctggcacgaatccagatctggatcctacatctgttgggtcttaggcctccttccctcctcagtgtctttcaaatgactttcatcaaatgactttcaaaataaaaccttattttggcaaaggc

SEQ ID NO: 37841 - DNA, 18133 bp, Homo sapiens; identical to SEQ ID NO: 37840

SEQ ID NO: 37842 - DNA, 71766 bp, Homo sapiens
gccgccgccgccggcgcggaaggacgaggctgaggcgagaaacgaggtaggaacgcctctccggaggcgggcagggtcccacagacccactgccccgcgttccaaggtctcccttaggggagggcctgtcttcccacctatgtgccttcagcgcctgcccttcccttcagcccttccccctcggctgcacccgccctctgcgtccgccccgaccccctgggcagacctcgtccccagcccttctgacccttggccttctcctgacccttcagctctgcgtccaccggaccttcaaacacccagcacccaccgtccctttgggcgccaccccagatgcatccccaaccgtctcctcaaactgcccccttggggacaccctccccccacaaaacgactcgcgcccagtagtcaccttggtaccccaagtccctgtgacggctttggggaagcgtggccgcccggcacccaggccggcgactgcagcgggggcctccctactgccagttcccggccgggtcctctgctccctccacccttttagcccctgcctccctttattatccgcccggcgccggcgttgcttcagtctctgtctctctgtcatccagttttacctggagaaaacctttggcttggcagtaaccgtcccctactactgcactcacttgccgcgaagggcacggtgatcctgttgcccacagttggctgtggccctccaggccggccctgcggacacggggaactgtcctgggggcaaggacggtacactactcatctttgtatccccggtccccagcacggtgcctggcacatggtagtgttgctggtggagggtcttcactaccagttgtcctttgcgttttgaacaagtaattgagcagcggaggaatgaaacgcaggaacaagtagatctgagtcaggcaaggattaccactatgtgaacagtgtccgtgataaagaacacaggccttaaaaaaaaaaaaaaggcggaatttacaaaggacaaagggcctgaaacctgtttttatttattcctaggtgggtgacctgagcagatttagtttcctgggggtttgggttccacgcggaagcaggtggtatcgctgagggatgaaacaatggctggaaagctgtaggagttgataaggtagaaagtagttacctaattagtagtggcattattgtaactggggctcaaagtattagcaaataaaagtagtgactggattttcttagccggctccttagatattaagcagtggtggatggcttaatggaaggaagagcagatccaaacagtatacctggtattctgttagttatgcccgtcctgctgtatggccagccactgtttctcttctgttttgagccaggttaggatccctctgatttctgtgctggtatttaagattcctttttgaagccacagttgccttaactggaggctggacatgttctcattcatccattgctagttttgatgtatccttttccgctttctgtctcccaccctcttacatgtctttataaagtcttggatcaggccaggcacagtggctcagcctgtaatcccggcactttgggaggcccaggtgggcggatcactagaggtcagaagttcaagatcagcctggccaacatggtgaaaccccatctctactaaaaatacaaaaattaccgggcatggtggtgtgcacatgtagtcccagcaactcaggaggctgaagtcccagcaactcaggaggctgaggcaggagaaccccttgaacctgggaggcagatgttgcagtgagctgagatcatgccactgcactccagcctgggtgacagagcaatgctctgtctcaaaataaagccttggatcatagaaacccagtgtggggaggggctcctgatctggatggattaagcaatacaatttttttttaacagtatctttttaatggccttttctactttttcctgtctaggcttcctgttaagacctcagttaccccagaacaccctgggttatttttctcctcacctccaatacttcagtgttgccagataaaacgcagagtgcccagttaaatttgaatttcaaataaacaacagggagtcctgtatttttacttgctaaatctggcaagttcatgggagggcttatgtgttctatttttctctctgggcttatctgcaaatttaggataataactcacccttttcttcctgttactcatacacaatgactatgcaccctgctaaaagtcacttgactgaagagatggttcacttcatgttagggtaagggcaggctatctagaaatggtcttgattgatcagtgttgaagttacccaggaaaaaaaaaaaacacccattcagacattggcatttaatataatttttgtcaaatgagtccgtcatacgaaacgagagcatcattttgagtagccagatgtcaacattgctctgatagagctaggtgatggggtagaagggaatcctaacaacaacaaaataactcagcagaacctgtgctgtaccatatttactctttatggtggtaatatatatatatataacatagaatttaccattgtaataattcttaagtggcattaaatatattcacattattgtacaaccattactgataacaatctccagaactttttttcatcttcccagactgaaactctgtaccagtaagatgctaactccccatttctccctactccgccccaggcaaccaccattctactttctatctttgaatttgactactgggggtacctcatataagtggaatcatgcactatttgtctctttgtgactggtttatttcggttagcataatgcctttttttgttttttgggtttttttttaacttttattttaggttcaggggtacatatgagggtttgttatatagataaactcatttcacaggggtttgttgtacagattatttcatcacccaggtattaaacctggtacccaatagttatcttttctgctcctctccctccttctaccctcaagaagaccctggtgtctgctgtttgtttctttgtgtttatacattcccatcatttagctctcacttataagtgagaacatgcagtatttggttttctgtttctgttagtttgctaaggataatagcctccagctccatctatgtttctgcaaaagacatgatctcattcttttttatggctgcatagtattccatggtgtatatataccacattttctttatctggtctgtcattgatgggtatttaggttgattccgtggctttgctattgtaaatagtgctgcagttggttagcataatgtctaaagttcatccactttatagcctgtatcagaacttccctccttttatttttatttatttattttttgaaacagagtctccctccatcaaccaggctagagtgcagtggcacgatcttggctcactgcaacttttgcctcccagttcaggtgattcacatgcctcagcctcctgagtagctggaattacaggtgcacgccaccacgcccggctaatttttgtattgttagtagagagggggtttcaccacgttggccaggctggtctcgaacttctgacctcaagtgatccactagcctcagcctcccaaagtgctgggattacaggtgtgagccactgcacctggccagaatttcactccttttaaaggctgaataatattccattgtatgtatacactatattctgtttattcatcttttgatggatactttggttgcatctatcttttggctattatgaaaaatgctgatgtgaacatgagtgtacagatatgtttgagtccctgcttttagttcttgtgggtatatacccagaagtggtgttgctggattgtatggtaattttatgtttatgtttatttatttatttatttatttgaggaaccactgttttccacagtggctatagcattttacattctcatcagcaatgcataagggctccaatttttccacatccttggcaacacttgttttctttttttttttttaaataacaaccatcctaggctgggcatggtggctcacgcctgtaatcccagcactttgggaggccgaggcgggcggatcacctaaggtcaggagttcaagaccagcctggccaacatggtaaaactccatctctactgaaaatacaaaaattagccaggcatggtggcgcacacctataatccctgaggcaggaggctgaggcaggagaatggcttgaaccggggaggctgaggttgcagtgagctgagctcatgcccctgcactccagcttgagtgacagagcaaaactccatctcaaaataataatagtaatataaccatcctaagcagtgtgaagtgatatctcatgattttgattcatatttctctaatgaaaagatatcgagcattttttcatgtatttcatacctatcggccatttgtatatctttggagaaatgcctattcaagtcctttgcccattcttggattgggttgtttgtcgttgagttgtaagagttttttaatacattttggacattaatccatctcagatgtatgatttgcaaatattttctcctattccatggattgcctttcactctgttaaaagtgtcctttgatgcacgaaagtttttaaatttgaaatctaatttatctaatttttcttttgttacctgtgcattttgtcttacccaagaatcattgccaaattaagtgacatgaagctttccctctgttttcttgttttttatatataatatatattatacatattatataaaatttatatataatatatattatacatatataaaatttatatatattatataatatatattttatatattatatatactacagtatatattttatatattatatatactatagtatatataatatatactatagtatatattatatatagtatatattatatatactatagtatatattatacattatatacactatagtatatattatacattatatatactatatatatatattttattaaatatatataatatattttattataatataatttattatatataaagtatatatttatattatatatgatatatataatatataaaatatattttttatatattatatatattatacatatagttttagctcttatctttaggtctttgatccattttgagttaatttttgtatgtaatgtaagataagggtctaacttatttcatttgcttgtggatatccagtttttccaacaccatttgttgaaaagactgacctttccccactgaatggtattcacacccttgtcaaaactcatctgaccagatatgtgagggtttatttctgggctctctagtctcttccattggtctttatgtttatctttatgctgataaaacactgttttgattactgtagctttgtagtaagtttggaaaatcaagaatgtaagtcctccaactttggttttctttttcaagattgttttggttgttcaggatcccttaagattccatatgaattttaggatggattttactatttatgcaaaaaacattgttgggattttgatagggattgtattgaatctctagctgactttgggtaatactgacacctctaatgatagcaagttttccaattcatgatcaccagatgttttttcatttatttatgtctaatttcttccagcaatgttttgtatttctcagtgtacaagtctttcacttccgtggttaagttcattcctaagtattttattctttttgatgttactgtaaatggaattgttttaatttccatttcagattgttcattgttagtgtttaggcatacagctgattggataaagttgctccaaaacagatgaagaaaattacaccaaagcaaaagaagcatcagagagtgatgagcgagctagtaaccagagaaactctcgagtcagtggttgagtaagcagtggaggaggagggcttagatctagacagagtccgaacgagaagcatgcaacaagtggagacctacctcgaggctgcagaggttgaggcatgagagagccaaacttcaatcgagcgggttctcaggaagctctcagagaggatcacagagaatcaacaggaaacagaagtctctagagaaactcgacttaaaattaagtcaggcagtatcaccagttgagccataaataacaggttcatcttcgtagaaacaaagctcggtgcattaaatcttcttttgtttctacaaaggctccccaagggttggctaaccttagagatgctatgtctcttgcacctgcagtcacttatcccgctctatcaagcttgcacttggccagcccatctgcccctcctgctgaaggtgatgcatgggatccatgctcggactgttgtaaaccaagttctgtgatacgtcaattcctggtgttgtcctatttgaatatcctaaatttcccataagagttgttatgaatgtaacatgtaaatttactatcactgatgattcctctgaagaatttcatgcaaccaccagaaggtgcaagatcctagagatctacatatcttaggcattttccaggagtactccttcaactgtcgccctgcacctgattaagctggatatactatagtaaaacaatatgtaacagatccatgcactacatggtgttattgtggaaatggccctgacacatggccactcacttgacagctgtacaaaagacagttatgtttttgcctagaggacgctaaggttaaaattgtctttattgctcatcttccccactgatactgagcacacctggcatagctgagattaaactatgagtatgtatacttgaatctggcatttaatcctcacaaaacgaatagtgactacacagtcaagcatctttaatgggcaagtacttgagcatccaacccatgtaaagtttgacgatctgcacctctcctgtccttccccttagagagtgagtacaagtttctagatgacaggttcggtgtagactgttcagatgcatctggccaagttgtcatgatttctcattgagggaagagagatacgacacagcagtacattgtggatatgttgaacccattaattgatagtgcagccatcactgagaagcaacattcagtcttttcttgcagatctttactgtacaaccccttactgatatgaccccatttgttgagctgttgtggatgaaaagaacttaattgggttagtaaactggagaactgttttgttttggtgttgcaaacccatttgggtagaatttgttccatgggtcaacaactctgtatcccctggccatgtataagaacatcacaattatgtattaccagccatatatccgaatactatatgctacttctcctgaagtcggcagcagattgtatatcctaataaacacatctgtgggaagctatcttaggacaacaagatcttcattataccccaagaagatctccagacctagggtgattaaaacattaactgcagacattaaagacattgatattattaatgatatgcacactcatgtccacttaactgaccctcttgcattggcagtgggcccattagtagatgtagaggctattaaacatgagatcattgggcatgcagattcagtctcctcctttcactcctttggtgcaggatttatcacttctctgtccctgtggaacattgtgaaagatatgtatctacatctgtcacacttagacggaactttgtttctcctatcttttgttgtaactgccataggaaaattatacatgtactacaggacagtagaacaactttgcctatattctcagctaattaaataaaaaagctggtttttatgtgttgattttgtaccctgcatcattgctgacactaaaaaatgcttagggtatttgcaactaatcattattagttctaatgtttttgtggcatctttagggtgttctccatacaagatcgtgtaaccttggaacagagataattttagttttggttttttttttttcccaatttgtatgccttttatttctttttcttacctaattactcaggtaggaattccaggactgttaaatagaaatggcaaaagaatgccaggtttggtggctcatgcctgtaatctcagcactttgggaggctgaggcaggcagatcacgtgagatcaggagtttgagaccagcccggccaaaatggcgaaaccctgtctctattaaaaatacaaaaattagtcaggcatcttggcgcctgcctgtaatcccagctacttgggtagctgaggcaggagaattgcttgaccccgggaggcagaggttgcagtgagccaagatcatgccactgagctgagatcatgccactgcactcaagcctgggagacagagcaagactctgtctcaaaaaaagaaagaaaaagaggccaggcgcggtggctcacgcctgtgatcccagctctttaggaggccgaggtgggtggatcacgaggtcaggagatcaagaccatcctggccaacatggtgaaaccccatgtctactaaaattcaaaaaaaaaattagccgggtgtggtggtgcgtgcctgtagtcccagctactcaggaggctaaggcaggggaatcacttgaacccaggaggcagaggttgcagtgagccgagatcgcctggcgacagagtgagactacatctcaaaaaaaaaaaaacaaaaaaagaaaaaagaaatggcaaaagtgaaccatttctcttaacacacaatccttatgggattgttgatttggtatgcaagtccttaatagacactgaaaacaacattattttagcctggtatattattaatgttaacagtagtgaggccaggcgtggcggcttatgcctgtaatcccagcactttgggaggctgaggcaggcagatcacttgaggccaggagttcaagaccagcctgggcaacatggtaaaagcccagctctactaaaaatacaaaaattagccaagcgtggtggcatgcacatgtaatcccagctacttgggaggctgaggcacaggaattgcttgaacccaggaggcagaggctgtagtgagttgagattgtgtcactgtgctccagcctgggcgacagagtgaaactctcaaaaacaaaaacaaaaaacaaaatagtagtgagtcatcaagaaaagttaaattatagcctacataatacattttaaaaagttctgccaaaacacttaaagtttttaaaaaattaattttgatactttaggaagaaaccctctgttccttggaattgttggtttaataaaagtcttttatcttcaagaaaatgagatggtaaactctgaggtatgtgttgtatttttggcttcttgtgtgagttcctgcagacaaggacaatagactgataactgggtggaaagaaaaatagggccagccaacttctggctaaagtttaattatcttaggatcaaaagtctatacttaacttgtttatcttaggatccaaaaaaatctgtatttaatttatctgtttttatactttgtgcttcctttcttttcctgtataattctttttaaaaaaagaaaatgcacccttgtatttagtgtacttagggaaaatggacatttatttttatccacgcccaggcaaaagaaaaagagcaaagttctcctaaaggcagcatagataggatttagatgaacccaaggtaaaaagcaaaaactgcaggggagaaagttgggaacctactactagtcccgttcatcctcaagttgtttctcttccaaaatgttctttacttgttttttgaaagttgtttatttctgtttaaagatacagtcaaactttgttaaagttggctgtattctatttatttaaagttatagccaaacagaacagcttatttttctagagttccggatagctagagtttttctataagactaatgatttccttttaaacatctcccaaagcctagtgattcagacgtttctgccttactgtattagtctgtttttatgctgctgataaagacatacccaagactgggcaatttacaaaagaaagaggtttaaaggacttaaaggcaaggaggagcaagtcacatcttacatagatgacaggcaaagagagagagagagcttgtgcagggaaacccccttataaaaccatcagatcttgtgagacttatttgcaaccacaagaacagcacaggaaagacctgcccccatgattcaattacctcccaccaggtccctctcacaacacatgggaattcaagatgagatttgggtgggaacatagccagaccatatcacttacttatctattactgtataacaaaacaccccaaaacttagtgacttaaaacaacaattgattttatttcacaattttgtggatgggctggtggttttttgtacttctgaaaagagttctaagaatgcttttactaggagcactactggaatgagttaaatttctcaaggtggctactttgttttttagagttttaaaaattctttcctcttgccaattattccctcataaccaatgtgaccactttgaaggacatatcttatttggtcatacaagagctattctttaaaatattgctctctttagttttatatttatagctatagttaacttcttagatagcatagtgtctctttcagtttatataatgttctttgcctgatatccaacacagcaacctgcaactgtattagtttattcatccttaatgatagtggctggagaaaggagggctggaagcaggatcacctgcctcattatacatttgtgagtcctttctaacaaccaagtggtggtgatgaatagctaacaaggagcatttatcttatgaggaaaaaaagacagctgtggctttttattggcctgtgagaatctatagtagagaataaagaatttcaaactttttttaaaacagacttttgttcaaatatattctacaggaaagggactcagaaagataaaagttgggctgttttggttgaatgcatggagttgggagaagtagtctaacctgttcaggtttccctcttttcatctacatccccttcacttccttttcaaagtcccctgaaggagctctgtaaagaatagttcagaagtcactgatacaggccgggtgcagtggctcacacctggaatcccagcactttgggaggccaagtaaggtgaattgcctgagctcaggagtttgaaaccagccttggcaacatgggaaaaccctgtctctaccaaaaataaaaaaattagccaggcatggtggggggcacctatagttccagctgctcccgaggctgaggcacaagaattgcttgagcctgggaggcagaggttgcagtgagccaagatcgtgccactgaactcctgcctgggtgacagagtgaggctccatctcaaaagaaatgtcactgatacagatatttcttctactgagttatgactccaaggtagaaagagataaagataaatggttgggtttgggatatatatagtcttcaactgaccatgcaccagtagcagccaaccatggttcgagagacatgtaaccaaaatatgtgctgcatacatacagtctccaaattcctatgtgaaatccttagccttaattaatttaatgagtttcatggaaccagaaatgaattatagatccttttttcctcctttagtttaggacctatgctagtttttttaatccactctagtcctgagtcaagatattttttctagccatgctttctagtttataatatgaaaacaatagttgtttttagaatatttaataatgtttatacttctaaaaaatatacactgaacattgagggctctgcacctctttccctttgagtactgttggtctctttgtccaatacttctacacatgtgcttctcaaacttgatggaaaaaaaaatcacccggatcacccctgaaattctgattcagtacatctggcatggggcccaagtatttatctgtgcttaataagttcacacatgaagctgattctgctgatctgcagaccacactttgagtagcatgactcttagatctaaactctgttctcagcctcttacttagtggttctcaaaatgtaaaggctttccccaaaccccaccccctaagaaaaagccctggtgcaccagacccaaaaattgaaagtcaaatagtgccactgtctaagagtgtgggatatatcaccatgggttttcttcctctagagattaggtttataaatctctcactccctcaagattaagggattgtgaagaagagttctaaggaaatacttttagctgtccagactttaacctcgaaaatccttaaactgaagttcctttttatggagaaagattaaaagtgtacattttcccttgaaagttaaaaaattttttttgtttaaaaacattttctgaaaaaaattctttttctgaatatagatgaaatatatgctcactgtagagaatctacaaaagacaagtataaaatgaaaagatatcattgaacagttcttagaggccaaaattttagcagttgtataagaaatctatgtttgaatgagccataacttgcttaccccaaatggacatttgtggttttatagtacttttaaaaatttttcaatagtttttgggacacaggtggtttttttggtaacttagataagtttttttgtttttgttttttgtttttgtttttttgagacggagttttgctcttgctgcccagtctgaagtgcagtggtgcactctcatttcactgcaacctctgcctcccaggttcaagcgattctcctgccttagcctcctgagtagctgggattacaggcatgcaacaccatggccaactaatgttttgtatttttagtagagatagggtttcatcatgttggccaggctggtctcgaactcctgtcctcaggtaatacacccgccttagcttcccaaagtgcagggattacaggcgtgagccaccgcacccagccagataagttctttagtggtgacttctgagattttggtgcacccatcacctgagcagtgtacactatgcccaaatattgtcttttatccctcaccaccacccccgccgttactcctctagtccccaaagtctattatatcattcttacgcctttgaatcttcatagtttagctcctactatgagtgagaacataagatatttggttttccattcccgagttacttcacttagaatagtggcctccagctccatccaagttgctaaaaaagccgttattttattccattttatggctgagtagtattgcgtggtgtatatataccacattttctttatccacttggttgatgggcatgtaggttggttccatatttttgcaattgccaatcgtgctgctataaacgtgtgtacatgtgtctttttcatatagtgacttcttttcctttgggtagatacccagtagtgggattgctgggtcaaatggtagttgtactttcagttctttaaggaatcgccatactgttttccatagtggttgtaccagtttacattcccaatagcagtgtataagtgttcccttttcaccacatccacagcaacaacatctattattattttttttttcttttttgagacagagtttcactctgtcatccaggctggagtgtagtggcatgatgttggctcactgcaacctccacctcccaggttcaagcaattctcctgactcagccacctgagtagctgggattataggtgcatgccactatgcccagctaatttttgtgtttttagtagagacagggttttaccatgtcgcccagggtggtctcaaactcctggcctcaagtgatctgcccgcctcggcctgccaaagtgttaggtttacaggcgtgagccaccgctcctggccattttaatactttttaattattaactttatgcaaaaatctttgtccacatctctgataatttccttagcatagaattctagaggtggagttactgagttaaatgatttgaatagttttaagacttgagatatatatttttccgagctcattattaagattgtaccaaaatatacatacactggcaatgaatgaaaatgcctgttgtacttgccttcaccagaattaactattattattttgtctgataattggtagccaaaaggtggtaatttattgttttaaagttcaaactttttgtatgttcattaagtatattttgtttcctcttctctgaaatgtttgttcatatcctggcaattttctattaagatcttagttttttgggttttttttctttttttttttttgagacggagtttcgctcttgttgcccaggctggagtgcaatggcacaatctcggctcaccgcaatctctgcctcccaggttcaagcgattctcctgcctcagcctcccaagtagctggtattacaggtgtgcgccaccacgcccagctaattttgtatttttagtagagacagggtttcaccacgttggccagactggttttaaatccctgacctcaagtgatccacctgcctcattctcctgaagtgctggaattataggcatgagccaccatacccagccaagatcttagttttaagtgaaataagaaagtcacaggacaaatatggcatgattccacttgtattagttatcaaaaatagttaaaatcatagaagcaaaaatagaaggaatggtggtggccaaggcctggggtggggtttgggggcgaatggggatttgctccttcatgggtataaagtttcagttatacaagctgaataagttctagagatctgctgtacaatgctatgcttatagttagttaacaatatgtgctgtacacttaaacagttgttatgaagttagatcttatgtgttttcaccacaattttttttaaatcttagtctttagttattcacacaagttctttacacattaaagatatatgcctatatgccttttgttataacaaatatttgcttgccttttaattttgtttgtgatttttgacatacagaatttcataatatctatatggttaagtctttagttttcttttgtaatttcattactcctttcagcaaatgcactgggagtctatgtcttgagtctgggactgtggagctcagatctttctgaggaactctttgtatgcacatggttttctctaactgagatcccttccttagtccccgaccccaccacatatttctactcctcctctaacagttcagtcatttgaccctcctgaaacttttcttgattacctcatgcaaacttgggtatgatttccactatgccttcatttgaccttgtctggagctccattataacaattaacaaattattttatataaccataaactccatgaggacaagaatagagtctttgaatccagggtctctcagagatctagagagaaattgacctctttcatttaatatatgaaattcttcatatattgaaaatgattgaaatccaaaccactattataataattttagtatattttaaatatttgccttaacaaattaattttaatactgtaatgattgtacttaggacagaaacaacataatcatctcagtggatgcagaaaacacatttgacaagtttatgataaaaacactcaactaggaatagcatctaacttcctcaacctgacaaagggcatctacaaaaaacccacagctaacatcattcttaaggtgaaagattgaaaactttctctctaagatcaggaataaaaggaggatgttcattctcaacacttctattcaatattgttctggaaattctagtcataacaattaggcaagaaaaataaaaggtatccagattggaaaggaagaaatataactattgctatatgcagatgatatggtcttgtatatagaaatcttaaggaatccataaaaactatcataactaataaactagttcagtaagattgtgggatacaaaatcaatggggacgggcttgcttttaggagtgatgaaaatatttcaaagttagattgtggtcagagttgcataactgtgaacacactaaaaaccactgaattgtatacattaaaaaggtgaattttatactatctgaattacatgttaataaagctgttaatttaaaaatatacttataactttgaatgtaaggatgaagagctaaatttgaagtcctttgtaagtatcaggcttgagcctaagatcttcctgtcccccttccccacaattcgtgataggctttattttccactatgcatttctggtgcctaacacaacgcctgacaaatggtataagctcagtaaatattggtagaatgaatagagaatgaatgaatgaattacagggtttgaactgacattaagcctagctcagcaaatctgttacatttcttaggttgctttgctttcacaaaagatctgattaatttagtaacattcacagagattatagcctggcacccaggatgagtatgattttagccctatgaacaagttttaaagaagtacagaagacagagtggtcagtgctgactggttgactagataaagctcatacaaaaaaatctgtgatccaagctgaacatgatctaaagcatctaagtaggaattttaaaaatcaaaataaatatataaaaatgggccaggcatggtggctcacacctgtaatcaatgctagaactttgggagcccaaggcaggaggatcatttaagcttagggtttcgagactagcctgagcaacatagtgaaacctcgtctctacaaaaaaaatttaaaaattatctgggtgtggtggtgcacacctgtagtcccagctacttgggaggcgaggtgggaggatcatttgagcctaggagggtgaggctgcagtgagctgtgattataccactgcactctggcctgggcaacagagggagaccctatctcaagaaaaaaataaaaataagaataatcacaaaataaatttaaatcacctataatcccactttcctatgctttctgtttacatgcatatataaattttgcatggatgtaattgtagcattaagattattttatattctgctttaatttagttcctaagcatttatccatgttgccacatagattttatgatttatagcttagtgaattccattcacttgttgaagcatcctcactagtagtcctttaacttcaataaaacttcactgatactacattcttttaaaagtatacttgcctgataaaaccccaaccctgaatgaatataaccccttaccttctccatgtctgtactcaaatagctcagctttgctggagaaagttgtacaggccagcatatttagcatcactctaaattcatcattaccagctgacagcactccagcgaacatggtgaatgttccccaaacccaccagactttctgtaagaagtatcacaagcaccaactccacaaagtgacatagtccaagaagggcaaggattctctgtgtgtctagggaaagcagcattatgacaggaagcacagtggctatggtgggcagagtaagccgattttccagaaaaaagctaaaactacagagaagattgtgctaaggcttgagtgtgttgagctcaatttcagatctgagaaaatgtggctattaagagatgcaagcactttgaactgggaggagataagtgaaaaggccaagtgatccagttttaagtgtcatcttttgttttgttatgaagacaataaaatcttgagtttatgttccaaaaaatttaaaaataaattcatcattaccgaagttaatattggcagcagtcttactatatttctctaacaagtatcctactctactctttgcaacaaatgtttcatcccttcattactctcttctacctctcaccctccctgtttccttccctatgctgttggtagtcttgactcatacctcagaaggaaaaaggaagccatcatatgtgagctctcttacttcctaccaccaatctgcaaacgtgtctacagccatcctctcctctctagttggaggaaatattccacctcctaacaaaagctaagtaatccctccctggcgctctggattgcataccctcctacttgatcacaattggttgcttactcagcaatgacttctctattcctcctttgaagcgtaacagtttgtttagatatccaccttcctccacacatgcctgtgaatgtgaacatatctcagtgtaatgtttgagatgactactggagccatgctctgacctaaggatggcagatttaaatgacatgttgaacctctgaattcactaacctggcagtcactgtgcctctggtcttcttgatatgtgtgacaatgaatttcctctgttgtttaagccactctgagattgtcgtcatccatatgcagagaatatcataccaaaatggtatactctttaagctatcccaaataaacctatattccaagtacaaacactgtcattgctatacaaatggaactttatgacaattccctgatgctactccattcccacctatcccttttaatctgtttgctgctcctaaaatcaacctatagcgaaattctggagccactacagcttctcaggtatgttattccatcatttaacctcttttcttaatctttcacatcagtggggacaaaaacaaaaggaaaagacagaaagaatacaagtacatttcccagaactgaagaatatgagtctacaaattgaaagagtccactcagcacccagcataacaaatagcaccaacataacttatcccagggtccttcatcttgaaaatttggaaaaccaaggatatagagaaattcctaaattagtctttaaaaaaaaaagttagaaaaatatcaggaatcagaatcagaatgaggctgggcacagtggctctcacctataatctcagcactttgggaggctaaggccggatcacttgaagctaagagttcaagaccctcgtctcttcaaaaaaaaattaaaaattagccaagtgtgatggtgcatacctgtagtcccagctactcaggatgctgaggcaggaggatcacttgagccccggaggcacaccaccttgtccagagaaacttttctaaagcagaagctgtggaacttagggagggtcacatggtgtacatgtctggaaataattagatcttttaaggagaatcttgtcagcccatgagtttacatggaagacttgcttctactgtgttctggtgacagtgagcaattcaagtagacctgtacctacccgtgttcattgggcaggaaattcttgatttacagttaacataaattcactctaacctcctttctatatattttcccgagatgttgcctaggttagagctgctttactttacaacttacagggggacaaagaacaaagccgtgaagaaaagttaaagaatttgaggtagtattcctattgaaaagaaaacactggctatgaccatgacatggttccctgttgtaaactggtaaattgaacggtagtacagtctcaaaaaggcaataggagggattcaggttaaagaaaagaggagattcctgattcacatttattatagttgtcatttattgagccctgcctaaataccagtccctgtcctagatgtcttatatatcttctctgtaactcctaccaccaccctgtaggaaggtattatccccattttaaaatgaaacagaggctgaggggaatcaaataacttgccagctgctacagaattagtcctgaagagcagagttctatacctaccttttcttagctctttacattgaccagaaagaaacaaaaatgaatggcctgatgctgaaaagagcaaatcagggttctatttctccagtgtaatggacagtagtttgttaattgaagtgagttcctatgccttaaataaaaatatgtaatataaaaataggtactgaattcccacaaaatgaatgggaataaaagtggagcttaaccaagagtatgttattgatagattccggtgacttttcaagagttttcaattcaggcataagtaattggctgggcatatggtggctcacacctgtaattccagaactttgggaggccgaggtgggaggattgcttgagcccgggagttcaagaccagctttgccaacatagtgagaccccgtctctacaataaaaatttttaaagagaaaacagataattttaattgccaatacagtgtaaactggaccctgattaataaatatgctaattggcctccctggatggagctggctttcatgatttaactatctttcctttgaatgcagcacattccaaaggcctacttaatcgagtatacagtcatagttatttatttgtttagtctccctgggtgaactataaactccatgaaggcaggcatcaggtttttttctttcacacactacagtgtctggcactttggaggtactcagttaagatttattgagtaattcctttagtccttgggtgagactttggcatttaaggttctcagggccgcagattccttcaaacgtttgcccaaagcagagaaggaaactcttctagagcactgttgtgtattactgggttgggctgttagatttcccaggtcctgcctcctttgggtgggcccctagggcttgatgccagatgggctgtgtttttggcaaagggcttgttcttattctgagattttgactataaatggactatgctatttgctgtccccactgaacccagtggggaagcagccgacaatgggagcacagagttactactttttctgctggaacctcccaacatctacccagagatagctccagtataggttggccaagcaggaaattccaaacacttttcctgaaactccaaacagcttgaggagtctcttcagatggagttggaaaagctcccagcgagcagagctgggtcttatgtaactttatagactgccctttttagtgtaactttatagcactgccctcagctagtgctggacttttgaaacatatcctgcattctttcctagctactcagcagtccctattggaagcagctaataggacagagttgaagactgtgaggttaaagggggagaaaaggagggcaggatgtctgtcattctgtctggaacctgctgttcttggtcccctgctgtggctcccactggcagtagagggagcgcattgccagatatgaaggaaactcatacttgagtatgagtatggtatgaagagaggagctgtcgcaaggatactccccctgcatattccagaagcccatcactggattccctagatccatttcagtaccccacatcccaaaaaggaggactagaactaagtatgtgtaaatatgtccacatctgtaatgagccaaattctgctctgaagaaatgtttccagtttatttggtgaagatttcagttcctcgaacttagttcaactcagtaaacattttaatcatctaccccatgccagactttaggctaggttcagtgactacaaagatgaagatagcctctgtccttagcatgcaatcaagaaggaaatagaaagtgtatataaatggttataatatactttcttgctttataatccttagtgctttttgtaattcttctatttttaactctcctaaaagatatatatcaggtttatgttatctacctgtaaactaatgtgctaattcaagataaaaatataggaaaatctcggccgggcgcggtggctcacgcctgtaatcttagcactttgggaggccgaggcaggcggatcatgaggtcaggagattgagaccatcctggctaacaaggtgaaaccccgtctctactaaaaaatacaaaagattagctgggcgtggtggctggcgcctgtagtcccagctactcgggaggatgaggcaggagaatggcatgaacccgggaggcggaggttgcagtgagccaagatcgcgccactgcactccagcctgggcgacagaacgagacttccatctcaaaaaaagaaaaaaaaaataggaaaatctcttcaggtataactcttcttttacaagtttctcatgaaaggggcaagcacaagtttcaagaatattttcatctaattttttgtttttattttcataattttctcaagctaatataaggcattttagaactttgaatataatttgaatcttttaaaacaacatttagctttctcaatgaattataatttgccctatgcatgcctgtagcttttatttcttctctgaattaaggtattaggcatttagtgggcactcattagatacctgttctcccagtacaggtagctgttctctttgaggctgtaagtgggtagtccctcatgtctcctgtgctgatgtttcatgaggtccaggctttcaggcctgtgaggatcccagatggcccaaaagagtcccatcatcccacttattgccagaaaatacagatgatcaaaaagaagatgtgtatgcattttttttaaataaaaatgggatcataccatgagttatactttgttttctgttttgttttgtttttccttcctcctcccgtccctcttttatacatcaagcaaaagagcacagttactgtggtaccaaacacacctgggtatgaaactcagctcagccactccccaattataaaaacatggacaatttttgtaaaacctctgggcccctgggaaataataacattaagtttaaccttatgaaatgggcatttttgcaggttaaaaaaaatgcatattgaccatttcacatcaccctaacagttccctccttgtatagttttgtcagcattaaatgagatgatgcacatgcagttataatgtctggcagtgaggtactcactaatgactataaatattaattgctactactactaggatgacgatgatgatgactgctaagaagcagaagcacaaatcaaagggaactgaaagagcagccattcttaggttttcaaccatggattttggacttgagaattatactttgttttgttgttgttgttgttgttgttgttgttgttgttgttgttgcttgagacagagtctcacttgtaaaagaagagttatacctgaagagattttccaggctggagtacaatggtacgatctcggctcactgcaacctccgcctcctgggttcaagtgattctcatgcctcagcctcccgagcagctgggattacagacacgtgccaccatgccaagctaattttcatatttttagtagagatggggtttcgccatgttggccagactggtcttgaactcctgacctcaagtgatccacctgcctcagcctctccaagtgctaggattacaggcatgagccactgcacccaacctgagagttgtactttgtaaattgcttatttaaaagaaaaaaaaactgtatcatgagcatagtttcatcttgacaacaattctgacacatctttttgtgttttgtagaatacttcattgcatggattgcatcatgatttatttaaccaattcattactgaggggattttaaaaatatttttaaattttggccaggtgcagtggctcatgcctgtaatcccagcaatttgagaggccaaggcaggaggatcacttgagcccaggagtttgagaccagtgtgggcaacatagcaagaccctgtctctataaaaaattgttttaaatagtatttttttgcttttgtaaatagtgcttcaacaaacatatatatatatatatatatatatatatatatatattactttatgtgtctttataatgttatttcttttaaatacgtttttatagaaatagactagagagtatgcttatttcaaattttgctacatactgcttggctgctctcttgaaaatttcattaattcatttgaaaatattaatctatgcatcccagacactgctaggttctgagtatacaccaacaaataatggtagacagggttcctgccccatgaaacttgctgtctagtgttagaagccaaataaacaagtataaaacacaatatagagaagtgcaaggtgctttgagaaaatacaaccagtagcctgggaagggccattggatttggaatattttagctaaaaacctaaaggatgattaggagttagacaaatggaggggcagtgttccaatcagtaccgagctgatccgagttgatagtatgactacagggcaaaagatgagagtgaagaggtgatttatcaaggctagcatatacctttagggaatttggattttatggaaagccttcgaagggtttttaagcatgaaagtgatataaatagacttcatttgatgtctattaagatgattctaggaagggaaaccaggttagaggttgatgtaggaacttagataagtgataaatataggttgctctttagtagcagtagggatggagaatgtggtaggatgtataaagtagcaatagatatgagtaacagaaacccaacactggtgacttaaataagatggaggtttttttctctcatcagcaacggaagtacagagatagatggtcctgggctagtatggcagctccacagtcattagagacccacaccctttccagttttttgctcggctatctctaggccatccttatggcacaagatgacctactatagttctagtcatcacagctaccttcctagcagcaggatggaggaagagatgaagaaggttgcaccctgttcatcataaagagactacccagaagttgcacacaacaattccaccataactcggtcaaatggccacccctacttgcaggggagggagaaatgtggaattttacttgggtagcattgtacctagccgaatatcagggttctgttaatttgaaagataaagggagaataaatatttgattggcaactaataatctgggacctggaaaagtggggaactaatttaattcagctaaattgtttacaaaataacagctcacacaaagatacacatataccactgttgaaaagagacttatttggctacgaggcaaagatttaacattaaaaatcccgttttcttgtaaagagtaaacaagtgttagctcatgtatgtctccagctttggtaggaatacagctgtatgcatttgacctgaatcactaccatgtaaaagtgtcatacttgtgatttttagtaccttgtcattcattaatattcagagtatagaaaaaggcagaccaacagattgctgctattttttttttcaagcccacagctaacatcatcgattgctgctatttgaaacaaagtcaaacaagacccaaattaagggatttgcttattgtttttctctatcaaggatattagctgtatattatagtagaaagagcaagggctttagattgagtcagacaaaaattgcaagcccaacttctctactttctgggtctgtgatcttagataaagtttatctctgcaagatcctcagtttcctcaactgtaaaatagagataataatatctactttgcacggttatcatgaggattagaaatgcacttatgggccagacacagtggttcacacctataattccgacactttgggaggctgaggtgggaggatcacttgaggccaggaagttgggaacagcctggccaacatggggaaactccatctctactaaaaattcaaaaattagctgggcatggtggcgcgcacctctaatctcagctacttgggtagctgaggcacaagaatcacttgaacctgggaggcagaggttgtagtgagccgagattgcgccaccacattccagcctgagcgacacagcgagattcttgtctcaaaaaaaaaaaaaaaaaaaaaaaagagaaatgcgcttatgacaaacatctagcatggtgagtaacatagtagataataaataattgctaataatattagaagaattactctttagcaataagtcatttgtttcctctagcttctggtgtgtggggaggtataactacaaagattcctaaccatttctatatcattcttaggatgcttctatagcagtttgccacctgtttacagaacctgtaactatttgtgatggtgcccagattaaagtcagccctaaatttttgctcacccctacccccatgcctctcatccatatttactgtgtccaaatccatctgtctattgatagtttccttgctatccacagccataccacatatagaatggggagtgagttcaggcctgagccaattcaagtgtggatttggaacttgggggaaagaaaaaaaaaggccttgtaggggtatgggatagtattaagcagaaacagaaagataaagatggtttatggttcattctacactccagaatgataatgcaataagctaaattctatagatggttttgaagtgttttatgtgagggaaattagccagtctgtcagctccaatacaaataacctcaggattcttccttcacattcctcagtgactcctcagaggggagttgcctctgagaaccgtgtcagccctgtggaaagaggatctctaggcaggcccaccagggtcagaattctaagatacagaccttgcatagagaggcctttaaggtctagagtaggagtcaatcagcaaattatggtccctgccagggtgttttcattcataagctgagaatggcttttacatttttaaagagttgttgtttgtttttttaaaagggaattgctaagaaagtaaatttcaaatattctcaccaaaagaaggtaagtatttgaggcaatggatatgttaattagcttaatttaattattccacatgatattcataaatcatagtatcacttcgtgatccatagatacatacaattataaattgtaaatttacaagaaaaaaattttaaaaagatgtggcagtactatatggcccacaaagctgaaatatttacagaaagagtttgctgatccctgattttgaggcctcttctctgaaaggaagtgggtctcaccagaggctgcaggaggtttgaacatctgttttgaatcccagggtagagacttacagaaaaagtaggtgtcaccatcaacaaagaatagatttctagttctcttcgggagttccagagacctggcaaactaacccaatactcagggatcgctgggctagaaagactgaaggcttgtgttaggtttagaatacagtatcgcctttgttctgactgagcagtagaatacatccctcattaatgttgctctctcaggccttttaggctatgttccagtgagtcctgctgctgaatgccacatcagtgggatacaggccccagatcagtgtcctgggcccacaaacaggggagaattagctttgtggctgctagatagacaagggagtaagtgaaattgtttcttttgcttatgtatttctaaattccttattataagttagtggaaattaataccttatgtctaggtaagcatattcctatttcgtctgttcctcaaaccagaggtggggattataggcctgaaagaagggcactgcatctctgggcacagactgggcctatttcctaatgtggccactgtgaccctagaagagggaggacacaggagaaggccagggcgctctgcctgcatgcgtggatgaccatgatatttctgaaatactttagtctaaagactacagcatttacatttcccttattctttttatttttcaaatattttttcctaccacacaccagaagatggatacagttagtccttttactagatggtaaatatggagctttgagagaacaggtactctgccccagatgacccagcaagttggaggaaaacccaagaatgaaagcagtgttcctgtctttgggcatcctgccactatcctaggcatgggtagtttccagatggagctaagatcaaactcctttatcactagtgatcaaatctggttgtttctaaggctgcactgttgttctgatgaccaagtggatcatccttgaatgacagggaaaaaatgtattaaatgagtccctcaccagcctgtcttcttgccagcaccctgacttcttaaggtattaacatgtcgtgtcactgatgatgacctaggattgcaggaagatgacagagtcactgttcctgtgtgcttggctgctcggctgttttgtttgcacttcagcattcctacctggtgtgtggtacatttttgtcattccacagcagtctgctgtgctcctggctccagagtaagctagtctacatctatttacatcagctttccagctgtcagcctcctcatgctcctgtctgcctgatggggcaagtagacactctggcaggagctgcctttcagggaggttagcaggatatccacagagttccagatactgtagtcaaagtataaagtccctaggaccccagtctctaggtcttgcagggatgaagaagctttcaggagattatctaggcacagctcctggcccaacaagatttctatcctagtgtgtcatgtctaggaaaaaatctctggtggcagattttcaaggaatttgatgtacgtgctaaaaactatacagatcggttgaggactggcctaacccatcctctgtctcaaattcctataaaaccctcccaaacaggctttttctttttctttacaatgtcagcactcagtgccctagtctgggacttatgactgataaggctgagcttctgggtagttgagtggcagtctttctttgtttttattcagatgatttcaatgcagccaatttgtgtgtgtgtatgtgtgtaccctgtccagaacaacagggcctacctgactcaagagagtactataagcaacagctttcaacttgaggtccatctggtcccagaggtttggcactagacagctggacatatgaaagctctgtttgttccccttcgtcttccctgtcctgtttaatgctgaactgttttcaacaagacttgcttcccgtagaatccaacttagtaacctggagaagcctgaggccactcctggagcaggaagctgccctagatttgggcagtaaccagtagaacttgatactgacgccagagcgtaaaaataaacacctcctacagttctgtcttaatccattggcatcagagttgctattattaacccataggcctcacaggcagctgtgatggtcagacaacagcctggacaaaacctatcctgccaacttgggatcacactctctccccttcacctactggaatatgatctggggccccaggagaagcaccatcagtctaggagcatgccctacaacaggtaacactggcggtggattagtatctttggttttggagagccttgaggctcccagggccagcctaccagcctagagtatgatggccacagacaggatgactgattcagtcctagtgtgggggaggaaaaaaaggaatgtgacccttccatttcctttggctcttttaaagagattttgcctgccacttccctgacctgaagactttagattttctgggaaattgggacaggagagaggaaagagctccactggtcatctgccaaagatataataataataatgacttattactaagcacctaccatgtgttgggtactttatgtacaatatcttacttatttttacttcaagcttttcagggaaaatatgacagttttacaaatgaggaagctgaagttttagtgaggttgagtgaccacccagaattccacagctggcaagtaatgtgtcagagttggacccagacttgtcttaacaccaaaatccatgttgtgaatcattatagaacctaggctgctgaatactcaggacccaggccaggcttcagctacctgctttttaaatgtgggggcttaagtaaacaaaaatatataagttactctcactttagtcttacaactaaagcaatagttactggtacacagaaatggtttttgctgccacctgcgagtgagccagtcccagtgctcttactgtccatggtgagctggactccagagactagcagggcaagcctcctggaagatgagatgcctcccagagaaaggctttgactctgcctgaggagtctcagaccatgactcctctgtagagaacatggccagattggaacctggttccccaggggaacaaggctttgatggttctggcagtcatgctgagggaggggtgtacttgaataaaaagattccttgaaggacaactaggcttcccccacccctctctttttccaacctcctccaccctggccccacaactggcttctgtaattcaatctagattcttctcatagcctactttactgtgcgtatgtggccttttatttacagctttgggcattctgattggatagcagcttcctagtctgtgtgcttcagtccactgcctgtggggtgggggagcagagtacactttgatttttgcttcctgaagcccaggagctaaaaggaatagccagagggctgcccacacagccaaaggactgaccacactgagcagtcaaagagcagcataggggccttttttgttccagctaactttctcctgcaaatacacacttgagggccatcctccaagcaaagcagtctgtgctggggctttcagcatccacccctcgtacactgtctctggtcttggtggcttcctgctcccttgctgctcacctacacctagcattgagagactttagcctgtgggccttactcactgctgctctctccatcacctcatctgaagaactcggtctgtcaaggtaggaaccaaatctttccttattccctatagtcttcctctctccccctaatacatcctcaaaagaaatagggtttacaacaaattcccagtctctagagacttacagctagcagttagaagccaggcacctgggagtataggtgtgtttatgtgtatttgtattcatgttggaatgcaggaggtcattttttttaacacactgcataggaaccttcccttgggctccaggttttaatttggcttaggttataattagacctgaaaaggaccttaagaggtcatctgattgagcccgctgcttccaaacaggtgctacaagttgagctaaggagggaatcaaatggttggcctaatggagaaaggtgtatacttttgctggctggatcagcagaagaaaataattttttgttttctagattgaatcccttttgagcatagagaccctaggggcaaagctaggtttattatcatcagattttaatggaataaagaaaagcaactctttcagctcagtgaggttcaatggctctagcttattcttttcctgggtatactttcccaatgctgcagtctccatttactgaattggagccttgggcgcctggggtcttttaccttttaggctgctaagcccattctacttcagagccaagcctcttctggaatgtttgtctttgacttttgggggtggacgtttagctgaacttttctacaacatatgtgagaagccaaaagcaaaccaagttctgtgcttcgaaagaggactctatattaaggaagcctaataaggcagcaactggtgtgtctgggacagcccttcaggctaggccctttcaacacactcccagcatgccgtctggcctcacttggagtccaaaataacatgatacgagttagaaacagtggcctcctcagctagcagcagctacactctacttggaggaaagacagatgacctcctgggcattggctgctattccatttatggaatcagactcctgatgccatagccaggtgctctcagcatctaagaacttgtttattctctctttacagttcagtcctagacacccacaggaatcactgttaccaccagttctgaaatctccaaattctttgagcctctctcacacatttcacagagaagtacttgtcctataggaaactcagagcctccatctaatctcatggcaagggtggagggtagctgactttccaaattcgtgtacaaagtttatttctgttctgggaagttaggtttgctattggtgaagttaatcaacatctgtttacaaacatttgatttgggaggcatgaaaaaagagagatgtttctgtcagttaattatttcactccccatatctctaactcccaacaaactatggtcagttctgcctttgcctagggttccctggaggtgcctctggggccccccacagtaaggagagggaattggagtgcatggggcattaggcctcctctgcttcaaccagggtagctgttttatgtattggggctgaaaaattaaaagcattgctctaacccttacaccctgaaactttctttttgctgttctggcctccagaggcatattggcaattattttaacaaaattatgagcccctcaaattgggctattacccctgaacatccagcatagctccttatacacaggaagaatacagtagatgcttgtggcttgattgcttgcttgattaattggctcacaagatgatattaattgatagcctcaggataattctagatcagagaatagagtacagtatgtaataatttattttgatttgttatggtttgagcatttctgacctttgctactggaatcaatcatgcagtctgaggtgaaaacttagccaaaaggaattaccttaactgaggttgtcgctgttggagaggatacccagtaagtcagcacaaacaaaagtaccttctgttgatttccaaagatttgtatgatttcaatccacctctgtccctggtgtactgaggtgaaaggtcagcagagtgattattgggaagaccaggcatagaggtatactaaaatcatatagtcctgtctattgattagtactgcttacttttgctaaaaattaccttcttggacagttcccaaaactactcattgtcttgattgtgggaaatgcaaaacttttctctgctaagctatacttattaacaacatctaaactgtttatctgcagcctgcattatacatctgcatatcttttgtgagggtggctttgtttttaattagcttatatgttttataaaattataatgttttttataaagctaaataacaggacataagtgaaaaaagcagccacattcaaataaagtctgccagttcagttaattgtaatgtactcaatgttaattgctttgttttaacaaatgtaccttgattacgtaagatggtaacattagggaaactggttaaaagaggtacaggaactctgaactatctttgcaactttttataactgtaaattattccaaaataagtagttagcttttaaaaattcatacacagcaataaaggtcttcacaatgaaaaaaaaagccaaatagtggctgggcgtggtggctcatgcctataatcctgtcactttgggaggctgaggtggctggatccttgagcccaggagtttgagaccagcctgggcaacatggtgaaaccttgtctctacaaaaaatacaaaaattagccaggcatggtggtgcatgcctgtagtcccagctactcaggaggctgaggtggaaggatggcttgagtccaggaagtggaggttgcagtgagccaagatagggccactgcattccagcctgggcaacagagggagactccatctcaaaaaattaaaaaaaaaaaataaaaatttaagccaaatagtgccaaatctggggcagtctgaacatcaaaatcagtaatggattatgacccactgactttttaaaatccaggggtccatatttatcctaaatcaataaattaagaaaggaaggaaaagggaaatctttattatgttagaatgccaactaatcaatgtagaaggaataatagaaaattgtcattttttggccaggcgcagtggctcatgcctgtaatcccagcactttgggaggctgaggtgggtggatcacttgaggccaggagtttgagaccagcttggccaacatggtgaaacctgtctctgctaaaaatacaaaaaattagctaggcatggggcacatgcctgtaatcccagcacctcaggaggctgtgggagacggaggttgcagtgagccaagatagggccactgcactccagcctgggcaacagggtgtgactctgcctcaaaaacacaaaacaaaacaaacctgtcatttttcaaccatcatagtaaataactgattcagatgaaactcatcaatggatgctaaaatgattggatgaaagtttgatgggaacaggttatttatctaatctaaaagtaatctctccatagattgcttattaattagaggagaaaatgataactttacaatggagaaacctgacagacactatcttaacgaaggactagttcaaaattagcatcatcaataaagtgataaaatgacctcatgtgttgggttttgtcttgttttgttctgcattatgtgtttctcccagactcctattttatgtttttgttgtactctttgttttctgttggaggctgccctcaaaagtctggtgatcccaggccgggtgcagtggctcacgcctgtaatcccagcactttgggaggccgagacgggtggatcacaaggtcaggagatcgagaccatcctgggtaacacggtgaaaccccgtctctactaaaaatacaaaaaattagccgggcgtggtggcgggcacctgtagtcccagctactcgggaggctgaggcaggagaatggcgtgaacccgggaggtggagcttgcagtaagccaagatcgcaccactgcactccagcctgggggacagagcgagactccatctcaaaaaaaaaaaaaaactctggtaatcccttggctactgatataaaaatgagccatttaaaaacactggaggttctgtgagagtggaaagatatatcaactggcaaacttgtctggtgggcaggtggaacaggctggcctttttttgtgtggggaaacccccagagaatttgacattcttttctctgaggtagttcagtttctgcagagaaataatctaccaggggtagggtgggataaataagtctggctgttggtattatcctgaaatagaaggaagaagtctagcaattctttggagattttcacctaacccctcagttttcagattggcctctcatcctgctttcttccatgccttgttttccagagtcgaatgcagttccactcaaagttctccagaaataaatctccagtaatcctgaggagcaggagaccagtggtctcctgacagtgtagggttgttggtggggactgggtgtctaattacttcttctacaaactttaaccaacatccctatttttttttttcctttaaaaagaatttttggtcgagcacggtggctcatgcctgtaatcccagcactgtgggaggccgaggcaggcggatcacctgaggccaggagttcgagatcagctggcctacacggcaaaaccccgtctctactaaaaatacaaaaattagcctggcgtggaggcacactcctgcagtcgcagctactcgggaggttgaggcaggagaattgcttgaacccaggaggtggaggttgcagtgagccgagatcgcaccactgcactccagcaagcctcagccacctttaaacatattttttaggccaggtgtggtggcttctgcctgtaaccccagcattttgtgaggcctaggtgggcgaattgcttgagctcaggagtttgagaccagcctgggcaacatgaaaccctatctaccaaaaaaaagaaaagaaatacaaaaattagctgggcgtgatggcacgtgcctgtagtcccaactgcttgggtggtggccatgcagagtgagttcctagcattttaacagtgctttatatttctataaaatggtcagtttacagagcactttcatgtactgttttgaatagaccactgttcagatctatagtagggggcatatgtttcccctaagccttcaactccccataaagtagcctggtccaggcacaggaagactcagtaaccaatgtttatattcatgcctgctttattttgagcaccctggatctctctattgcttatgaaagctgcccagaccactactgagttctggaagatgctgggattgaggagtggggaaaggtatccatatccagtcttttcatgtttctccaaggttaccgtcctattttggtcagaattgtgtaatctcctttgtgggggttttggatattaaccaacatcttatcacttgataatagtatcacacttactgggtatttactgtatgtcaggcacaatttaagtgcttgatagtattaattcacttaatgttggtggtattttcatcaccattctacaggaaatgggggcagggaaaggcaagataactggcctaggattacacaacactcaaacagatattacctcatcttgttaactattaaatgtattgcattcagattttacttggtgtggggtacagtggctcatgcctgtaattccagagctttaggaagctaaggcaggaagatcacttgagcccaggagttcaaggttgcagtgagctgggatggtgccactgcagcctgggcaaaagagagagaccctgtctcaaaacaaaataaaagccacacaaaaaatttttgctgatgtacagtttagatacttgttactgatattctttatcctgagatagttttacttcctgaatccatggattcttgttttctaataacttctgaaatattatctgtcattatctcttcaaatattacctctccttgattctctaccaaagattctgattataagtatattaaacattttcattctatcttatctcttaacttctcattcacttttctgttcctttgtttttttgtgctgtttctatgtgatttcttcagatcgatcttccagttcactaatttctcacttcaactttgtcttttctgctgttaaatttgtcctttcgttgttttttttttcttttttgagacaaggtctcactgtgtcacccaggctggagtgcagtagtgctttcatggctcactttagcctcaatctcccaggctcaagcagtcctctaacttcagccttctaagtagctgggactacaggtgtgcaccaccacattctgcttgcttgcttgcttgcttgcatatgtatgtacatgtgtatgtatctagtgacagagtcttgctatggtgcccaggctcttaccaaattcctggcctcaagcaatcctcctgcctcagcctcccaaagtgctgggattacaggtgtaagtcactgcacctggctgagtttttattttaataattatgtttctaacttctgaacatatttcgttctttttcagatctgcctggttatttctaataattcattgccactcgcttacctttgagatttatcttttattttaaaacatttcacacatagctgatttatattctgtaactgacatttttggtatctgaagttcttgcaatctaaatacattatttattgttttctctgttatttgctcatggcatctttgtgatcattaattataaactaatttttcttgatctttaattttgagaattttgttgacttagattgggaaatattttcccccagagaagattcatatctgcttctaccaaaagctgtggaacaccacctaccatggatcatgatgaacttccttcaggcttccctgtttctgcttaatgcagaactctcaggtttagctccctcaccttcccagtggctcaagtatggtcatcttggctgcagtgatgctctgggaattggctgacaaggaaccctggttctcccccttgcttactgcatagctcatgaatttttccctttttggggaattgggtagagtagtcacagagatgtctcctatatactgagagacctgaaatgcttttaaaagtatatattgcccaggcactgtggctcatgcctataatcccagcgctttggaaggctgaggcaggaggattccttgaggccggaagttcaagatcagcctgggcaacatagcaagatgccatctctacaaaaaatttaaacattagccaggcatggtggcacatgcttgtagtcccacctacttgtgggggctgaggcaggagaattgcttgagcccaactcaaggttgcagcgggctatgattgggccactgcactccagcctgggtgacagagtgagaccctattcctttaaaaaaaaaaaagtatatattatacaggatctcatatttttcatattttgcagtgaaaggggccctgtaatgtcttgattaccataatgtgggaagcagaattctctttatgcgatttgataccttttttttttttttgagatggagtttcgctctgtcacccaggctggagtgcagtgacgctatcatagctcactggagcccaaaagtcctgggttcaagtcagcctcctaccttagcctcccaagtagctaggaccataggcatgtgccaccacatccaactaatttttaaatttttgtgttgacagtgtctcgctttattgcccaggctggtcttgaacttctaggctcaagcagtcttctctcctcagtctctcaaagcactgatattttactttttaaattagcttaaaagggccgggcatggtgtctcacacctttaatcccagcagttggggagaccaaagtgggaggctctcttgaggccaggaattcaagacagacctgaccaacataatgagacccccatctttaaaaaaatttttaaaaaaaaattgtaaaaagtttaaaaaagaaaacaaaaaataaataaattagcttaaaagcctttttcgataccattgaatataccttgtatacccaatattaatggttctattatattccgttacatgggtagctcactagccatttttccattggatatttagaatattctcaatttttctctgttgcaagtaatattgcattgaacatcattggggaaatatgaggcaaatcaaggagggtagagatataaagaaaatgcataactgttattctggggcaagagttggcaaactcagatgccttataggagccagacaaataatgcaaataagtaaaatgaaccagtgaagctgccatgaggagtgctgggaacacggcaaactgaaggtcacgtgctcatctaatgaagggaaccacttctcagctccagctgattgttagtcatgtaggaatgagggcctagtgtagccagttcttttggttttttttcaagcaaaacaagctggaaatctagatttttttctagaaatccccaaaatgtttatggtggcatttttactatgcaaagcacataaaacctattgacatactagatgtgacagtcagtctgtcactttgcagcctttgctaatgtttatgatggcatttttactgtgcaagccacgtaaacctattgacacactagatgtgacagtcaggctggcactttgcaacctttacagcctttgctccagggtcatgactggatataaatgggagggaatgtactgactgaagacatatctgctcagtcatgtttccatcctcagaatgagcatggtgtgtaatgaagggtttaagatcttggcattaaagatttatttattaagcactttactaaggctcagctttcagtttttcttcttccttaccttcttcttcttcatcaaatatgctgttctcagaagagactgaccttctcaaagccagctgggctccatttagcctgctgtgcttgccatccattcagtagctttgtttttgtttgtttttgagactgggccttgttctgttgtccaggcttgagggcagtggcacaatctccactcaccgcaacctctgcttcccggcctcaagccttcctcccacctcagtctcccaagtagctaggactacaggtgcacaccagcacacccagctaatttttgtattttttgtagagacggggtttcaccatgttgccgaggctggtatcaactcataagctcaagcaatccgtccacctcagcctcccaaaatgctgggattacaggtgtgagccaccctacctggccagccattcagtagctttatcaaacatcattggtcctccactatgtgccaaggccctgtgctcagaattacctatcaatgtataagacacagctccaccatctagaaatgtaccgtcatcaagagataataaaatggccaagtcttgataccaaatgagttgtacgtataattggtattgaagtataggagaaggatttccatgataaagaaaagcttccagatatggtagaatttgagccacatccttaaaatgaagggtgggagggaatggggaaaacaatccagatatcttcccagtgagtaaagccaaaactcagagtatattcggcatgtgacgggaatggggttggataggtagaaaggaattttgggggttttttggttgttttttgtttctgttttttatgagactgggtctcactctgtcgcccaggctggagtacagtggtgcgatctctgctcactgcaacctctgcctcctgggttcatgtgattatcctgcctcagcctcccaagcagctgggattacacacacacaccaccacacctggctaatttttgtatttttgtagagacagggtttcaccacgttggccaggctggtctcgaaatcctgacctcaagtgatctgcctgcctcagcctcccaaagtgctgggattacaggtgtgagccactgcgcctggctggtagaaaggaactttgaacgccacattaaagaatttggggctgggagcagtagctcatgcctgtaatcccagcacttttggaggccgaggcgggtggatcacgaggtcaggagatggagaccatcctggctaacatggtgaaaccccgtctccactaaaaaatacaaaaaaattagccgggcttggtgtcgggtacctgtagtcccagctactcgggaggctgaggcaggagaatggcatgaacctgggaagcggagcttgcagtgagctgagatcgcaccactgcagtccagcctgggcgacagagcaagactctctctcaaaaaaaaaagaatttggatttatcctgtaggcagcagggagccactgaagatgttttagtagtagagtgacttgctgaaggaagttgaggagattacccttgtgcctgtatatgtgatagctgggaaccaagagacaacgaaggtaagaaaactagttagaagactatataattcagaggagaggtaatacaggcctgaatttggaggatagagtagggataggaactggagaggcaatagaggaagtggttaagaatactgactctggaatcagacaggtctttatctgagtcccagcttagacatttactgactgagttacattgggaagattatttaatatccctgagcctcagatttctcattcatgaagtaaggataataacatttagcttagagagtggttatatggattaaatgagataatgtaagtaagtgtttagcatagtagcggaaacatagtaaaaacaggaaattgttgggctgggcgtggtggttcacgcctgtaatcccagcactttgggaggccaaggcaggcggatcacgaggttaggagactgagatcatcctggctaacacagtgaaacccctcctctactaaaaatacaaaaaaattagccaggcgtggtggcgggcgcctgtagtcccagctactcgggagactgaggcaggagaatggtgtgaacccgggaggcagagcttgcagtgagcagagatcatgccactgcactccagcctgggcaacagagcaagactctgtctaaaaacaaaacaaaaagaaattaagtcaatgcccgaaacattggaaggaagactcagcatgacttggtagttgtctgaatgtaaagagagtccagatgactcttattttcaagtttgtgttacaggcagtccaaagagacctaatttgaaattttaaaaatcgatttggttttcgatatgttgaatttgaggtaataataagtatctgataggctattggagatttgattctggaagttcaggaagaatgtaagatttggaaatcaacggcaaaggtaatgggaagtactaaagactgttcagattgaaaagtcttcagatctgaaccttgctgtaaatttgcatttaaatatgggccaggtattgttttattaaacaacgaagaaagaattatctaagaagtagaactaggaggattggtttatagaagacaaaaggggttgggtttgatggcacatgcctataatctcagcactttgcaaggccgaggtgggcagatcacttgagctcaggagttcaagaccagcctggccaacatggtgaaaccccatctctaccaaaaccacaaaaatatagctgggtgtggtggcatgcacctgtaatcccagctacttgggaggctgaggaacgagaatcactttaacctgggaggtggaggttacagtgagccaagatcagccactgcattccagcctgggtgacagagcgaaactgtcttaaatgtctcaaaaaaaaaagccaaagggaaaagaggagttgaataggaaaggatgactgctgatagtgttggatgattccaatattataagttaaaaatgataactgcttcacacacttcaaatgttattagaaaaaagatttctggtggttaagaaacaatgaaggagagagtggagagagaattttaagagtccatttgttaaggaattttggtgtcgaggctgggtgtggtggctcacgcctgtaatcctagcactttgggaggcctaggcgagcagatcacttaagctcaggagttcgagaccagcctgggcaacatggcgaaaccccatctctactaaaaaatacaaaaattagccaagcatagtggcgcatgcctgtaatcccagctactcgagaggctgaggcacgagaatcgcttgaacccaggaggcggaggttgcagtgagccgagatcgtgccactgcactccagcctgggtgacagagcgagactctgtctcaaaaaaaaaaaaaagaagaatttggtgttgaaaaaagaaagagaggactatctgacgtccttggattgacatgcagtgatagcctctgctttctggtaccctgatattccacctctcacccatacccccagttatggggttctcaaagacttcagtctctgtggagctgagcaacaccactcaagctcctacagcaactgccactgtttttaacagctttattgaaatataattgacataccatacattttgccatttaaagtatacaattcaattgttttagtatattcacagttgtgcaactatgactgtagtctaattttggaacatttcatcattcccaaaagaaaccccacacccattagcaggcactccccatctctctgcctctccagcctctggcagccactgatctactttttgtctctatagatttgccttgtctggacatatcatgtaaatggaatgaaacaatatgtgaccttctgtgtttcttctttcacctagcatgttttcaaggttcatccatgttggagcatttatcaggacttcattcccttttattgctcaataataattcattgtgtgtaccaccttttatttatcccttcttctgttgatgaacattttggttgctcctagtttttgactatcatgaataatgctactaggaatactcatatacaagcttctgtgtggatgttttttgtttctcgtaggtatatacctagaagcagaattgctggggtcaaatagtaactctttaactttttgagaaactgccagaactcttttccaaagtggttgcaccattttacagtgccctcagcaatgtgtgagggttccaatttctacacatcattgtcaacatgtgtgattgcctgcctttttttattttagccattctagtggggtcaagtagtatctcactttagttttgatttgtactgcctaatgattaatgatgttaagcatttgtttatataagtacttgttgaccatttgtgtgtcttctttggggaaatgtttattcaaatcctttgcccagccaggcatggtggctcatgcctgtaatcccagcactttgggaagccgaagcaggaggatcacttgagctcaggagttttggaccagcctgggcaacagagtgagacccccatctctacaaataatacacacacacacacacacacacacacacacacacacacaatcctttgctcgtttttatttatttacttatttatttttttgagacaggttctcactctgtcacccaggctggagtgcaggggtgcgatctcagctcactgcaacctctgcctcccaggttcaagcacctcttgtgccttagcctcccgagtagctgggattacaggtgtgcaccatcacacccagctaatttttgtatttttttggtagagacaggttttgccatgttggccaggctggtctcgaactcctgacctgaagtgatctgcctgccttggcctcccaaagctctgggattacaggtgtgagccaccatgcctggccccctttgcccatttaaaaattggattgtctttttattactgagttgtaagtgtttttaaatatattctggatagaaatcccttatcagatatatgatctgcaaattttctcacattctgtgggttttcttttgactatcttgattgtgtcctttgaagaacaaaagttttaaatttttatgaagtcagtttatgtttttttttttattttttcattttgccagcaggaagtcaaagtttttctgtttttttcttttgtcacttgtatttttgatatcatgtctaagaatgtgttgcctaaccctaggttatgaagaattacttctttgttgcctaagcttcttttttttagatatggagtgtcactcctgttgctcagtctggagtgcaatggtgcaatctcggctcactgaaacctccacctcctgagttcaagtgattctcctgcctcagcctcccgaatagctggggttacaggtgcccaccaccacaccccgctaatttttgtatttttagtagagacaaggtttcaccatgttggccaggctggtcttgaactcctgacctcaggtgatctgcccgcttcggccccccaaagtgctaggattacaggcattagccaccgctcccggccgcctaagcttctttttgatagatttttttttttttcacatggaaaacagtcttctctttcaagcctattgagtcaagtctacccaccacttattctgatttacacacaaggagcttctcttttttttttttttttttttgagacggagtctcttgctctgtagcccaggctggagtgcagtggcgccatcttggctcactgcaagctctgcctcctgggttcacgccattctcctgcctcagcttgctgagtagctgggactccaggcgtccaccaccacgcccggctaattttttttgtatttttagtagagacggagtttcactgtgttagccaggatggtctcaatctcctgacctcgtgatctgcccgcctcggcctctcaaagtgctgggattacaggcatgagccaccgtgcccggccaagcatctctttttagattattcttgttcaacaagacttccatatgccaagcataagacaccttctatatgccaagcagtatgctaggttttatgggaaatacaaaattaaaatgatattcttatatactggataatggagatgtacagatgactataactccgactttgcagtctagaagagatgttaaggcagatatgcaaaaaagaacaataaccatgttaagtgacatgatttacttaatcaaaacttctcagggaccgatgctattgctgatgaagtttgccatcaatatgcaatgcaatgagaaagtacagtatgctttttcttataaaatgatgatcatcaaagtaaagttttttgtaatgatcctacttgacaatataagaagttggcaatccaatattgatccccgttttttgtggaagttgttttcttgtctgtaaaatcaacaacctgcaaccactggttcggagaacagattatttctggctctggggtaatcagagaagacttgatggaggagttgctctgggtctggtaggtttggataattttgaacagggccaagtgtaacaggaaggagagtctgaatgaacaaatacaacagagtggaaatgagtttctgaaacatgtttcaaggactgcatgatgggaaggcaaggttgagtggagtagagtagacagccaaggctgggcacggtggctcacacctgtaatcccagcactttgggaggctgaggcgggtggatcacctgaggtcaggagttcaaaacaagcctggccaacatggcaaaaccccgtctcttctaaaagtaaaaaacttagccggggcatggtggcaggtgcctgtaatcccagctactcgggaggctgagacaggagaatcacttgatcctgggagacagaggttgcagtgagccaagatcgcgccactgcactccagcctggatgacaagagtgaaactcaaaaaaaaaaaaaaaaaaaaaagaatagacagccgagatggatgacctctaaagccaaaatgaggaggctcaacttgattctctgggtaatgagaaaccattaaaaggggcaggaggagtggcatgttgaagaaaggtggtgctttagggagatgaatctggtagtactaaaaagtaaattgcaagtggggagactagttaggtggccgaggtttataatgtaacagtatttgtgttttgtttctggctggaaaataatttgatctttcctcaaaaccctagatctttggcagtagtggttaggaagtaagtggcaaggttgtctgtgatgtagtgaattaagccaagcactagaggtctgagagctgccaccttccataggcaactggaagcactggctgtccagcacaatgcatgacttagcctcgcagaaatttcagagtcaaagaccctgggcccagagctctcatggtaagaggctcgaactccaaacgcttggtcatgaagattcactctgccctaacctacagatgcttatccaaccccgctttgtggtatcagctaggcgagaggaaagcatagtgacaccatttcctcacctttcagcctccttgagatgaccgctaatggttggctatgaacagcagcctccctccttccttcctttcctcactgtttcttgctttataggatcaaggggccatggctgctcaaacaagtcaaggctggagatgggtctttgtgtctttgtgtgtttttgttcttctctctacaattgactcagctcagcatggtgtcagtggacacatgggtgtcacagggaataggagaaacaagaaaggaaaagaaaagttacatctcttctggatcctgagggatagctgttatggtcttggccagtggtttctccaaaggcttctttctaaggacctgaaatccaagggcaggctgtggagtccagatagtagtcaccttgggaggaaccctaggcagggctagtgtttggggaccaagccctgcttaagactatctctgtgttcaagcgtagcagcagggagcagtggcacaaagtggacggagacctcaccgctacttcctgtacaactggctctagctgcagtttctcccttttttccttattcccacagaattggcccagaacctgaggaggctggagcagggaaggagcagaggactctgtaggtctccaggcagaactgagatttttctgtggcctaggagagaccactccctgttccctgccttcctttccctggggagataagcttcctggcctctcagcctggctagagggattctgccttcacacaaacccagctggacccagctgagcactgaccgagaactgatgtatgtgagaggggccagttctacttcagccacagcgagtagacctctgaagacccagggaactgaattgaataccgtgttaggaagagggcctgcagcctccatggtccttaagacttaccaccacccagtgtacagaagcctgtctaccgccccgtctctctaggaaggccagtgctaagactcgtgggccatccaccaggactgagttcgagttactgctggcagaatggtgactggtccctgcagcctcccttctgggcttcaggaatcccctcccaggctgactgccccaccctgaggctagtctggaatcctggttagaggaaaaagctggaaaacagagtcattcacaatgggcaaaaagaggagggagaggtttctggttaagatatgaaaggaggagcctaaagaaggaaggaaggaaggaagctccaaggctctgcccagacatcttccctgagatgcctaaggacaaaagaggagctagacacaactctccccatttttcctttgctgtcttaagagtgctccatcttccagcactgactgccctctgtggctggctcctttctctaccctcccccttccctaggctaaagggcccacaggggctggaagggagggaggctgagtggctgtgctgtgggcctgcctgctcctttcccttcccccttcccttagcagcaacgtcaccgcagcaccagcagccgcggcagcagcacggagactggggctgggattgcgcagcctccctgcattagcaacgatgccattgtattagcagaaatcagatcttaggaaatcggcccagttcccctgtgtgatcccgtggaacagtgtctcagctggaactgtcgcggtagagcttggtcggagtgcaaaagggacagacgcatcaggggtccagctcaaggctcctgacagaggtatggctcagggagctgggggaggggcagggcagagatgctaggataccgatcagcacatttgggccctggcttctgagggttggctttgtctttccaaaagggagaggggggcggtgcggggggggataaaggggggaacatgcggaagcacaagcattagacaagctcattgcatacatttgggctatggtgcagagatggggaaaagccaaggcttgggctaatgccatttatgctattttgtcaagaagcagatctcatccttcctttttgggcatttctaatgaagcttctagtatgggtcagggatgggggagtcagatctagaaacaaaggcttaataggaggagacacccctacagctactgtaagtttatgatggagaacatgcaaggatcctcgcagctttcaagaggagggctgggaaacctttctctccacacacacacatacatacatacatgcatgcatgcatgcacatagctatacatgcacatagacacacataccatatcttctggtgctatgggagccaccaggctccaggtaagggtggagtaagaaaacattgaccagggtgccccacagtgtctggcaggggcagggacagtcattgtaatgcctagggcacctgatctgttacagtaagccttcaagaagagacctaagcataagctaacactcccaaatctaccctcctgccctcctccctttgatcctacccaggagaggaccagtcaggaaaagcgttatcagtcctacagaggcaccttatcaggatctcaagtcaaggtcagattgctagagaagagcaattgaagaccattgtgttccccatctttattcagaaggccaaaaaagagggaaggggttctatgactggcagaaagacactgatgaccaaagctagaggaaaccttctttctggggttttcccgcccagagttgctccattgctgagcaggtagaaagagttccctaaattcccatttccacacctgtaatcccagcactttgagaggctgggatgggaggatcacttgagcctaggagttgagaccagcctgggcaacatggtgaaaccctgtctctacaaaaaatttaaaaattagccaggcattgtggtgtgcacctgtagtcccagctactaaggaggctgggtgggaggatcacttgagcccaggagttcaaggtgcagtgagctatgatcgcatcactgcactgtagcctaagcaacaaagctagactctgtctgtaaaaaataattgtaaaaaaattcccatttctaataaccaccttggtagagggttcaaaaacataggataataggagacagtagtgccatgttgtgcaactatatggttaaggaatatgctggatagttatgggagtgtatttgttcccaggaagtgtctaggaatgtgaaccacaagagcagggaataatgagccttgagaccatgaatggggcagggagatgagggctgggaactggggcaggaggtgggattggcaagtgttatcatagcctggggacagtatgaaagggactgtaggttcatagaatagagaggccggtagacataacctgtgtaaatggaggctgaaatgtgggtctacccaggacaggtaggaagcagatgctctgggagcagagtaattgcaaggactttaggaagagggtgtggccccaatcattttctttggaaggccgttgtagtggaaataattacaaattgggcagacctgggattgaatcccatctcagatgtgtaaatgtggacaaactacttacacactctaagctttggttttctcatctttacaatgggaaggattatgcctacttaaaaatgttacagtacatttagagatgatatatataaattaatggcacataagtgtttaataaatgatcacttatagtattataataggacaagagacacccatttgggacaagggccaggaaaagggctctcatagaaagcttttcctgattttggagagcatgacctcataactttatactggctgagcccaccattccactctacctggtaggcatagctagagggctcatcttctgaaagagctgtcttctactttcttcttattctggatcctctgtttctcccccatcctcatcttccatgtctctccatttagtcagggcagaaaaagtctgaaatgagctcttccagctcactgttttctcttcaccttcattagaggggatgggccacttgtcttgatgtagaaaaagtcactcccaggaaaggagcctgagatacgctctcagtaaatgttctctgtggtgtcatatgtacagtttactctcattttttttttttaagacagactctcgctttgtcgcccaggctggagtgcagtggcacgatctcggctcactgcaacctccgcctcctgggttcaagtaattctcctgcctcagcctcccaagtagctgggattacaggagcgtgccaccacacccagctaatttttgtattttcagtaaagacagggtttcaccatgttggccaggatgttctcaatctcttgacctcatgatccacctgcctcagcctcccaaagtgctgggattacaggtgtgagcccccatgctaggtctactctcattatattcttaactgaccaagaaaaaagatcaaaagttaggattcctgagtctcatcttaattctgttatttattcactgagtggtcttgggcaagtcatttcatttttctgggtgtataattattttaaaatttttatatatataaaatttttttaaattatttttatatcatataacattttttaaaattttataaatataaaaataattccttatttttaaaaatgaagatggctctgcctcctttggaagttgatgtaaggatcagtaagatatgcatacataaaaagtgccttgtaagtaaatgtgaatggggtgggcaaagcatgagtacaaaatctcatgagatgcctggagaacttccccttagatggctgaattggaatcgtctatggaggagccattgctcggcctttctcttggttgtgtggagatcagaaaggaataagatcttctctgagatacaaaagcataaaataaaatgaaatcaatcagtgaaagagcttgacagttaaagtaggattcaatacaacctaaatgtaaaagctacaactatacagcttttagaagaaaacataggtacatttctttatggtcttaggacaggtaaagatttcttaggatacagaaagatttaaccatagagaaacaaactctatgatcagttgatcaattgatcaatttaaatttaataaattaaaaactatttatcaaaaaacacagttaagaaaacagggacaagccacaggctgagagaaaatattcatgaggcatatatctgacagaggacttgtatccagaataaatgttaaaactcctataattcaatcataaaaagactaacaactcaggttattttaatgggaaaagtagtcaacaaataaccaggcacctactgtgttccaagcacagagttcactgtattgcagtctccaacctcagaactgtgctccagtctgggagatagatatgtcaacatcacattacaatacaattgtcagtgccctccagccaagggctccgtcatctcccacgctcatgtgttcttcatctctgatttagagagtcagctttctgcattctgtatctgtacatcagtttttccatattaatgcatgtatgtcctggtaatggttttgtggcagaatcatacattcttttatgtgatacttgtgaatgcctcttgaaaatgctttaaaaaggaagaaaaggtactcattgaaggtcagtgatggctgcaacccataggtacccctaaaattactgctatctatgtaagaaagttctctatgctccttttagtccagactcgggattatggccaggactccaggggaaacgtagttatgtatgaaaggagaaaccccctcaaagaaaaaaaattgtttaggcccggcatggtggctcacatctgtaatcctagcactttggaaggccaaggcaggtggataacttgagcccaagagttcaagaccagccttggcaacatggagaaaccatgtctctacaaaaaatacagaaattagccaggcgtggtggcacacacctgtggtcctagctactcaggaggctgaggtggatcacttgagtccaagaggctgaggctgcagtgagccatgatcgcaccactgcactccagcctcggtgatagagtgagaacctgtctcaaaaaaaagaaaaaaattgcttaaattatgcataaaatgggtatttattacatacaaattagaaaatacagctgaagcaaaaagaataaaattaaaaataatccaaatcattcaacagtgataggcactggtaacagtttgttgcatgttacagattttcttctatgcatacagacatgtttatttacaaaaatggtgacaaacacctggctaatttttgtatttttagtagagacagggcttcaccatgttggccaggctggtcttgaactcttgacctcaaatgatccgcccgcctcagcctcccaaagtgctgggattacaggcatgagccaccacgcctggcctgatttcaggacattctatttctatggatttgcctattctggacatttcatataaatggaatcatacaacatcacaaaagccctttgtgactggcttcgattgtgcccaattttttggctactgtgaataatgctgttatgaacatttgtgtacaagctttagtgtgaacatatgttttcatttttcttgggtatatacccaggagtgcagttgctgggtcatgtgatgacactatgtttaacattttgataaactgtcagacttttccaaagtagctgcaccattttacaatactcccggcaatgtttcagggttccagtttcttcatatcatcatcaacatttgctagttgttattgtctgtatttcttattttatccctcccagctggagtgaagtagtatctcattgtgatttttattactctaatgactaatgatgttgaacatcttttcatgtgctggttagacacttgtatgtcttcttcagagaaatgcctattcatactgtttgccctgtcttaaactggatcatatgtctttttttttttttttttttgagacagagtctcactctgtcaccaggctggagtgctgtggcatgatctcagctcactgcaacctctgactctctagttcaagcgattctcctgcctcagcctcccaagtagctgggattacaggcatgcactaccacgcccagctaatttttatatttttagtagagatgggatttcaccatgtcggccaggatggtctctgtctcctgacctcatgattctcccacctcggcctcccaaagtgttaggattacgggcgtgagccactgtgcccagcctcgtatgtctttttattgttgagttgtaagagttctttatatattctgattagaagtcttttatcaggtatatgatttgcaaatattttctcccattttatggattgtcttttcactttcttggtggtatcctttgaagcacaaaagtttttggttcttatggagtccaatttatgttttttcttttgtcacttgtgcctttggtgtcatatctaagaaaccatcacctaatccaagataacaaagatttactcctatgttttcttctgtaacccttaatcttgtagctcagactctcttaatatctgcccttctacatctctacccattagcccattaaacacacaaaggcttggaagttcaacagaggagcctgccttcctctcagaaaggggaggaggaagcaagattgtaaataattgctgcttaaatttaacacaattatattttaataccttgtcccttatacgtatacttattagccatattttttatgcattgtttgttcatgtccttgagcatatgtgacttgcctcagactttaccacattccacatgacgagctatgaccctatggtctacatgagttaaattttaagaaattgattgtgtcaaggattcagttaaatgatgaataagagaaaggcaatgagggatttagactcagggtgagtgaaaaggaaatgataggaataaaaagagaaaggaaatgaatgaattttggaacattacatgtgaggagtcgaagggaatgaagactgttgcgacctgaacgtggaaacacaggagactagaacttgagcaggccacactgccacggtgcagccaagagaccagagaagctcaggatgggttctgtgtccttggcaccaggagaccttgaacaagagagaactttgctttagcctataagaggtaaaactgggaagagaagactttctagtggatcccagtagtgaaggttctaagctaaaactgggcagcatttgggcacttcaggatgtctgtatcctgagctagacgcatgttaagaatgtattatgcctttcacgtttatcttgtgtgatgtgttagaatgatacaaaagacataaaactaggtccccccacccccattgaggaggaagaggttgacatcagtcatacttgcagtcaccctaatgcccaactcagtgtctgcattcaagaagttctagtatagtagtgaggatagtaaggatacttagcccacggtcatcagaaagggacaaatattctggggcttgtaggacgagaaaggggatcagagataacagtcacttggtcagatgataccgtatattttaaaatgcttcttgcaaaattatagcttattgctatgagttcatattattcatgattttccctcttggctgtaaacttgtgtgctatagctgtgtctaagccttaaacatcctagatggttttttcttaattgtgtcattattcatagtttttttgtgctaaggactggtcattgtttactgccaaggagagggtccttgaaagagaaagggaaagtactgcccaaaccttcatatgtggcattagaaggacttggccttttgtcataatttgatgcatagtgaccttaaaattaagggggacctcaggtgctgcacctgtgcaatgcagaaagcatggttacgtccccacctgcctattgggctgtgtggtcaagctccatcttgactcaagccttttctcttcctgggctcttctccatctgaaaatgatgtagggaagggcatgcccctgacttccagggaggtgacattaggttccctttctttccctctctctccaggtgccaagctctcctgatgaaatgtgttctgccccactgggctccagggacagtgtctggtgctgttgaagcccttattcgaactttccagaatggatagtcccccaaagctgactggagagaccctcatcgttcatcacatccccctggtgcactgccaagtcccagacaggcagtgctgtggaggggcaggtggaggtggtgggagcacaagacctaatcccttctgcccacctgagctgggcatcacccagcccgatcaagacctaggacaagctgactccctgctattcagcagcctgcactctactccaggaggaactgcacggtctatagacagcaccaagagtaggagtcgggatggaagaggccctggagcccccaaacgacacaaccccttcttgctgcaggagggtgtgggtgagccaggacttggtgacctgtatgatgacagcattggtgacagtgccacccagcagtccttccacctgcatggcactggccagcccaactttcatctatcctctttccagctgccaccatctggccccagagtgggcaggccatgggggacaacacgcagtcgggctggagtggtggaagggcaggaacaggagccagtgatgaccttggatactcagcagtgcggcaccagccactgctgccggccagagctggaagcagagactatggagctggatgagtgtgggggacctggtgggagtggcagtgggggtggagccagcgatacctctggcttttcctttgaccaggaatggaagctcagttcagatgaatccccaaggaaccctggatgctccggctcaggggaccagcactgccgctgcagtagcacatccagtcagtccgaggcagctgaccagtccatgggctatgtgagcgactcctcctgcaacagttcagatggtgtgctggtcaccttcagcaccctctacaacaagatgcatggcaccccccgtgccaatctcaactctgccccacagtcctgcagcgactcttccttctgcagccactcagaccctggcgccttctatctggatctgcagccctccccatttgagtctaagatgtcttatgagtcccatcaccctgaaagtggaggaagggaagggggctatggttgccctcatgcctcttctcctgagcttgatgccaactgcaactcctaccgcccacactgtgagccgtgcccagcagtggctgacctcacagcctgcttccaaagccaggcccgtcttgttgtggccacacaaaattactataaacttgtcacctgtgacctatcttcccaatcatccccaagccctgctggctcttccatcactagctgctctgaggaacacaccaagataagtcccccaccaggccctggcccagacccaggccccagccagccctctgagtattacctattccagaagccagaagtccagccagaggaacaagaagcagtgagttcctccacccaagcagcagctgctgtgggccccactgtgcttgagggacaagtatacacgaatacttcaccccccaacctcagcactggacgtcagcgctcccgcagctatgatcgcagcctgcagcgcagccctcctgtccgcctgggctcgctggaacgtatgttgagttgcccagtgcgcttgagtgagggccctgcagccatggccgggcctggctccccacccaggagggtcacctcctttgccgagctggccaagggccggaagaaaactggaggctctggctcgcccccacttcgtgtgagtgttggggactcctcccaggagttctcacccatccaagaagcccagcaagatcggggggccccactggatgagggcacttgctgtagccatagcctgccacccatgcctttggggccaggcatggacctacttggcccagacccaagtccaccctggtccacccaggtctgtcagggaccccactccagtgagatgcctcctgctggcctcagagctactgggcaaggccccctggctcagctgatggatccagggcctgctctcccagggagcccagccaacagccatacccagagggatgcaagagctagagctgacggtaaggagcctaagggttagcaaatatgtggctattcaccagcaggatatgcatggccacctccctgacaggtccctgccagaccaccccatccataccactagaggttccacatcctagatctgttatccttctaggccagggcaggacccacagctacagtggaataggctcactggagaaagacagaggactcaaaaatacactgagcagactgggtgcagtgactcacacctgtgatcccagccctttgggaggccaagccaggcgaatcacttgaggtcaggagtttgagaccagcctggccaacataatgaaaccccagctctactaaaataaaaaataaactagccaggagtggtagcacccacctgtaatcccagctactcagggggctgaggcaggagaattgcttgaacccaggaggtggaggttgcactgagctgagatcataccactgcactccagcctgggcagacagagtgagattctgtctcaaaaaaaaaaaataaataaatacactgaggagataaaatcagcaggacttagaggctgacatattgggaaatgaaggattcagaagactgattctgaacctggatgatgggaaagatgaggccatggataggggctgtaatcacaggagatttcctggaagaaaagttcaggttcagacctttaggagtttgcagtgcctaaggggcaaccaagggatatgtctaacaacaacaacacacacacactgggcgtcagtgaagtttttttttttttctttttgagacggagtcttgctctttcgcccaggctggagtgcagtggcctccctaggccagctctttccctatttattttgttacattttaaataaatattttataccagtgtgttaaggtggtgctagtgacagagagatgagagggatgactctgttttcaaggattccagctaaggacagaaacagaaaacgtagttgatcattaaaatgcagagatggcagtgttccgtactggccagtgaaaggggtatgtaaatcagactgaaacgtcagggaggaactgctaatgcagttacatttaagcccaatctagaaagatgattaggattgggctttgtgacgacttgtaagaagaatgttctaggctcacaggattgtctgtacaaaaccacaaaggcacagaatagcttgaccctttctaggaactgcatataatttggtgaagccatagtggaacacaggtggaaccactgaaaaattttagagaaatggcttttggcatttgtttgtttttgtttggtttggtttttctgtctgcttaattatatgttttgatttgcatttagaaagatcactggttggttgttccttcaggccttgtttaaaaaaaaagtaattgggctgggcacagtggcttacacctgtaatcccagcactttgggaggccaaggcgggcggatcacctcaggtcaggttttcaagaccagcctggccaacatggtaaaaccccatctctactaataatacaaaaattagctaggcatggtggcgcatgcctgtaatcccagctactctggaggctgaggcaggagaatcacttgaatctgggatggagattgcagtgagccgagatcacgccactgcactccagcctgggcaacaagagcgaaactccacctcaaaaaaaaaaaaaaagtaattggatcactggttgtttgggtagaagatggactggaaggggtgtcttcctgaagtcaggagaaagcactgtgtagattggaaagtcattggaataaaagtggtagctggcacttgctgggcgtggtgactcatacctatagtcccagcactttaggagactgaggcaggcagatcacctgagttcgggagttcaagaccagcctggccaacatggtgaaaccccatctctactaaaaatacaaaaattagccgggtgtggtggtgcacgcctgtaatcccagcgacatggaaggccgaggcaggagaatcgcttgaacccaggagacagaggttgcagtgagcctagatcatgccactgcactccagcttgggaaacagagtgagactctgtctcaaaaataaaaaacaaaagtggtagctgaagctatgtgtgtggctgagagaggatccagggagaatgtgttgagttataaagggaagaaggggatactgtgacttaagggatgagcagcaccctcaaaagagacagaagaattaggacaatagaagaaaaaccaggagaggccgggcatggtggctcatgcctgtaatcctagcacttcgggaggccgaggtgcgcgggtcacctgaggtcaggagttcaccagcctgaccaacatggtgaaaccccatctctactaaaaatacaaaaattaggtgtggtggcgggtgcctgtagttccagctacatgggaggctgaggcaggagaatcgcttgaacctgggaggcagaggttgcagtgagccaagattatgccactgcactccagtctgggtgacaaagtgagagtccgtctcaaaaaaaaagaaaaaccaggagagagtgaagtcacaggaaccaaaggaggagaaagtttaaaaaaagtttgaaccaaaagagttctaaagagaaatcacctaagataatgaagaatcctgaaggcaacattcaggagtagtgagagtggaagccagatctcagagggtttagaaggaaagggaggtaaagcagggatagcagaggctcacagctgtgctgtagccttaggttgggtctgttggcttcacaaaagaaaatgttttaaaaccataaataatatctgtgctgtcagggagatcacagtccatcagaagacttcatgttcctaacatacactgaagagctgtccttggggtgggcatgggagggagatctctagggaaggggcaggatcagaaacagcaaggattgactgggtcctttgaacccactcccttagactgcagtgtctgtctgctgggtgcatctcgtgggatactatgactggcattctgagggcaagaaatatcctggtcagagatgtgttttctctatcagattaagacatatcaacatgctgctctgttccataagtctccagtcttctcttgattctgtacagcttttttctaaatcaaaaatgaatgacaattcatcaagctttgaatgacaaaagaagggacaggttgatccaatctaggaatgacagtataggaagctgagaaggtcggctgggcatggtggctcacacctataatcccagcactttgggaggctgaggcaggaggatcacttgaagccaggggtttgagaccagcctgggcaatatagtgagaccctgtgtctacagaaaaaaaaatttaaaaacagctgggagtgatggcacatgcctgtagtcctagctactcgggaggctgaggcaggaggatcgcctgagcccaggagtttgaggcacagtgagctatgattgcaccactgcatcccagcctgggcaaaaagtgagatcctgtctctaaaaaaaattaaagtaggccaggtgtggtggctcatgcctgtaatcccagcactttgggaggctgaggtggggaaatcatttgaggccaggagttcgagaccagcctggccaacatggagaaaccccatctctactaaaaatacaaaaattagctaggcatggtggcgcacgcctgtagtcccatctacccgggaggctgaggcacaataatcgcttgaacctggaaggcggaagttgcagtaagctgagatcacgccactgcactccagcatgggtgacaaagtgagactctgtctcagaaaaaagtaaattaaaaaataaaaataaaaaaggcagctgagacggctctttgagatactgagcagcagaatcaagatttaaagggatcttactgaatcttgaaagaacaaaactaataaagcagagaccaatgtgaagtttgatatgtaacctgcacttgagttgatttgggatatttgattgcaaactcagattgagtcagcagttggtagagcttccaaaaagttaagatgactggattcattcatagactccagaaagaaagagtggatagtctctcactcctccgaaccagtgagtgctcagtggtattccattgagttctgggtaccacatcttaagaaggaactgaggaactgggggactggggctatttaacctagagaaaaactgactcgggtgaatacggtctctgtctctggttttcttaatgaatgtcacatagaaaagtgagaaaacttattctgtgtattccctgagggtagaactaagacccattccccacaggggcccccttcttacctgatcttattcctctgcctcagtctgtatcctgggaacttagcagagaggagttttaaaagggtaggaataagcagtctaattcagacatactttgtatagggggtataataatgctgtggttgggatgacctaatccgatagccagagtcagctcagccttgaaaactgatacttaaataggcggaaaggaaggacacattcctgatgggaaaagcagtgggcttcatgacagggatggactgggaagagtagggtcagtgggggcaggtgtggaagtctgaagggagagcagcctagctcgtagcaggtgtgggcaactagctcactgagaagattagactttattctgggagataaaatttgtatctcagaagctagttggtgtatgtaagaagcttctggttgtagtgagactggcttgaatcaagagtgaccgtggagattccctcatttaacagatggtttttcactccatactgtgtgccagcctctgttccaggcattatggatccagcagtgaacaatataaaatccccacttttctggagctcttaggagcagtaatggacaataaacacattaaaaggacaacttttaattgctggaaagttcaacaatgctgaaaagaaaatgaaacagggtaatgggatagagagcaacttgccagaggggctgacgtagtcagagaaggtcttattgagggggtgatatttgagctgatgcctgaatggtgagaagattcagacagaaagaaaagcaggtgcaaaaggcccggagatgttcatgcatctggtgtgtttaaggacggggaagtgtggctggagcacagtgggccagggagaatgcagagtctgtgtaagcagtgactgggtatagcaggagggtggagcttgaaagtgtcccctgggagtgattcagaagcacctccctaatgggattgtggtccccatcccctctgactctttgatgtaaataagatgagggataggaaaacctggcctgatacaatttcacatgtagtacaatgtggtaaaaagaacagtggctctgaaatcagactctgggttaggcagaattctagctctgccacttcctagttgtttgaccttgagcaagtgctttaatctgtctacatttcacatttcctaatatgtcaagtaagagaactaattcccgcctcgcagagctactgagccccactgctggtgagctttcaccagggctttaggccgggtgcgtgcttatagcgccatcttacgtttattcggagatctacagtgttttgttggaagtgcagtccatccactgtcccactccagtgtcctggagttttgtgtttagttctgagcaccacgttttgaaggacattgacctgaagactgcctgaaagaacaggagaggcccagccttggggaacatacctccgttcagggggagcaaatgtggactctgaggttccaatgccaggatcgtgaaaagagtgggagtgggggtagatacagataacaggtaggctgcaagtaaagaaatatcttactatggttcgatatgctcaggaatgaaatgtgctggcatgattggagatgggataatgagcaaaagcttgaagtcagtaacatctgaaacattttcatcactgaaaatgtgtgtgactgtgactccaagacttagaaacaaagaaaatggttctgccattgatagaaatggaagtcatcggaaaaaaggagaaaggtgatggataagcggttatagcacattttaagtgaaagcagaactataaagcagaatgatctggagatgaagaggaaggtccaggctaaagctgtgggtttgggagtcatcccgtagaagtctgaactcaaaacttctcaagaaataaagtgtaaggtgagatgcaagagttgagccttaagatacactcacctttggagtcaagaaaatgaagagggactgaacagcagagaggtacaagacagtccagcaccataaaagcaataggaagcgttttacaaaagaggggagcagtgtcccattccacgaacttctaccccattcaattcctgccagccaggtccctgcccctctcccctctcccatctctgcttctgggttttctctcatatgggtttcagtgtctgtctactgatttcttctccatccctttgctacagggggtggcaccgagagccgaccagtccttcgctacagcaaggaacagaggccaaccacactgcccatccagcccttcgtgttccagcaccacttccccaagcagctggccaaggcccgggccctccacagcctttcccagctctacagcctctcaggctgcagccgtacacagcagcctgccccactggctgcccctgctgctcaagtctcagtcccagctccctcaggggaaccgcaggcatccactccccgagccactggcagaggtgccaggaaagctgggtctgagccagagacctctcggccatcgcccctgggcagctactcccccatccggagtgttggcccctttgggcccagcactgactcttctgcctccacttcgtgctcccctcccccagagcagcccacagccacagaaagcctgcccccatggagccactcctgtccttctgctgtccggcctgccacctcccagcagccgcagaaggaggatcagaagatactgaccttgactgagtaccggctccatggaacaggaagcttgccgcctctgggctcctggcgatctggcctcagccgagcagagagcctggcccggggaggtggtgagggcagcatggccaccaggcccagtaatggtacgagctccagcatctccctacccaacccgccacctcacgcaagcacttccaccacctcccctttgagtggttgcttacactctcacctggggccagaggttaggatgtctgcatccctccctcagcatctgtagataatatccacagataatctagtgtttcatatgggcccactgggtggatgtgaaactctgtctcgctgtctcctgccaactcttgtctttctgctaatctgttctgcttccagccaaccacctatcccctcaagccctcaagtggcgggaatacaggaggaagaacccactagggccacctggtttgtcagggagcctagaccgaagatcacaagaagctcggctggcccgaagaaaccctatctttgagttccctggctccctcagtgctgccagccatctgaactgccggctgaatggtgtgtgagcagggtccccagtacacccggggcaggctctgccatggctggaaagggctagagaaggggtcagtcccaaaggaacgtgtctcagacggtacgaggcactgaactggcctggaactcctgcactgagagttgctcaggattgatttttctcttctttccaggccaagcagtgaagccgttaccactgacctgccctgacttccaggaccccttttccttgacggagaagcctccagctgagttttgtctgtccccagatggcagctcagaggccatttccattgacctgcttcagaaaaaaggtgcatacaacccccagctcaggccagggactctgctgtcactacctcctcacacttgccctactacctagccagtctgaaacctctaagtgctggctgggcccagtggctcacgcctgtaatcccagcactttgggaggccaaggcaggtggatcatgaggtcaggagttcgaggccagcctggccaacatggtgaaaccccatctctactaaaaacacaaaaaaaaattagctgggtgttgtggtgggcgcgtgtaatcccagctactcgggaggctgaggcaggagaattacttgaacccaggaggtggaggttgcagtgagccaagatcacaccattgcactccagcctgggcaacaaaactgaaaactccttttcaaaagaaaaccacaaacaaatctccaggtgctgggaaggtgttggagcacacaggctctggggccagaggaggaagctgtgtgctgtgtatcatgagtgcatgtgagtgagcaagggtcattcatcagaggctttcagagtcacgctccggtcccttcctgcagtgagcaaagtctcatgaggaggcttccatgtcatcaaaaaatgcctcagtgctcttggagggggcgggtgaaggtactagagggcccagcagcttgggtaagagtgttggtgacatctagtaagatgaagattgacaagacccacactatttagcaaataagtgaccactgaactaagaacatttttagggagatggagagaactgagcataattgtgggctgaagatgagcctgtgaagagagagctgaagttccttgcaaaggcagaaggggagaatcagagctcagggagaaagaacccgggcaagaagggaaacggccaccttcctccaggacgcgaaggggatgcaagtgggcaggggagtgaggggtgtacatatgagattgttatggattttggaggtagagggaagttaaaggagtttataactagggaactctgttctctgaagcagaaccaagggcttgagaggaggggtgtcgatttcacatggcaacttgagggtatggcagagagtgctgacaagccatgtgtcaaagaaccgcccttgtctggcactggcactggggtgagggacttgggttttcttcaggtcagtggcccggtttctcagagtggagaaaaccgatagttggcctgacccaggattggaataagggctgagaggtaaggacattgagaggcttgacagtggcatcactgaggtagctccaggctgggaagtaaagacaggaagagcttaagaactgggcagaaccagaaaagggccaggcctgaatgttttgataagacccatgtgcagatgtggagacggagtaagtgtgggagccctttccctgaggaaacctgaggtttcagccccagctgagttggttaaggacttgctcagggacctgtcacatcacattcttccctgcagggctggtaaaagctgttaacatcgctgtggacctcattgtggctcattttggcacaagccgggatcccggggtgaaggtaggcaaggaaatgtggagagctgagctctgcctgcaagccctcacctgtcccgcgctaccaccttcccttgctgtcttgcatttagagcccagggttgggtacttaggaatggggacggcaagaggggaaccatgagggcctgctacgagaggaccacagtcaggcctgagggggtttcctgcacttccctaccacacctacaggcaaagctgggaaacagttctgtgagccccaatgtgggccacctggttctgaagtacttgtgccctgccgtccgcgccgtgctggaggatgggctcaaggcctttgtactggacgtcatcatcgggcagcgtaagaacatgccatggagtgtggttgaggcttccacacagctaggtaggtgctgggtgccaagacggggacccagggctgaatttagggctccagaaattggtcatgtgacctgcaaccctggcttcctcccaggcccatccaccaaggtcctgcatggcctctacaacaaagtcagccaattcccagagctcaccagtcataccatgcgcttcaacgccttcatcctcggcctgctcaagtgagtgcacagagcagcaagatcccctaaacaacttgccctgccccccacccccgggctctgcctgcaccaaggaaacaacgccctggacagacagaaagggtggatctggagggtcccctcagcccgctatggcctctcagtaggtcactgcctccccactgtgcccatgactctgtcactggtcaccaacgtggtctgcttttacaaatctgtaatctggcttatttggaaattagttgggtttcttaatttctctggaccttgtaaaccctgatcctctccattccagcactacttccaaatcctgcttgaccctaagtccaccttgggacccacatcctagtaacatgctttctcaggtatgggcccaggccattccctttggccctgagctgcctgtactttcacacagtagctgccttgatttcttaggtctactgcaggctgactccactccaggaggaaacaattggcttgtaaatcacatgtccatctccctccacacatccccactgactttctggaattaggtgaaatgaatcgtgccatggaagggcgtgttcacctattcttcctgtgcctgaccccctggatctgtctccttatctggctgtattcacacaagactcaactctcttcacctgtctccctacagcatccggtccctggagttctggtttaatcacctctataaccacgaaggtaatgcctagaaccctgcaggtcaaactcaatgggtcagaattcagaggcacaaaagaggaaggaagagctgtcttttcattgctggaggtggggagggggaccacacaagcgttcatcctcagagcctcaggcttccacccaaggccttccccagcctctgcttgagttaaaaccttgggccaggcatggtggctcatgcctgtaatcccagcactttgggaggccgaggcacgtgggtcacctgaggtcaagagtttgagactagcctgggcaacatggtgaaaccccgtctctactaaaaattcaaaaattagccggctgtggtggcgcatgcctgtagtcccagctactcgggaggctgaggcacgagaattgcttgaacctgagaggcagaggttgcagtgagccgagatcatgccactgcactccagcttgggcaacagagtgagactcagtctcaaaaaacaaaacaaaaaaccttggagccagcaggatactctagcaatctgggagttagggtggccaggaatccctgcatctcactcctctaaactcagggccaccgcctggggttggagagtttaggcactgcacagctgtgggcagcagcgtttatacttagtacatgcaagttgactagtgcacagcctgcaccgctgtctgcagcagctctgcccagactgtctttcaaagtcccacttgggccaggctctggttctctgtgtggatcagtccctctctcttttcccctagacatcatccagacccactaccagccctggggcttcctgagtgcagctcataccgtgtgtcccggcctctttgaagagctgctgctgctgctacagcccctggccctgctgcccttcagcctcgacttgctgttccagcaccggctgctgcaaagtgggcagcagcagcggcagcacaaggaactgctgcgggtgtcccaggacctgctgctgtctgcccactccacgctgcagctggcccgggcccggggccaggagggccctggagacgtggacagggcagcccaaggggagcgggtgaagggtgtgggtgcctcagaaggtggagaagaggaagaggaagaagaggagacagaagaggtggcagaggcagccgggggctcagggcgtgccaggtgggcccgaggtgggcaggccggctggtggtaccagctcatgcagagctcccaggtctacatcgatggctccattgagggttccaggttccctcgtggtagcagcaacagcagcagcgagaaaaagaaaggggcaggaggtgggggacctccccaggctccaccaccccgagagggagtagtggagggggctgaggcctgccctgcctctgaggaggccctgggccgggaaaggggctggcccttctggatggggagcccccctgactctgtgctggccgagctgaggcgcagtcgggagagggaagggcccgctgcctcgccagcagaaaatgaggaaggggcctcagagccttcacctggaggcatcaagtggggacacctctttggctcccgaaaagcccagcgggaggcccggcccacaaataggtgagagcctgcccatggtagggatggagggagtagggagcctgctgtaagccagggcacgggcagagcccatcctgggcagagcctgagtccagctgctgtccctaggctcccctcggactggctgagcctggacaagtccatgttccaactagtggcgcagacagtgggttcccgccgggagccagagcccaaggagagcctgcaggagccacactccccagccctgccctccagtcctccgtggtaagcctggggaaacggaagggctgaggggggcggggggcttttgagggggtttctctgacctccatgtgctgtttccccagtgaggtgcaggcactgtgccaccacctggccaccggccctggacagctgagcttccacaaaggagacatcctacgagtgctggggcgagctggaggagactggctgcgctgcagccgtggccccgactctggcctggtgcccctggcctacgtgacattgaccccaactccaagtccaacccctggaagcagccaaaactgaggccctgtgcatgctggtggcctcagggaccctcataacccccagactcagagcccgagagcccttcccaagccattggcttggctgcagagtagactgagagctggggccacgtatccctgtgctggcacctgctccctgtgctcagtattaattacgcccccttaactgtcccagtgaccttgtccagacctccacccaggagagggatgggacacagcactgggctgccaggattcccctggcccgtctgggccaacccttccatgggtgaagacaagcaagtccccctggaggcgggtggcccagaaagccatctacagggttccctaggccaggtggagatgaggatgggtaacagtattggggccagatccctaagccccccagctgtaaataggctgtggccagtgcctggtcatcagaagagggaggaggagcccaggcgtctgtttatgtatttatttatttatttattatacctattaataaaaaaggtgctcagcctcc

SEQ ID NO: 37843 - DNA, 33722 bp, Homo sapiens; identical to SEQ ID NO: 36957

SEQ ID NO: 37844 - DNA, 33722 bp, Homo sapiens; identical to SEQ ID NO: 36957

SEQ ID NO: 37845 - DNA, 14013 bp, Homo sapiens
catatcctagaggttgggtgaccaaccctgtcccagtttgcctgggacttgagggtttttccaggatgcagcactttcagtgctaaaactaggaatgttccaggcactctgggatgagttggtcaccttgcctaggtgcctaagaacctctcccctgcccacgtactaagaccaatgagtaagagagacaaggctgggaaggtgagcaggtggaggaggctgcctcccagggagctggtccttctagcctgccccccagggggattggacaggagttgagaagtgggacaggaatctaacctatcaggttggacttcaagcctgcaagggagctaaagagctgggtgaggaaactgaggcaaaccagtcatggatgtagccaccatggtggggtaaaggaaagctgtgactttgtgagtgcttgggacatagggcctggggcaacatggccacctccagtccccacatgctgagcccccaggactccccacaacatttcttctactgtccttcaagtctgagacttctcttccctcccaggacacagctagaggaaaaggcaaggacatcagcaagtatggcagtgtgcagaaaagctttgcagacagaggcctcccaaaacctcccaaggagaagctgcttcaggtggagaagctgagaaaggagagcggcaagggcagtttcctccagcccacagccaagccccgcgccctggcccagcagcaggctgtgatccggggcttcacctactacaaggcaggcaagcaggaggtgaccgaggcggtggcaggtgagtaggaggggaatggggaccctggggagtcagggatggatgcctcctaggaatcccctcatcttctctgcagtgggaccaccccagattcagttccacccattgattacctgttgggtgccctctgctcattcacatatgaggataacaccccactcagggggtcattgggatgagatggcagaaccaacctgcagggccactcagtggcttttcagtatttacagctgtcttcaccttcactggacttttctttgtgcttttgaaaatgtgctgaaggtccgctctgaccaggtgacagggaatggtagagacacagtccctgtccccacagatctcacagtctagtgagaaaaaatacctatgaccaggcagctgccacagtgaggggcaggagaataccgggctcctgagaagtgacaagggctttcagggcatctctcatttcctctccagctcctccctcttcttatatccccaaggaagagcccacagactcttgtatttttcctgcagctctctgctgcatcacagagaagggtgacaaagtaattggcaaacaagagacacacgtttcaagataccccaaatttctgagccatctctacgggttgtggttcttgattcccccactaagacccgccccagatggctgctctcttctgatgtcccagaggggtgtcccaaacctgctcctccccttcctaggtcctgctgaccacctcctcctgcaaagccctccttccagcccatgtgcaaggggcgcaaggaggtgaaacagtcagggaccaggctcctttgagagccctcttgtttcttggcctctcaggactcaggggcctctttaccctggtcccagctgctggcccaagccctgccagcttggtctggacatggcacagagcctctgacccctggctggggcactgcctaagaacagctgcaggcatctgactctgccagcaaggcctgtgggaacaggcaccctgccctggcaggctgcttaggccaggcctccctgtggtcctcctcgaccagggggatgacccccttccccgccagggcccaggctgcccacagcagggcctgtgcaaagaggaagcccaaaatggagaaaaaaggaagaagttattgtcctcaagtcaagggttctctgagcccctcacccagctgaccaggaggtcccctgggcaccagaccatcatagtaataacagcaccattcctttgtctccctggtgtcacaatttttttttttttgagacagagtttcgctgttgtcacctaggcagtggtgcagcggtgcaatctcagctcactgcaccctctgcctcctggattcaagcaattctctcgcctcagcctcccaagtagctgggattacaggcacgtgccaccatgcccgactaatttttgtatttttagtagagacggggtttcgtcatgttggccaagctggtctcgaactcctgacctcaggtgatccatccactttggcctcccaaagtgctgggattacaggcatgagccaccgcgcccggccggtgtcacaaaagtgtaaaagtgtttccctaaacccttccttccttccttcctttctttctttttttcttttgagacagggtctcactctgtcacccaggttgcagtgtagtggcacgatcatggctcactgcagccttgacctcctgggctcaagtgatcttccctcctcagcctccctaatagctgggactacaggggcccatcaccacacctggctaattttttctattttttagtagagacagggttttgccatgttggccaggctggtcttgaactcctgggctcaagcgatctgccggcctcagcctcccaaaatgctgggattacaggcaccagccactgcgcccaaccctctaagcactttcgttcatgccgtctcatttgattctggcagcagctgcattttccatggcagaataataggagaaggcctgtaaaacgggaacaagagcttctctctagaattgaatctagcaaatgagagaactggtacaaagtgcttgatgcataggaaggaaagggatctcctttttggtacctcgtatttgctgggatctgtgcaaatgtttatgtacatttttctgtagtcaacaccacagtccagcatggtgggctcctgactctcagttcacagaggtggcccaggaaggcagggggacatggctgaggccacctggctgggtttagagccctggctgtgaagtcctccctgcctcccatttggagacctttcacccccctccaggtgtgaggaggccctgaggaggcctccccctccactccctgagggcccctgagatgggggcccagtggaccttagggagacccacacggcagcaggtggtgctgagatttgagcacaggggtcttctctctgcagacaacaccctccagggcacttcctggctggagcaactgccgcccaaggtggagggcaggtccaactccgcagagcccaactccgcagagcaggatgaggctgagcccaggtcctccgagcgagtggacctggcttctggcacccccacttcaatccctgccaccaccaccaccgccaccaccaccccaacccccaccaccagtctcctgcccaccgagccaccttcaggtccagaagtctccagccaaggtgagtgagcctcacaggagtcagcacactgtagcctgtgcccaaatctagcccacagcctgtttctgtgaagccctcaagttaagaaatgctttttatagctgagcatggtagctcacacctgtaacaccagcactttgggaggccaaggtggacgaatcacctgaggtcaggagttcaagaccagcctggccaacatggaaaaaccccctctctactaaaaataaaaaaattagccaggcgtagtggcgggtgcctgcaatcccagctactcgggaggctgaggcaggagactcgcttgaacccaggaggcagaggttgcagtgagctgagattgtgccactgcactccagcctgggcgaaagaaattttttttttttctttttgagacagtctcactctgtcacccaggctgcagtgcaatggtgagatcttggctcattgcaacctccatcccccgggttcaaacaattctcctgcctcagcctcccgagtggctgggattacagatacccgccaccacacctggctaatttttgtatttttagtagagacagggtttcactaccaggctggtctctaactcctgacatcaggtgatcctcccatctcagcctcccaaagtgctgggattacaggcatgagccaccgcaccaagcccaggtagtattttcaacaaattcttcttaaaatgtcacctagaatgccatcatcaaatccagcaactatttttatttctttatttcctgtgtccaatcgttggctctgttttgatgtcagcatttatagttttgctctgtgtctcatggtagaaatcttcctcgttaagtcattgatcccgtccttccgaagggatcttggctctctgtggtgaaaatccttcaaaccctgtcctgctttggtccaaggtcattccacttctaggaatctttcctgaaggatctaccagcaatgggaacaacagctgcagcttaagtggttgcatcatggcatcatttctaatgtcagaaaactggaaataacacgaagggctgacatggggaggactggtcagataaattcagggcacagctgtccaccggcctggcagaaccttgaaatcacatcattaaaagcctatttaatgatgagagaaattgctcaacggaggctaaaaacaggatacataaaactgtatactcacagttttttaaagtatgtctgcatgactgtacatgcaaagaaaaaagaaaaggaaggaaatgccacatgtttaaatttttctttggatgggagaatggtgggagggggtaaaggataaaagactacatactggctgcagtgtatactgctcaggtgactgatacattaaaatatcagagatcaccactaaagaactcacccatgtaaccaaaaaccacctgttccccaaaaactatttaaataaaattttattattattgttgttgttgttttggtttttttggtttttttttttttttttttttttttgagacggagtctgactctgcggtccaggctggagtgcagtagcgtgatctcagctcactgcaacctctgcctcctgagctcaagagattctcctgcctcagcctcccaagcagatgggatttcaggcacacaccaccacgcctggctaatttttctagttttagtagagacagtgtttcgccatgttgaccacactggtcctgaactcctgacctcaagtgatcagtgaaatacaatttttaaaaagagaataaaagaacagaagaaaatttttctctggataatggcagtttttaggtttttattttttatcttataagagtttaaattctttttattttttaaaaagtaaaataaaaaagaaaaaccaaaaaagaaaaaaatttaaatttttgtactgacaaataaaaattgtatgtgttcatttgtttgacatactgcagaaagaataatttttttaaatgtgtgtatttataatgtacaacataatgctttgatatgtgtacacacagtgaaatggctaaatcaagctaattagcatatatattacctcacattatgtatctttttttgtggcgagaacacttaaaatctactctcttagcaatcaaaattcaagtatacagtatgttgaacttattcctgttgtctaaatgaaattttgaatgctttaagcaacatctcctcaatccccccatccactagtaaccactattctactctctgcttttatgagtttgactttttaactttttaaatttttaatgtttatttttatttatttttattttatttttattttttttgagatggagtctcactctgtcacccggctggagtgcaattgtgtgatcttggctcactgcaacctcctgcagtgattctcctgcctcagcctccagagtagctgggactacaggcacccaccaccgcacccagctaatttttttatttttagtagagatggggtttcaccacattggccaggtttgtctcaaactcctgaccttgtgatccgcccacctcagcctcccaaactgctgggattacaggcatgagccaccgcgcccagccaatttttatttatttattttttttgaggcggtgtcttgctctgttgcctaggttggagtgcagtggtgtgatgacagctcactgcagcctcaatatcccaggctcaagcaatcctcccacctcagcctccccagtagctgggactacaggcgcacaccactatgctcagctaattaaaaaaatttttttttttttttgtagagagaaggtcttgctatgttgcccaggctggtcttcaagtcttgagttcaagtgatcctcccacctcagcctcccaaattgctgggattacaggtgtgagtcactgtgcctggccgagtttgactattttagattccacatataatgaataatataactttgaagatttttattttctccattctcttttttttttttgagaagagtttcactcttgtcgcccagagtgcagtggcatgatctctgctcactgcaacctccgcctcctgggttcaagtgattctcctgtctcagcttcctgagtagctacgattacaggcaccgcctaccatgcccagctaatttttgtatttttagtagagacgggtttcaccatgttgcccgggctggtcttgaactcctaacctcaggtgatccacctgccttggcctcccaaagtgctgggattataggcgtcagccattgcgcctggcctccattctgcttttctgaatgttttatgtttttggtaacgatcaggcattgttttgatgatgaggaaaggggaaagaaggccacaaacaaaatttcaggagagatttaagttagacccagataacattcccagcccgttgctctggctggggggcttgggggtctgtgtaccgatgctgcctgccctcctccccacaggcagagaggcgagctgtgagggcaccctccgggctgtggacccccctgtgaggcaccacagctatgggcgccacgagggagcctggatgaaggaccctgcagctcgagacgacaggatctatgtcaccaactactactatggaaacagcctggtggagttccgcaacctggaaaacttcaagcaaggtcagggacccccggaggtggagagggggctgggtatggacaacctggggaggggtcctcatggggacttggccttccttgccttgtgggtttctatggtataggctggttgagctccagattgttagccaccccaaggagggggttctgggctgagggcactgggctggaggcccagacagaccccatggcaccccggtgtgctagcaccctgccaggaaccagaatgcagcggcaaacaagagagacatggtcctgccctcacaagtgtgacttaccatcaaggggccaatactgagtttccatttgttgaacgcttaccctgtgctgatctcgccccccgtgtatcagctcttggtagctacatacctccaggaggtggggttatcacctgttttataggtgcgcagtgtctcaggtcttagcggagctgcaggtctgggcaggggccaggatggagctgacggcacagggaagggcagaattctgcttatcaaacctggggaatgatgccaggaaggggtcatttagatctagcctgcccttcagaaatgcacagtctggtgggggaggcaaaggcttaaagagacgatttcagtacagcattagagggagcactgaaggggctatgggaacccagcctagagatcagggaagaccttcccaggaaggtgatgctgagctgggccctggaagaagagtaggagtaagccatgcggaagggagagggaagggtgttccaggcagaaggctgagtacatgcagaggcctggcaatgagaggaaacgtgatggcctggggtaggggggatggtgactgagtaagctggggcaggcctggtgagccagataaaggagtttggacttaaccccgagagccatggagtcacaactaaaggcctggaacaggccgggcgtggtggctcacacctgtaatcctagcactttgggaggctgaggtgggctgatcacttcaagtcaggagttcaaaaccagcctggccaacacggtgaaaccccgtctctactaaaaaattaaaaaaaaaaaaaaaattagctgggtgtggtggcaggcgcctgtaatcccagctacttgggaggctaaggcaggagaattgcttgaacctgggaggcagaggttgcagtgagccgagatcgcaccactgcactccagcctggatgacagagagagactctatctcgaaaaatatgaaaaaaataaaggcctggaacaactgaaatccttcctccgctagctcaaaattggccggctttctgctcaagcagcgcacagggtggtggaggaagccagtgataagtatcaagatgaaggcttctgtctggctgctacagacgtgtcctggggggataaaagacaaagggttatgggaggctggaggagaggcccctcactcaggctagggaggtcagtgaaggtttcctagaggaggtgacattggcctggggctctgaaagatgggcaggcattccccaagcagatggcctggggaatggcagtcctaacagaggaacagcagggacgaaggcctggagacaaagaatggggctgatgtcaccctgtgtctaaatcctagctgtgccattccagagctgggcgaccttgatcctctgagcctttttttttttaagcagatgggatgacgatagacctccttcaggagacgcttgtgccataataagatgtcatcccagctccaggcacactgcacatgcttggtatcagtcacttactgggccactgagagcccttggtgggctcaggggatgtgggtgggctggggttgctcgggaggtctggggtgaccatcgccctcgcctgcaggccgctggagtaacatgtacaagctaccctacaactggatcggcacaggccacgtggtgtaccagggcgccttctactacaaccgcgccttcaccaagaacatcatcaagtacgacctacggcagcgcttcgtggcctcctgggcgctgctgcccgacgtggtatatgaggacaccacaccttggaagtggcgcggacactcggacattgactttgccgtggacgagagcggcctgtgggtcatctaccccgccgtggacgaccgcgatgaggcccagcccgaggtgatcgtcctgagtcgcttggaccccggcgatctctccgtgcaccgggagaccacgtggaagacacggctgcggcggaactcctacgggaactgcttcctggtgtgcggcatcctgtatgccgtggacacgtacaaccagcaggaaggccaggtcgcctacgctttcgacacgcacacgggcaccgacgcacgcccccagctgccgttcctcaacgagcacgcctacaccacccagatcgactacaaccccaaggagcgggtgctgtacgcctgggacaatggccaccagctcacctacaccctccacttcgtggtctgagtggagacctgtgctccccggagaggggcagcagtgcgggaggggctttgcacagcagctcctgcaactgacccagtccgcaaatatttattgggggccagcccagggctgggactgggcatgaggtggtcaccaggattgagcttcctcagcacccagtgggtaatacttgcttccacttgcagagcaccgtgccaagcacttcccacacacttacccgtttgattctcctagcacctcccttggaggtagagatcatgaacccatttaacagacgaggagacaggctcagagaggcaccgtcccttgcctaacacctcagttgtgatcaggcaggctgtgctctcaggacagccccattttagggatgaggagacttcaccacgccctcccctccctgccctcccccatctccccggtctcccttgttctctcaacccagtctcccttcccagggccactcagaaccagaggtctttagggccagtgtactggtgtggggtggaggccctggctctgcctgccatcctagggccctgttctggctgagctgttggtggccctgggctttgggccccttagccaatgtccttgtctcttgtctttggccagccccctcagcccagcccaccccacccgctgtccggccacattccaaacctctaccgtcacctagctgctgagcagaaaccgcaccccgagagaaaatcccatcctctgttccaaggcccctgtctgctctatgctcatttttattttctcttattcttcatcagtgccgtcatttgtttctgcagcagcagctgagaaggcagccggcagctctgccagggtggggagctgagctgaggctccctctccacccagaagcactggcgttgttcacatagtcaggccttgggtcccctccctggttcatcccagagcctttgggcctggagtccgccttgtcctttttctctgggctttcaaacccacaacctttacacactcagggatacctccgggtctgccatgaataagaccctaggcccaagtctggtgtggtgccaggatggcacagtttccctcttccttgccagccctgacctggtcactgggcaggctggcccagcagcctgggggctgcagaagacatggtgtgagtagttgggtccaggggaggcatcaggccttcttctggttgcaggagagaaccagagggtgggaacggggagggaagaactgagggtctgcagactggacttttcctggctcgacccaggacttgggttgaggatgcacgggggccaccttgcccggggccactggtggctccccagagcctcagacccacacagcccagaggacgaggccttcaagcctgcccctcttctgcttttttagacagtatttttagagctggaaagaaattttctagcccaactccctgtttcatgaaagagaaaagaggctcagaaaagtttagagagcagctcagtgtcacactgggagctgggcacagccgatctccttccagaagggttctgtctgtatcctttattctccgcacatggaggctgccctacctgggaaggcaccccagcacctgtgaaggacatttactgctcatcctcacctgccccctggcccttgctgccttcattctgtcccaatgccagctccctggatgtctgtatgtttgaataccagttgccatgttaggaaggtcagctgcacagccaagagtgtaagagtgtaaagaaatgcctttttttttttttttgagttggagttttgctcttgtcgcccaggctggagtgcagtggcgcgatctcggctcactgcaacctctgccccctgggttcaagcgattctcctgcctcagcctccctagtagctgggactacagcacccaccaccacacccagctaatttttgtatttttagtagagacaggggtttcaccacgttggccaggctggtctcgaactcctgaccttaggtgatccgcccgcctcagcctcccaaagtgttgggattacaggcatgagccactgcgcctggccagcaaatgctttttgtgcagaatacacttctttcaggcattgtcaggtgctgttttgtttaagctctaactcacccctggaatacaggggaatgatgacaaccagcccagccaggcctgactcatcatggtcacatccagcccccacccccggccaactaaccactgcaggctcctcttccagactcaccagggggcctcgaggccccggcatctcccttggccctgggtgtgggttttacaagactgtgtctttcatgacatcatagcccaaccatgtgagaagaaggagaaggcccccctttcttcattaatctgaaaaaaaggaaagtgagaataggctgatttttaaaagttaaggggcaagcagcattgcattctgggggaacgatcctggccacagccgccaaacaaacattcactaggcctcttctgttttcatacccttgtaagtgggttatgtggtgggtatggtcagttttttcttttttcttttcttttcttttttttgagacagagtttcgcttttgttgcccgggctggaatgcaatggcgcgattcagctcactgcaatctccgcctcccgggttcaagtgattctcctgccttagcctcctgaaaagctgggattacagggccctgccaccaagcccagctaattgtatttttagtagagacaggatttcaccatgttggccaggccagtctcaaactcctgacctcaggtgatccacctgcctcagcctcccagactgttgggattacaggcatgagccaccacgcctggccagtttcttcattttacatatggtcacattggcgcctagaacagttaggtcgctcgtcacataggcagttaagtggagaaccaggtttcaaaatcaggtaagaaaaccatcatcattaactgagcaccagctgtgctaagcctgccacgggcgtatccttgcagcctcacaacagtgggaggtctgtatcctgaatgtcctcattttacagatgaggacattgaggagaagagacttacccaggctcacacagcagctcagcctgttccaggcgctggtcagtgcgtgttctttgccaccagcctgtcactccagtggcagctccagaaacggaggctgttgcttttatccctaaactgcatccacagagaagccccaagaaggaggttggggccagctcataaaaagcctgaatgccaagccaaggagtggatgcctccagtcatatttagaacaaagtcaagtataaatttacagagaaaaaattctaagacagttggatgttgtcctgttggtgaggaagggaaaggtttttcttgtagggaactggaaccagcccacaactgcacacttgtgagctgtcatggaaacctgatccccaacagcttttgaggttgtttgtttgtttgtttgtttacctgtcttgggctttgttgcttttggcaaaaggtacttcaaacaagggagggcctggactgagggggaccaggtcttcttgctgacctcgtctacaaaggcaaaggaaggcaaaggaagctgtctcgggtgtttctgaacaacgtgactcatgaggggctttggctacctcttgcgttccccctagagatgtccaggccttacatttaatcggctttctctgcggtggggtagagaatggagctcccgccttgcgggcagtgctaaaggtggagctgggggattttcctgggaatgatttgagggctcttgaaagcccatgtgttccaaagcgtctttaactctgggatagcattggaagccgctgtcatgacaggacatggcactggatggctggcagagagccctggctgggagttagggagccctgggttggaatccagccccacctcttttatgccacaggtttggtcaagttctctcccgctcagggtagggctgtgaactccctcttacagctaagaacatgcagcttagtgaggacaagacccttctagagctttacccctaatccccccccaggagccccgaggccggcattattcctccccattacaggtgatgagcctcaaattcagagagcttaagcaacctgctcagggtcacgtctccaacaggcagtagagtcaaggtataaaccaggtctgtttttgtaccagagtcccagactaactgttggtaggaatcttgtaaccagtcatgttttcttccttgttttggccgctgggaagctcaaagtcaaattcgagacccttttttttccaattgtgctgagtctcctactagactcgcttcattctagctttctgcttttacctttaccctaatctttttatttttatgctattgtactttatttttgtaagttgctgagatatctgttttgcaacaagatgggctatatctaaataaagacatgatcaaaggtttgatttaaaagtct

SEQ ID NO: 37846 - DNA, 4876 bp, Homo sapiens
taatggcgggcgctgcagaagatgcgcgagctcttttccgggctggggtctgcgcggccctggaggcctggccggccttgcaggtcagtggggccagggccagggcaaggtcaaggttagggcccggggcagaacaggagttggttgggctaggtgcctgaggcttggctaggcggcataagaggagttggctgggcggcgtaagcggcctccaggctactccaggtctgctcccaagctgacttggtgggcttggacctgtgtttacagatcgctgtggagaatggcttcgggggtgtgcacagccaggagaaggccaagtggctggggggtgcagtggaggattacttcatgcgcaatggtgagtgaatgtgaggcgccgcgacccgcctgtgtgggggtgtggagaggaggagccccatcccgcagagcctgcatttcctctcgagcagttgtggattggtacctaaaggtgaggtggaatgaattcagcttttagaatcagaatcctggattccagtgctttacgggctgtaccactgactcgtgggattactctggacaaggcagtttacctccctgagactcagtttcctagtttctaaaatgcgtataaaagtatccaccagagcgctgtacagtagaaatattatgctagtcacatataatttaaaattttttagtagccactttaataaagcaaaaagcagatgaaatcaatgttagtaaactcggtgtgtatgaaatatttcaacatgtagtcagtataaaacattgagatattttacattttttagtattaagttttcaaaatctggtattttacagttttagcacatttcgatttggcctagccatatttcaagtgctcagtaaccacctgtggctgtttggacagcaaagatctacactgtaggctcgtcttgagggatatacaagaacaagaggcccagtagagggcctgttgcatagtatggtttttaaaaaaatcttcattcaatttctagctttggagatgacattaggcagagtcatctctctcaagaaagtatactatccattgaggatccacacacgtaaatagttacaacattgatagattttctgataaagaggagctcagggtgcatggggtaacaggatggggagacagcttcttagtggaggtggtgaattgggctgggtcttagtgagaaggagttaactaggtgggggaagcagagagagcaacactcaagttctgtggcatgagggtataatgtgttatatttggaaagtagcagggagctcagtattggagtatgggcgtgtgtgcgtggggggtggaggagtggtagagaatgaagctggggtgtgggaagcccccttgaaaagcataagacatggaagcccttatgtgcctttgattttatcatttaggccagtgtttgccaaaattcatgctaactagttctgttagatgttcagtgaagaagcttctccagttaccttatgtaagaaaaactcttgttctgctcccactgaaaagtcttaacactcatgaacatattaaaggcttgggtaagaataagaaccactaaaaaacctgtttgcttttgtttctcattagctttctatggatagtgtcccttaagacccagcagaacagatatttctcaaaggcaaactgtgaaacactgcagtggctggtaaaaattcgtgggcaggttctagggtgagaaataggatgggatttgctggctagaaagttcaggaaataatcagtatgaagcataacctggagagggaaagactgatgagaacgctgtttttgtctagaaactgatgaggcctgaagtaggacagtggcaacaggcatggaaaagaaggggtggaatagggccttggagattggttggctgtagacagggagggaaaaagaggcaagttcctggtttgagttgatgggtggattaggtgtcttttctcggagtagaggaaccctggaggatgcgaagcaggtttaaagagtaaggtgatgagtctggctttagatatggaagatctgcggcatctgtgaaacgtccaggcacagagtagtctcagttggagataaattcgggggatattaagtttgagtggtagggaaagccaagagtgtggatgagctctcccagagaaagcacatagaggggagagggctaggagctttgtgggagactttcttgagttactgtctaattcagaaaaagtagagcataggcccataggtaactgaagcccagagaggaaggtggctcagtcagagtcacacagtaggatgtcagtgtcaaggctatgatgatttcatcattggaattactatgtccatttcttcttaactatcccattggtctgtggcttcttttatcagtggaaccacagttgtgaaggttctcttcacttcaaaaacttcagcttttgcatgatagaaattaacatggatcatggatcttcactgtgctaggcattgtgttggatggttcctcataacagacctttgaggaggccaccattagccccactttacagatgagaaaactgaggctcagaaagaagtagcttgctcaaggtctcatagaggggaggctagttagaatagtccagatgaaagagggtgagtgtagggctgggagttgtggaaagaggccttggtaggatggaagagattggaaatgaggtattaatatttagtggttctttaaaaaattatgttaaaacctggaatgcagaacactttagcagataaaaggcaggatggaagagattggaaatgaggtatttttagtggttcttaaaaaattgttaaaacctggaatgcagaacactttagcagataaaaggctcactgtgcctttacccacccagttgcagatccaccaagtagatattgaagagcagtgggcaggggtgatgaagttggctggtctttgacccaagggccctgtccttttctacttagctgacttggagctagatgaggtggaagacttccttggagagctgttgaccaacgagtttgatacagttgtggaagacgggagtctgccccaggtgagcttatcacgggcacaactgcagtctccctacctgtagtctttcttctccccagctgtctgttttgggccaagactcttgactatgactctgttgcctagaggaaaaagtgtagcctttccaaaccctgccttttctttatttctatacatcattcccatccaggcctgttcctcagccccatcccaagggcaggtcaggccagtccaggtccattttcacccccgctctggttaccattgctccccaataagattaccttcccttttacatcttatttctttcaaagcccagttctagaggattccctgctagttaggctctcttttgatgctttaggccttcatttgagcccttcatatgtggttgcttcattggttaattccttggggaggaaagagctctgttctcttctggaaaaatccaacctactccccactgttgcttcaaacacgtgctgtttgtatagtagatatctggaaaatccaaactggttgaatattttcttggtaggtgagccagcaactgcagaccatgttccaccacttccagaggggtgatggggctgctctgagggagatggcctcctgcatcactcagagaaaatgcaaggtcacagccactgcacttaagacagctagagagactgatgaggatgaagatgatgtggacagtgtggaagagatggaggtgaagtgggtgccccctgggttgggggatacagatgttttcaattttctggaagagcagctagattcacagggaagtgataaggggatggtggtggttggtggtagtagtattatccagagagggcagggaactttcctaaagttacacagccaatcctggaaaagctggagcagagcctgggtctccagtggtcagtgtattcagctctcttttaaatctcccctccaggtcacagctacgaatgatggggctgctacagatggggtctgcccccagcctgaaccctctgatccagacgctcagactattaaggaagaggatatagtggaagatggctggaccattgtccggagaaaaaaatgagtggggatgattggaaatggctttgggcccttatttgctgttctaagagttgtctgtaggggttttttttttgaggattgcagacctgtggactggttaccccatctccaccctctcccctgttcctctgtctggctccctccagggcaaggaaaacctagggtccttggtcttgggggtggggggaccttttccagcatattcccctgggcctttagttaacatccgagtgacgaagccgggttccccagtacagtgtcttttgggtgcggtcattgtgaggaaggggatgagtgagtgtgggtgtggctggaggaggagctagatgccggtggacagtgggcaggtggatttggggaggagaggatcagcagcagcagcagtactcagtgatagggggctggctgggtcaggaatggtgagatgaacatgcaagtggaagagagaatagttgaaaatgtgaatgaaagtagctctggagcctctcccttaccccaccccacacacacgcaacagctctgtacccctgcccagaacttggaacctcccaggaatgctgccttccttcagcccagcctccagtcctgggttccctcaggaattcgaagaccttggctaggtggtgagcttggaagagctgggctttgttttctgtctcctctaacctctttccttactccttatcccatcccatttgagttcaggggtgaggcttaagatcttaataaataataccttactgctt

SEQ ID NO: 37847 - DNA, 56780 bp, Homo sapiens; identical to SEQ ID NO: 36874

SEQ ID NO: 37848 - DNA, 507937 bp, Homo sapiens
ggccgcagctccccggcggaggcaagaggtggttgggggggaccatggctgacgttttcccgggcaacgactccacggcgtctcaggacgtggccaaccgcttcgcccgcaaaggggcgctgaggcagaagaacgtgcacgaggtgaaggaccacaaattcatcgcgcgcttcttcaagcagcccaccttctgcagccactgcaccgacttcatctggtaggtgccgggccgggcactcctgccccgctcctccccgcctccgggtcccggcacccggcgctccggcgcgtccgccccggggctggctcactccgataacttggaaccggcgggagtccgaactcttcgcccggagtgacacgcgcgcccggccctgacaccggcgggcaggactcccgggacgtcgccgtcccgccacacacaccccctggcgcgagagggaggctggccccgtacggtggcgaaggggatccctctccgggccgggcccctcacctccccgggcgcgcccacccgcacgcacccagcggagcggccgcttgccggggtgtgagcccaggggacaggggaggaggagaggccctaagggggcaaaggttcccggagaaacgcgccccggagtaacgggggagcggcggcgattgcactgcgcgcggtccaagttgctggcgagccaggctgggcgcgttcggggtgggggggttgtgtttgtgcttcccatcgggctggactgcgctggcatcttgggcccctgcctactgtaggctgcatctactgggcacggagagactgacttttctgagtgagcagagagagagagagcaaactgttgaaagcttgcagtgggggagggggagttctagcaggcaaatggcacaagggcagagggactcatttaaaatagaccctgtcggccaggcgcggtggctcacgcctgtaatcccagcactttgggaggccgaggcaggcggatcacctaaggtcagtagttcgagaccagcctggcaaacatggtgaaaccccgtctactaaaaatacaaaattagccgggcgtggtggcacacgcctgtaatcccagctactcgggaggctgagacgggagactcgcttgaacccgggaggcggaggctgcagtgagccgagatcgggccactgcactccagcctgggtgagacagagcgagattccgtctcaaaaaaaatgaaacagaccctgtcaactcgagattagacctgtaaccctgttgatgagggcagaggccttatttaagaaaaataatataagggccagaggtcagagatcaggtaatcgccaatgaattcaggcattcttaactcggagggtccctgggggcttatggagaatcgatacatagaagggcttcaggggtctctgaaccctgtaaaactgagggaaattgtgtttgtgaatctttttcctggtgagagaattacagctttcatctgatcctcaaaaggtgtgtgacccttcttcccagatccccgtcaccacacaaaagttttgaaagctggaactaaaggagctctaggtcctctagttagagcagcagtagtttggtttttcttttaagttgcccgacgtcctgactcttctacctcttctttgtggtgtaggaagttccgggcaagacagagctatggctagggcttcttagctccctctccttctaggccagggggagctgcacagggtggcagtcacggagtgaatcctgccaccagccagctgtgtggcacaggtatcttgggccactagggtgagcatagtatggatggctctgtcggaatccatcacacctggggaaaaacatcccaaagggcaggtcccatgatcgtggtgcgaataaggtgtttaatttttcctttcctttttagacatctgctcccaagtacacttttatgaaaagcacagccacctctatgagtgatttccactgtctagtcggcatatgaagcgactgtgctcaaaggagtaggtagtcgtagataaggctatttaaaataaaaatttcggagcatcagggcaaagagaatattgcatttggttaagaggaggtcagctgtgagagtccattaaaagggaacagactgctggtgacttttgcaggaagtaggagagttagaaagggacttgcagcatactgaggctagctattgtctttccactatcagttgcccttgaaggatcagcccctggtgagctgaagaggcgctcaggtcaccaccagtattgtgaagtggaaaatgcccccctgaggatccctgcagcactctgcatttaattgtaaaccaaccaattggaagtcccaggaaaccatccacggggattgtctttttcagtttgctttcattattgcttctacggggtccttgatttacacgtttatttcaatattaaatcactgatatttttaagcgaaatgtttagagttagatatggtttttagtaggggggatgactctaagttaattttaaaagtatgtgaaatactttgtacatgaaacattctatgtgaagcaagagattatgactctcaaccttccgaagaaattttaatgcagttcattctggtagaacaatacctgcaattgaacgtccacgtcagggttctctgcttacagagtaaattctctaaagtcatgtacaagaacaaaatagcctccctatgtgctttgaatgctattggttctcagtagaaattagatcgtggtcatctcaaatgcaaacaataggaattatattttctaagatctggtttcttaagccaacattaaatgttaaaagtgatgccgtttggcagtttctagacatgtgatattttaaacaaaaagaagccactttgttatctttagggagataaaaacaattttcatttggtcttcaggaacaaaataagcaacttccttttacaattttaaccataaactgttttgttacttgaatattgtgttgtagccaacaagtttgaatatacagtcatgttcttgtcttgaaattttagtattgataacatagtataaaaaattggaaaaaaggttgatacatcgaaatagttcagtgatcctttataggcaagatttttttccccccaaggttgaatttacacagtaatctgactagatatttaggtatgtttttttctattaaatcattgggtttcacatacaaacctttagtggtagagtacttggtcacataacttgtttaaaatatgctatccaacagaaaatatgttaagatattttgttcttgtttttgtttttcagggggtttgggaaacaaggcttccagtgccaaggtaagctaccacttttggttttattttcaagcacaacatgaaataagcattccaaacaagaacattatttccagtcatattttctttccaataaaaaaatgttatttagataattttgaaatatgagggctgtaaatttgggccttaaaaaataattggggcctactaatctgcatatagagctgcctttttctcattggaaaaaaaaaaaaaaagcctttctgtaattttattttttgccgagaacattcttgtcagaaactgctgtctttgtgtgggtgttgagaaaaaaatggaatcactttgtattcaagtggcttttcttccttgttcttcctctttgtttttattcttcatcgcttttacttatgtattgagttggactcactgcaactaattttaggccgtatttcattctagtaagggtttgttttgtttagaataccagttgtcatcgagaacaaagtttgcatgttttaaagttttgttgatgatttgatgactgatttctatggtatgactatgtagcatgctttcctttcagcttacatatctgacaaaacgtgatatcagccatcacatacagaaagaaatccatttgcttcaccctctgatctgtaattgcatttcacacacatcgaatatctaactttttgtactctccattctaattgtttgacttttcctttttgaagaaacccactttagagcttgtgaaggcatcacaggctcattagctaacttttctggctctcctgctcattgtctatattgtgtttatttagttctggttccatttcccatctgggcatagatttattattagggcaagcagaaagtacattctagcctggaaaatattatcctaacactgtttaatattaagtgcattagagagaaaggcactgtgtacttttttacaactttgagattgtgctagtaaattggttgccttttaaaaactagttcaaatttgtgaacttgtttcttgtatacattttctaaacatattttagatgggagtattttatggtatgattattcatttaatattctaccttcctttctccaagatgtgcttaaaacccctactgagtgtatcattttcagagttgcatttgaaaatcaagggatattccttttaaaaagagaagaaagagaaagatgtgttataccagtctctacaaaagatgaaaggaaaatgtagctctttctagttctcaaagttgtgggcctgaactttatgggtgagatttgagcctaggcttgaacatgactttagggagtttaaagatgtaaggttctgggccaatgtgattgacatctgttatttttggtgatatttttcgtttgggtggggacttacataaatctataagaaaatttttgtactgaatcttctccatactgcttgtctgggagaaagtggttgtcttgttctaaaacttttatcattttctgcataaataaaaaataaggttgattagaataaggttggttcctcttagacccgctcatctgagcagattttgtggaaatcacagtggccgtattactaggctctagggggttttgcatgatttcccccagagcatctcttgaacttttagtggattagcagattaatagtttcatggcaacataactcccttttacctaaattaaaaaagtgaaacccataaaaattttaaactgtataaaataaaaagtgaaattgcatatgcttctcttttccctcctccagagataacttctgtttgagacaaccattcgttcactcactcacacatacttagtttttaaaaggagatcaaaattttatacgactttgcaacttgctcttttcactcagcagtagatggtggatattcttccacatcaaagcatcagttctgccttactctgcttagtggctgcatgtgtggatgtatccaatttattcacccattcctctatcaaggggtattttgtaattcgttcttactagtacaaatacctttgtcaagagcattattggacactagtataggtatttctacaatagatagccagaagtgtgtatgtgtgcatcttacattttaacgggtgctgctaaattgctcttcaagagttccagtgcacatttttttgtattaatgggacttcctcttcatttttaccagtgaagatatcgggtaatatacatcttttacattttttaccaatctggtaggtgaaaaggggcccctcttttagatttccatctcctgcattatgggtgagcttgaactttttttttcaaatgtgttttagccatttgtgttgtgtgaattgccttactctacctaatatttgaaactctggatttacaaaccagacaaattagagaagtgactatgtgctttctatatagttctttgctttggtgaagaatttaacctcagatctctttaaataatgaattaccctagtgcgtttacaaattacagttcacagagaccttttccaatagtatacatttatttgtaacatgctgtctgcttgttatattttgtttactgtgtctcatctgtatttgacttctagtaggcatatgctagtccattgtattttattgtttgttgtaacttaagaaggatatgttacctcagggtgatgcttttaatcccacaaatatagttacccagcattttctgttttggctcctaccgcaaaattaatctttctattaacatctgactatcgtagagtgaagttttcttttaatgctctctaattttgttttttttttcctcggttttgtttgatagaacatcattcttctgcaggagaataactcattctcattcatacctttggcaacacactctctggaaatgacagctggagtttgaaactgctttttgtattcctcatacatcagattatttttacccgatgaggcagtgctttctgtccactagtatgtagtatgttgctttggttagtaggtaaaatatctgcagcaagcatagtttttctttttttaactagaggggtgtgtatgctcccagtgactcacatattcatgcagtaagtaatatagctttagatccaaaatatttatcttcattttacttagtaaatggtgagtaggtatttgaagactaaagaaataagtgagttttagtccttaaaactgggtttgtaatttatgccatttagagaatggcatcttacaagcatgtgaagtactaaagttatttctactttcatttatgttgtatcttggggaagggaagggcgtttctctggagagacttattggcttattctcatgttcccttcatggactctgtgccattcttctttatattgcaatataggtatacaatcctgaaaactgatattaccagggcaagtaacacaggatcccgttgtcagaatttgctgcctgaaacggtgaaaccaagggccattcttctggggaggagaaagatgagtgtgtagtagatttccaagtgggaaatacttttcttaaggtcctcagagataaagacaagcgtgttccttcacagctctgaagtgaccctttttacatgacttggagttgccttcttatttttggttgaatgtttttttgcttgatgtacccctagcactcatttcatctccataaaactagcagagatctagtccttgcccactttttttttcccccgtcagagaaaggagaagaagacaggaagtagatttgtgtggtatggacattgatgaagttgagtttcaagtctggaaggtctgtttccagttggtagtttctgtcttgcactggctacttccaaagtcagtcatcagagaacagagcgatccactgtactgctcaaatgcactctttctctggggcagtggagctgaaacagtgttatccactgctttcagtactggaaaagggaaagagccaactcgatttttttccccctccttaggcggagcaacacccatgcacttctctaattacagtggtagaaacagcctctcaaaatgtgacctgcctatttcaaatgccaaacagttaacatagtttgtttcatctgcctaacctccacttgttttctctaatttttttttttttttgctattctttgtcttttaatatcacaaatgaaaatgtgctacaaacctaggctctttgatgaggtgaagatactcaagagacagcgtgagaattaagctctgtcagtaaccatgaccaacaggagcctgttgtccctgaatgatcgtcactggattttgaggggtctgctgggaaagaatttacatttttgtgctttcaatgatgctactaaagttgttttgaatcttgagtcatttccctgctaagaacataacacatattgtacttcatctgtgacttcaactgaagctctgcatttttcagtgttaagggttaaaaaatcagctactcttcccctttgatattttgttttgaaggcctgtttcagagaaggtatttgcattggctcatctgagcagggtggtgatttctattccttctgtaagaatgaaagttggtgtttaagggaagaaaaaaaagaatgagtctcctcttggctgtgtgagctgagggattccagaaaacaagactacttaaggaaggtggcctttaaacagaaagggggcagtagcgagtgagtcaccagcctttcagaaaagggatgcgccgttgtcctcatccgccacggtgttctgagagctgagttgtatggacaccaagtaccaggagataggagactgaggtacaagttgggtggaatcatgaggtaggccagattgagcagaggatctgtctgtcctccctatggccaacttgagcagaggatctgtcctccctatgtactgcattgaccgctgcttgcactgtgtggcctctggctgcccgctggttttcaaagttagtgccagggttttccattattctgtcttcaggaggggttcagcccttggtacctcagttttgattggttacccatccccaaattgtaagttatgttaattagagataaactcttggaggtttagttccaaaaagatagaatgcatggaagactgagtataatttgaaacctagagtttttgtagtaatgccaggtcaaagcattatctcagtctcaaagatgaaatggtcagtaatgcctgaattacagagaaaagtggtggaggtggacagttagaactgcctttctgtggttgggtgcagtggctcatgcctgtcatcccagcactttggaaggttgaggcggtcgaattgcttgagcccagaactttaagaccagcccgggcaacatggcaaaaccccatcgctacaaaaaatagaaaaagtagctgggcatggtggtgcagcacccgtggtctcagctacttgggaagctgaggtgggaggatcacttgagcctgggaggtcgaggatgcaatgaggtgtgatcgtgccactgcattccagcctgggcgacagagtgagagcctgtctcaaaaaacaaaaccaaacaataacaaaaaatgctatttttcttttcaacagtgtttttcctccgtaaaactgcattaatacttagaagtagggatggttagataaaactagtgttgagtgttcccatttggtgctatatacttgttataaaatgatttctgattaatgactttctgaattgctactcttttactttatacggtaagtgaaagtgtttcgttaatttattcacacatcaatcctacccccgccaccagaagctggggttgtagcatatggagaggctatttatcctcataggtcgtgaaagccgaataaatgtttacttttgcagataaatctgatgtttgagtttccttttctttatattattttatttttttgagatggagtctcgctcttgtctcccaggctgcggtgcaatggtgcaactttggctcactgcaacctctgcctcctgggttcaagcaattcttctgcctcagcctcctgaatagctgggattacagatgcatgccaccatgcccagctaatttttgtatttttagtagagacggagtttcaccatattggccaggctggtcttgaactccagaccttaggtgatcctcctgtttcagcctcccaaagtgctgggattacaggcgtgggccactgcacccaaccagagtttccttttctttacattttttggtggtttcctgccctccgagtatttcactctcctggatgatactattgaaatttaagtttttagacacattaactcctcacttgctcaattgtttttcttcatgcagattcagagtattccatttccaaatagcattagtttcacagctgccctatcaggataagtccaactccttagcaagacattggaagactcttaaagtctcctgcctgacctcttcagacttacctacaatgctttccttcttcctatccctgggtcattgtgaataagttgcagtttcccagaaagtgcttgtttcaattctttcctcaaccccgtttgcccagatgatatctgtttcacctgttaagtcttagtctaaggtttagctctggtctttcccaattgtcctattctacatgttcttcctatcgtaggaccttttttttttttttttttttgtgagacagagtgtcactctgtcacccaggctggagtgtgcagtggcacagtctcacttcactgcaacctttgcctcctgggctcaagaaattctcatgccttagcctcctgagtagccgggattacaggcacataccatgacacccagctgatttttgtatttttagtagagacggggtgtcgccatgttggtcaggctagtctcgaactcctgacctcaagtgatctgcctgcctcggcatcccaaagtgctgggattacaggcgtgagctcccgcgccccacccttcctatcataggaccttcacactgtatcacctctctacttctgtttcctctgccagttttgagtgcgaggactgagtcttatttctttttgtgtctccagtgtgtaatgtggtgcctgacactcagtagatactatgtaaatatttgttgggtgtgtgattatataaatattaagagatgtgatacaagcattcataaccagaaagatcacagtgacttctgcctggctgccttttctatatttttttaaagcaagtttataatccaaagttgtgccaactaagatcttaggatcattaaagaaaaagtacttttaaagctaagcatacttattcaaaagagggagcagaaaattctacctttatgtatataataagttaacatatgtaatggctaaacctaacacattaacactgcagaaataaaccacttaatgtgtcttctttctatctttagaatattatccaagcatcaagaataaatcttattgcacaaataaaacaagagtgtatcatgggctatagcaggagggggaaaatgtcttgggtatagggtgagaaagtaaaaccagcttttagtacttgtttggtacagttatttaaatgctctattttactttgagattggtaataactggagctcaatcatcatgctccagagggagtagtagctcaacttcactgattctgttatttttaaaatttttgtacctgaaaggtttttgtgcgttaatacattttttgtgccttaatacaaataataaaggtttttgtgctttaatatgcaagtaaatgtacatgaatggcagcggcagctttggagtgaaacagctgtgattatgtttatcatcacagattataacggtgattagaatcactttcaagattttattcaattgaaaggaaagaaaatggatatgtattcaatgctacattatgtcagacatctagctttcatattttatatgctttcattccaaaagcaccccataacaggatgttatccccatcttagaaatagagctaaagtacttaaccaggctggtggggcgtgtcatgggttcagattctaacggttctgcagaaaacattcttcagagccaagtggaaacttttggtatgaatgaagcccggatttatattaggagaggaaagaatgatgccattatgaaacatttcttggtgacataaaattaaggtttcactgtcctcatcagtctgtcaaaatttccacggcagaccctttatttcaggtcttgttttccacccaaactgtgaaatctcatgctaaacttaaggcatggccacttcagtgttggctgtgtctagtagaaattgctataactgcattaaaaaaactctttattaaattatacaaaagggaaaatggtttctggaaatagatttctatcaaggatggaatggaagggaatgatttgattaatggccagcacgagataagaattatttgagagcaagtccatcaagtaagattagcgtaagggcagttcatctttaatgccttctcttgctgttccccctccagtatccatgagcaatagtagatccatctgtcccgtccacggtgactgcagtaggtagttaggaaataaaccataaggatgtaaatatgagacatgagtttagctctgacttggacaagcttcctcaagtttgaggggatgggtcaatgagggtccagttaacagttgaattgagagtaaaattctactgtagagattaactcatggttttaccgtcaggaaaactggtagttttgagttaatctctacgatagaatttctttctctctctctctctctagatatatatatatgtgtgtgtgtgtgtgtgtgtgtgtgtatgtatgtatgtgtatatgtgtgtatatatatgtgtgtgtgtatgtgtatgtatatatgtgtgtatatatgtgtgtatgtatgtgtatatatatgtgtatatatgtgtgtatatatatgtgtgtgtgtatatatatatacacctagcttgtgtgatacacacaagttcgtgtgtggttgtgcacaaagtttatgacgtaggggttttcttatacttgaaacactacaactgatagccagcacccatatagcacttactgtatacactgttctaagcactcacttttaactcacttgatcctcacacaattctgaagagataggcagtgttgtgattcccgttttacagatgaggaaacaggcactgaggcacagggaggtttagtaacttgtccacagccacatagttagaaaatggtggggctgggattcagacctgggcagtatgagtccagatgccatgctgttaagccaggtgttctgctgcctctcacaattctccttttcttgaagttttgtcacacttaaatcacaccattaacttgaatgtcgaggtattaaagaatgaagtgttttttctttttttttttttttctgagacggagtcttgctgtgttgcccaggctggagtgcagtagtgtgatctcaactcactgcaacctccgtctcctgggttcaagcaattctcctgtctcagcctcccgagtagctgggattacaggcatgtgccatgatgcccggctaatttttgtattcttagtagagatggggtttcactgtgttggccaggccggtgttgaactcctgacctcaggtgatccgcctgcctcggcctcccaaagtgctgggattacaggcatgagccaccacgtccagccggaagtgttttttcaattcagtagcacttaatgtgcttcctgcctgtagtgggagcttatggcctgatacatggacctctgtttagtctatgtcatgccagaccctgcagggcgcaggacagaagacatatatgaaaacaacacattgtaacaatacatctatcacgtacattatattacatcttagtctgaatgaaataacagtttttgaagcatgtgggaaggaaggagatattttttgagctcatcaggagatggctcttgttttgggctttgtaggttgctagaatttcctttgattaggaaaatggaggaagctcttctaaggtaagggaatggcatgcgtgagagagggatgagagtgactcacgttccaggagtagtagactgagagagcccatcttatttgggatgttgcccccactgacctccaaatggaagaacagataggaaaaatatgtagggagctacttcatgctttgccacatactgattctttattaaatacatggtttcctcttgtaactttttgttttcatgtcatcattttcagaacaaagttacaaatacagagattactgtatctacatgtagaagatacattgtactgaagcttggaaaataacttcttgtgtttaaaataagcttgttcaaccggtgggccgcatgcagcccaggatggcttagaatgtggcccaacacaaacttgaaaactttcttaaaaaattatgaatttttaaatttttatttatttatttgttttaaaagtttatcagctatcattagtgttagtgtattttacatgtggcccaagacagttcttccagtgtggcccagggaagccaaaagattggacacccctggtttaaaaagtgtgctactttgacacttctttctgctgatctctctactataaggaagctggcaatagtgattattgattatatatagcatcatgttgggagtccagggtcttaccgcatggaaattatgactggagatgagatactcagttatactagatacatgtattaataagggaaaaataaagaactaaaatatttacatattaaaaatcagcagccgggcgtggtggctcacgcctgtaatcccagcactttgggaggccaaggcaggcagatcatgaggtcaggagatcgagaccatcctggctaacacggtgaaaccccgtctctactaaaaatacaaaaaattagctgggcgcggtggcgggcgcctgtagtcccagctactcgggaggctgaggcaggagaatggcgtgaacccggaaagcggagcttgtagtgagcggagatcacgccactgcactccagcctgggtgacagagtgagactctgtctcaaaaaaaaaaaaaaaaatcagtaacactttctattttagaaactgtcaactgatgtattcagtcagaatttctggttcatgatccgtagtttattccttctctctccatgggctaacctcgggctgatgtgttttcaccgtggtcagaaaccttggtaaggaaaggaaaggggtgctgcagtgtactggtatcctagtttggagtattagttttcatctgggattgagatttgagaaatacaagtttacatgatactgctaccatgctactgtgaacttacagtgtactaccaccccatgggtggaaaggatgctggaacagaagctaagtaggctgcccttgtgtgtgactggtgaattgggaagctgtaatttgaaattggggagatttagtgaatgtcttatgtttccattgcagtcgtttttttagttgctgaagctgtacagataagtagccaatccctttttctcaacttatctcttcatttttttccttctcttaggtttctaataaggaatgatttgtggtgctgtttgtgataattggaataaaactctcactggtttagaaagcttggctcacagttgtaaagacttccattagcttccattcagatttatgttgaagttaaatggctgtacactagcttaaatcattttcctccttttgttgaattcatgcatgcaactatacatcctaagtgaatgaactgtcctaaaatgtgaaaatgggagattactcattttttaaaaatgtaaaatattttaacttgattcttaagtatttacaatgtagaaaatagcttaaaacatgactgttaagttctaaatatgaagatgtttttcttaatgctgttatagttgggagaagttgtacatggatgacttaaaatttaataggtgggcttcaaaataagatgatcatattatgagtaatttgcctaacaatacttctgaagttttctttttagtgaacttaattttatcatgtgccaaatttgtttaatactgaagtgacttttgttgctttagtttcacattagtttcttcaatctgaatggcacattaatatggaaaacttctctagaattctgttttaattaaaaaatgaggctttgtttctgtatatcacatagatgtgactttaaaatggaaatgatcgttaattacaaacagtttagaaacatggaggaatgatttttttttaatttttaggtgctaattcaagtttagggataatggctgataggcaccattatccttttttttttcttttttacttattttgtacaactaggcaccatagcacatgctggtattgagctggattgatgtctgtgtgatgcaaattaactttcaagtcatattttataaagctgagttgtcgggctggagcgggaatagttggtatgcttaagacttgtcatggtgggttgggcgtggtggctcacgcctataatcccagcactttgggaggccgaggtgggcagattgcttgaggtcggtagtttgagactagcctggccaatgcagtgaaaccttgtctccactaaaaatacaaaaattagccaggcgtggtggcgggtgcctgtaatcccagttacttgggaggctgaggcaggagaattgcttgaacccgggaggcagaggttgcagtgagccaagatcacgccactgtactccagcctgggtaacagagcaagactcggtctcaaaaaaaaaaagacttgccgtggtggctggcctaagtaggcagattgcttgaattcatgaattttagaccagcctgggtaacacggcaaaaacctgtctctacaaaaaaatattttttgtaataaaattacaaaattaggctaatttttattagcctatagtcccagctactttggaagtgggaagattgcttgagcccggtggttgaggctgcagtgagccgagattgtgcagctgcactttagcctaagtgacagagtgagaccctgtcccctccacccccacccaaaaaaaggcttgcaatggtggtctgccatggtggtctgccatgaatctaatgaaatgttgtggaaggataatttagaggctctgggcttttttgtttaattttctgagtaatatgacaattgaagtatattgctaatgcttttctagatgttatatgttttatttaaagtaaactctggaaaatagaaagcatttgtgattttaattttgacagtatcgtttgtgcacaagttgtttttggctgacttacccgttggtgaagaattattaaaggtcaaagttttatctcgaaattatgaagcacgttattaactttggcttctgttgtatttccagtgtgttcctttttgtcaggttatattttatattctaggtattttatcctgatagcctgatactttttcttatatggagactttttcttagcatgaaaaaaaaatttttttaagtagaatatatttcatgtcagatgagcaaaactttttgtcactaagaagtaactgggtatctcttacatgacattgggttttaatattactaaaattatatattcataggtggtagtcatgcaataacctgaattcatatacttcttttttttttttaattttttatttgagacagagtcttgctctgtcgctcaaggtggggtacagtggtgtgatcttggctcactgtaacctccgcctactgggttcaagggattctcctgcctcagcctcctaagtagctgggattacaggcgcctgccaccacacctgactaatttttttgtatttttagtagagacagggtttcgccatgttggccaggctggtcttgaacacctgacctcaagtgatctgccacacttcagcctcccaaagtggtgggattacaggtgtgagccactccacctgcctcttaattcatttacatttaaatactgacctttgttgaccttcttggtgaatcctgttgtcatagggtcaggaaaagccctgttgttagaattttagagtaagaaaggaccgtagaggctgtctagcccaggttcttgaatttatacctgtagaactggctataagagttaagtgacttgctgtaaaccaaacccccagagagtggccacttaagtctccagcccctacctcctataggatgaccctgtgctatgaacctttgtacttgtactctgtagtcttgactctcaaatgccattcccagtgagtacaagtgcccatccaatactctattttttttttttaaaaaaagaaagcatgagggaatctgcaaacaaagcagacgtgagattccttttattttctttgaaaaacggcagtgccttttagagtcaaatatgcatctaaactctaggagttttaccaggtaaataaggattgtatatttagctttcataatttataggtgaacagtctagtaacaacataaagaactcgtattaaagaatattaaaaatgcttcagacttttgatttgtattggatgagaattcatgggcaaggaagatgaccgttcacgaaattgtatattttttctctctaattttaactctgtgattctctggcaacaggctatacagttctggtgttacttagtctgcaaaaatcttacattgttttcataccagagctgattttgcctttttatatattacctaaaatacacacatacaaataaattactcattagttaatctacaaatgtacatatttttagtagctccctaaacaagatttaaagcttgactaaatgtagtcatggagcttattatttggtagttttgcattctgtagtttatgtaactctatccttaaaattgaaattatttctgagtggtacaagccaaatacagaagtcaaagctttatttttgatagtttcagtgttgttgatttgaggttctgaccttggaaataaagatacagaaaataaacacacaaaatatacaaaataacaatggacatttatgtatgcttttttcaatgtttattttctagctaaatccaagcacaacctaaaagtcttataaatattccatggaaaattttccttcctatgctaggtttctgagttgctttaaaaattagtctgaaacaatggttactttttttctccttggtaaatttccctgggggagtctcttggacattctttattgccctgagtctttgaaccatattcagaatgagaaactgaagacagttggtctgaagatactcggaggatggacagaaatgaccacagctgatttgatatgtatgaataattttgaaaaattttgatagaactcaagtgccaaggacagtttccatgtcgccttctttattgttcctttgtgcctgctatatggatgttattgtcttttttgaataatggcctcccttttcaaataatttagctcactttttaaaaattttttttagacagccttgctctgtcgtctatgctggagtgcaatggcatgatctctgctcactacaacctctgcctcctgggttcaagcgattctcctgcgtcagcctcccaagtagctgggattacaggcatgcaccactgcacttggctaatttttgtatttttagtagagacagggttttgccatcttggccaggctgatctcgaactcctgacctcgggtgatccacccgcctcagcctcccaaagtgctgggattacagggtgttagctaacttgtcttaaaaaaatctttgatagttcccagaatgaagggctgaggggacttgtatttgttccatgaactcagactcatgctatccacatcctgaagtgatcaaaccatccttggctctaacaactggagttctttctcatcattacccttctgaaatctttagaagaaataggtttctttgctccaaactttttaaacttttagttgctttggagtaatgtcactctgggtgaggtcagccttgtcagggtggttgctgagtgcatttatattggttctcattggcagtaatctcatttacaagcatagttaatagaaatggaaggccaaagatcttatgtcattgcctggtctcttaggagagatgaaataggaattcatggagcctcagagatctggaaaagcatcttcctgtagactaacactgtcctgtagaattttgtgtgatcatggagtgttccctaatctgcactgtttagtatggtagccacttgcaccatctggctattaagcacttaaaatgtagaatgaatttttaatttaattcattaaagttaaatggctacatgtagctaatggctactgtattggaagattcaaatttagactatttttaagaaaataaaattctttaaattttttaaagagatggagtctccctctgtcatccaggctagagtgcagtggtacaatcctagctcactgcagcctccaactcctagcctcaagaaaccctcccaccttagccacccaagtagctaggaccacaggcagctctcaccgtgcccagctaatttttaattgtttttttttttttttgtagagatggggtcttgctatgttgtccaggttggcctccagctcctgacctcaagcaatcctgtctcggcatcccacagtagtgggattataggcatgagccactgcacctggctagctttggagtattcttagggagtaacattggatcatattttttaaacctgaatttcattgtaaaataaaacacatacagaaaaccatgcaaaacaaatgcatagtttaatgaattatatgtcaacattcctgtaaccactgcccaaggctaagtagtaaaacttgaccagtcctccatgtgcctcatccctcccaccaaagtaatcactattatgacttttagattcatggcttcctcatgctttttagttttatcacccaagtgataaaacttatccttaggcactatagtttgatcttgcatatttcaaaataattgcaaatgtccttaaatcttttttaaatgatcacttcctcctccatctcctccttttccttataatttatctgggggagtacctgacttcttttgacctgtggagttttccacaatcagaattttgctaattgcatgctcccagtgcacgttaccacattcctttgtattttctgcaaattggcagcttgatccagaggttcaaatgatcagactcaggttgatctgggttatttagtttttaagatgcctttataacttcacatgcttgttaattatgggtctgttattgtggaaagaacaccaatggaatgttttctatcaaggtgtccaaaattgagagcagttagtatgataaaatggtttatgttaaattttgctgtatctaaaatgcaacactgagacatctactgagtgctacttgtggaaaatcagattgtcagaggtttctctaaatgtatttaatatgttcattggacctctatgcagattgagtttttatcaactgcttctgtgggcaagaagtgtgtatgggtatgtctgctggagtggtagaaagaattgctaatcagatgggcacggtggctcatgcctgtaatcccagcactttgggagtccgaggcgggtggatcacctgaggccaggagttcgagaccagcctggccaacatggtgaaaccccatctctaccctaaattcaaaaattagctgggtgtggtggcacattcctgtaatcccagctactgtggaggctgagacagaatggcttgaatctggtaggtaggtggaggttgcagtgagctgagatcacaccactgcactccagcctgggcaacacagcaagattctgactcaaaaaaaaattgctaatcaaatcgttatagccatttacttgtctaaacttcacccacatgactgtacataccatcttttttttttcctggtcttttaatttccaacacaagattaaaattgggttttagttatttttgtgcactggaacatctggtggcaaagaaagcaggaggtgaattgggtgtgttcctgtttgaagaagcagatggtcaataacacttggacctgctgtgtatagaacttcacataaacattgatatggagaaagagttttcataaaaattagcctctttactcttatcagggagtttaaaatataactagataaatatgacttagatacacaaaatactaagggtgcttttatgaagaaatataggcaggcatcagtggctcacgcctgtaatcccagcactttgggaggctgaggcaggcagatcatctgaggtcaggagttcgaggccaacctggccaacatggtgaaaccctgtctctactaaaaatacaaaaaaaaaaaaaaaaaaagctgggcatggtggtgtgtgcctgtaatcccagctatttgggaagctgaggcaagagaattgcttgaacctgggaggcagaggttgcagtgagctgggattgtgccactgcactctcgcctgggcaacagagtgggactctgtcttaacaaaaaaagtcaacatttataagttaatatataaaaaaaatttgagagactttccaatgtgataaaaaaagcagtagactggaaattaggtaatcttgatttgtctccagtttaggcctttgtcctcatctgtgtaaatgagggaattagactctagtagggatagcaaacatatgacattcttgccagatactatggcagataacactcattagtcacggtcttcattcagcttcagaattcttctcaaatttagggctccagtggccattacatattggttgattggaactgacatgggagacaacaatttgccattcctaggctacatcctttccaagtcccttcctagctacagatctcctctgtgaataaagaaaaatccttggaagctctaaattaccctgctagtcagtgtttctataacatatttcccccacttcttttaattcttccctggaagtgcagcatctcagaaaaacaactatgccagtaaaaatttttcctaaaaatgttatccattgaaatattgaacatttcatccaaagcaaaccattggtcattgtggattggccttaggccagaattgagttggtttagaatgggttggggagtgggggaagccaacaatcctttttatcccttgatgttatttttctttattagcagcatgtaaaatgttaaatttttctaatttttgttgggcccaagccgatgtttattacattcaatttatgggaactctttgcagttgaaatttggtatttgagtcacgtattgctttcatggtcttttacagagctctgtgacccaagtagtcactctgttgcctcccgccccactttaaaaaaaaatctggacaggaaataacaaaatactaggagtagacttgtgtttgaccttataggaaccataattaagggtgaaatagtgggatcctcaccccagcaatgcttgatgatagtaggggtagagtgtcctattcataaatccacaggagagaaagtcatgttggaaacagcaagtcaggaggctaatgttcctaaaaaccctttgagaacagggtgtagagaagagagaaaaagccctaaggggcgggtggttgtgatttattgaaagcttactccgaatcctttgagctacctagagagccctaggattactttgagtttataggactgcaagcttttgcatgcacaactcctatttttgaaaatttgacctttaaaatgatttcctttcctgtctcccatccctctccacctttcccccttttaaaactggacttttgtgtaaagttttaggttttagggttgatgtgaaggccctaagacctccatctatgagtggctaccatccattcacacacctaaaaattatttagcaggtaccgtactagttactaggaataaccggaggacctaccatttgttgagaaccccctttgtgtatggcccactgttaggcactttatgtagatatcttttctcatttaatcttcactaaatgaggacagattattttctggatgtaactcagatttaagtgttgctcaaatcacactacgtgactgggttagtgtttgaatgtagagcttcatactcgttcattttgttttttctcatgacatggatttttgtgacatttcataaaaaaaggtttttgaaaggtaatttctccgtgggtttgcatatctttaaaagcaaatgttgtcttccctgccctctgccctcactcacccgtaataaattgtaaaaatctgtctgtaagagcatgctctttaatttcctgtcttatatcctggtggtatgtgatgatataaaacaagtgtggctgagcctggcaaatttataagattgagaaggtttcaaagatgcatgaaaatgggtttacgtataatcaaaggttaattcaactctaacactttacttttgaggagcatcctcttttttgtatccctacctggggatgagagctgctaggagcgcagacaactcagtaattgtgtgcctgcctcatgcctagtctgttcatccttttgagctgtcaagatcaattatgttgaacatagccagagtggggtgtagtctgggtacagactcagcttttcttggcattggcagtatgtgacttctgtatctgatgtgtccatccaattcatattttggaatttacttagatatgcctcttattcatcagtatttgaaaattcttgataatctaaagtttgatccaggggagatttgctgaaagtgacatcaaacagtacctttgttttacttttaataatggattcatgtaaaaatcaccaggcatggtggcagacacctatagttccagctactcaggaggccaagatggggggaatcacttgagccctggagttgaaggctatagtgagctatgatcataccactgcactccagcctgagtgaccaagtgataccctgtctcttaataataattaaataataggccaggcgtggtggctcacgcctgtaatctcagcactttgggaggcagaggcgggcagatcatgaggtcaggagagaccatcctggctaacatggtgaaaccccgtctctactaaaaaatacaaaaaattagctgagtgtggtggtgggcgcctgtagtcccagctacttgggaggctgaggcaggagaatggcgtgaacccaggaggcggagcttgcagtgaggtgagatcgagccactgcactccagcctggatgacagagtgaaactctgtctcaaaaaaaaaaaaaaaaaaaaattgctgggtgtggtggtgtgtgcctgtaattcaagctactggggagactgaggcacgagaatcactggaacccgggaggtggaggttgcagtgagccgagatcgcgcccctgtactccagcctgggcgacacagtgagactgtctcaaaaataaaataaaatttctggatgtttctatcgtcatgtgctcccgtaaccgccagctatctgacatcaactctgtaaacttcatgtcctgtgtctccttcgtccacatgacttacatttttttatttcaattcatcttttctgctctcatctctatttctcatctttttgaaatttgtagtcatcagatagcttttatttgagtattaatatgacaagtttagaggagaattatttcacagaatgaggtctgaaattttaggtgactattcaacagattttttttccctaagcattcatcgtcatatctgccagccacggtgcctgatgctggagatacaagtgagcaaagctgagactacctctgctggaatccctctagtgatggacccagccactaatctgaaaatcatgtggacaagtaacaaaagactgcatatggagttaccaaggaaagcactacgggattttggcagtgtgtaacaggggacctaacttagtctgaaggatcaggaacgtctctcctgagaagataacatttttccctctgttgcccaggtaagagtcagtggtgattgtagctcactgcaatctcaatctcctgggctcggtcctcctgcctcagcctccagagtagctgggtgttaacagatgcatgcccctatgcctggctattaaaagacaattttttttgttttgatagagacggggtctcgctatgttgtccaggtcggtcttgaactcctggccggtcttgaactcctggcctcaagctatgatcctcctaccttggcctcccaaagtgttgggattacaggcatgagccaccatacccagctggaaataatatttgaatgaactctaaaggaggaaaggagttaactgattgaaaatgaaaggaaaacccttctaggtaaagcagccagcaactgcaaaggccctaaaaggggaacattgtgtgttctagaaactgaaggcagaggctgggtgcggtggctcatgcctgtaatcccagcactttgggaggctgaaatgggcagatcacttgaggtcaggagtttgagaccagcctggccaacatggggaaaccctgtctctactaaaaatacgaaaattagccaggcatggtggcacgtgcctgtaatcccagctacttggcaggatgaggcaggagaatcttttgaatctgggaggcggaggttgcaatgagctgagatggtgccactgcactctagcctgggtgacagagccggactccgtctcaaaacaaacaaacgaaaactgaaggcagatctcatttgctggagtgttttgaatgaggattattatggtgagaagaggctggagaggtaggcaggagccaccttgcaggtcttagtccatttaatccgtgttaaaaattcagtgctttagcccaagaaccatggcagtctttcaaagggctttaagcaaggaggtggcctgattagtgtctccttgtgtaggaggatcatgcctactgttatgtgaagaactaactagaagtgggcaagaatggatggggcagcctgttgggaggtctttcctcattctggtgagagacttggttccagaaaccagagatgtggtggaggacaaacgtttgcaaatccaggatcctttttaggaggagagatcagctggacatgatttggaggtagaagggagaggagggtatcaaaggtcagaggactgtggtgccattcactattacgtagcatgctagaggaagaccaggtttcggggaagaccatgtggttttaaacttgctgaatgagaagtgccttagaggtctccaagtgtatggtacagggactggggcagagggtgatgccgggaaggcagctggatttaggtgctggagctgagagaggcagccaggactggagagtcatctgcttacaagttaagttgaatgaatggcaaggatttgagtgcctggaagaaggcacagagagaaaagatgagagggctgatggaatcagtatagtttagtcatctacggagatgggaatgaacaagagagggcagggtttgcccagagaggcaggaacaaaaccaggagctgtggtgttaggaaagccaagagaagagagaattttaagcaggaggtccctactgccataggtaggacaaggtttcaagacaggagctgctctgatggcctgtggaggttggagcttcatcgtaatgggcagagtaaaggaaatacctctgcagccatctgagcagtaattccctggagagttaccaaggattgttcagtcaaacacaccccgtcatttatctggatagttctatttttccatacattgtctttgatcgaaatgtcgatcttttttcaaccagccgggatgaaaatggtgtgaatcgtgttctctctctttagaaagaaactgataaaattgggttttctttgttcttccttttattttcatccattcaatacctagtcctcactgagctggtcttactcaacccattccctctgctggtctgttgggtactaataacagatggaaacaactgggaagataaactattttcctggatttttttttttttttttttaaacagagtttcactcttgtttcccaggctggagtacagtggcacgatctcggctcactgcaacctccacttcctgcattcaagagattctcctgccttagcctcccaactagctgggattacaggtgcccgccaccacacccagttaattttttgtagttttagtagagatggggtttcgccatctcggctaggttggtctcgagctcctgacctcaggtgatccccctgcctctgcctcccaaagtgctgggattacaggcgtgagccatcgcacctggcccctggagataatattgatatgtgactcagggaggtaccaaacccaactgttgccccctttcctttatttacttatccaggatatttatctatatctgtaaaaggatttattattttttagaatcgtacagctgtaatgtctattcatcctgtcagaagagataaagcggatcagtaggcaagcatttgttgctgcttgagagagattttattaagctaaaatattccattagactcaactccattttcaaatattttgttaagagggtctcaggatgactgtaggaaaaaggtatttggaagattgtgtacactgacaataactagattacaaaattttataaattagttaagatggactttaaaatagcaacaggaaaaacaattttggacttgtctgcgagtgcgagtgaagctgatagtaatgagatttatgggttctggccctgcagggatcccagtagggatgaataaagcacatgcctgctagtacattcactgattctgctcttggatatattatttacttctttcctcttttagtaagactttcatctgtattagtaattgttctatacttttaatctctggagcaactccataaattaacaaggggttgtgtctaagatgatgctgatagccctgaagatgttttatttagtgcttttgggatgatgtgcagagatgggatgtcagaaggaataatttggaatcttatctccctgctccttggactcatgttatcaggggaagggagcttggggatgtggctgtcttagctgtgtcctctgatggcctcatctcagtggtttgggttgaaagactgtatctcgtgcttcctgtcccatcaacctctcccttcgtctgtttttctcttctgtgtttaagtataaacagaacccctttgtacctctcatctctttatcttctgaagactctgatgtggctactatgctctcccatttggttaatgctactttaggtatttagtatctttatacttttgttgtgttagttgtgatcagcaaagttctatgctgtagcaacacattaatctgcagatctcagtggcttaacactacagaggtccacttctcccttgctgttcatattcattgtgagtcggtaccgggactctcctctgcacagacttgtaggatctcagtacctagaacctaaggccggatctttcaggagctggggaggagggactggaggatctctcatgggcttttcattgcttcagctcaaaaacacttccactcaaagtcattgggcagagaaaaccacacaacttaattatcttaagaggtggggacaggggaagtggagcgaccgagagaagggttggaacatacagacataagaatgagaaagtcttacgagtgttctggtctctgccccatctgtattatctttgtttctgggaaggaaatttctgacagctgtgttgctagcataacctcttggttggtaaatgcattgctgtagacttttccttgatggaaactttctccaagacaatataaactacgcattgtctctttcttgttaaaccacttttttttacagtttattttttcgtttgctgttgaagatttgatcagtattttccttttgaatccaatggtagcaaaccaattttttttttttagaatatattaaggcaaaagaaaacaacttttaccccattcataataggatgtataaaagtaatacctcttggaatagaccatgggaattctggtgatacctagggcatcttatttgataaaatattttttctttctttccttctttcttccttccttccttccttccttctttttttttttttttttaaacagagtcttactctgttgcccaggctggagtgcagtggcacgatctcagctcactgcaacctctgcctcctgggttccagtgattctcctgcctcagcctcccaagtagctgagattacaggcatgtaccaccatggccagctaatttttgtatttttagtagagacagggtttccccatgttggccagggtggtcttgaactcctgacgtcaggtgatccccctgcgtcagcctcccaaagtgctagggttacaggtgtgagccattgcacctgactgaaagtattttcaaagcctctgctatggagtatagtgtgagatgtggagaagctgcagagggaggggcacgttagcatctaaagactctgttgaccatcatccacattaggtccattctaccattttctatgaagtctaaaataggttcctgattattttgtttttaattttttttttttttgagatggagtctcgctctgtcacccaggctggagtgcagtggcatgatctcggctcactgcaagctccacctcccaggttcacgccattctcctgcctcagcctcctgagtagctgggactacaggtgcccgccaccacgcctggctaattttttgtatttttagtagagacggggtttcaccatgttagccaggatggtctcaatctcctgaccttgtgatccacccgccttggcctcccgaagtgctgggattacaggcgtaagccaacgtgcctggccggttcctgatatttttaagggatttgtttgtgatttaagaatctggctattttataggacgcttaagtgttctttgtttaaataaaattaaaacttcaaattttcctttacaaccatttgaccagttacctctgtttcatctgccatacatggaaatagctttcccagagaaactgacatgaaggcatgcagtctactacatcaatgacatctacattacaaataatttaaaaatagtatatgaagcagagactgggtttacctattagaaaatctaacaaactatagcaaataagcataatttttaaggaaaacagatccctctaaatggtgcaaattttatattaatgaaagaactcaatctttaactcatattcttgttatagcatgaatgatcaagctgttttctgataaatagttcaaggataaagtggtctaatttgaataatgggactttattaggggcatctgcattaacgtgatttgaagcacatgtttgtatgctcactcagttgccttttatataattacattctttatcagttgttggtaaaggttcacttcattttaactagttttcaagttctgtcaggggagagaacctcttattccccatgccctgtgcttgtgaaggggtctgggctacgtaaatgggagggagtgagactgaaggggattaagtcctggcctttgcagttctgttgtcagcctcccccaggaaccagtgcctgactccttgggtccatctgttccgagccctgacagacaggacaagtagaagtaggtctagtctttcttcctactggagggtaacttcggagagtctttaggatgatgctcttcattgaaacctgggggttatactttttaaaaaaatgtgtttcactgtccccttaccctctgattatactagtcttgtgttctttttagaacacctaatataaagtgtaaaaaagtgcaaataaagtgtaaaaaagaggccgggcacagtggctcatgcctgtaatcccagcactttgggaggccgaggtgggtggatcacctgagatcaggagttcaagactggcctggccagcatggtgaaaccccatctctactaaatatacaaaaattagccaggcgtggtggctcagcctgtagtcccagctacttgggaggctgaggcaggagaatcgcttgaacccgggagttggaggttacagtgagctgagattgtgccactgcactacagcctgggcaacagagtgaaactaggtcaaaaaacaaaacaaaacaaaacaccaaaaaaactgtaatatagtataaaaaagaaatgaagttacacatgatcaagtcatctctgttaatcttttgttatactcttctgtctttttaagtgtgtgtgtgcttatttttttttcctcatgttacaaaaatacatttttaggtcttttgttaagaatatattgtgataactcaatttaaaaatgggcaaaggacttgaacagacatttctctaaagaagacatacaaatggccaataagcacgtgaggagatgctccacgttagggaagtgcaaatcaagaccacaatgagatactgtttcacacccattggatggccgttaagagaatagaaacaagtgttgagaatgaggatacattagaactcttgtgcattgctggtggaaatgtaaaatagtgcagctgctgtagaaaatggtatgaaggcttctcaaaacattaaacatagaattcctatgtgtcccagcaattccacttctgggtatctgcccataagaattgagagcagagacttgacagacatttgtacacccatgttcatagcagtattcataatagctgaatggtagaagcaaccctgtgtttgtcagtggatgaatggataaacaaagtatgggaacacatagagtggaatattattgagccttaaacaggaagggaattctgatacatgctgcaatatggatgaacttcaaagacattatgccaagtgaaatgagccaataacaaaaggacaaatgtatagtttcacttacatgagttatacatttcatgtataacttctcaaactcatggagacagaaagtagaatggtagtgggctaggggtagggggaaatgggaagttcgtttttattttcattttatttttttgaggcagggtctcactctgtcacccaggctggactgcaatggtgtgatcatagctcatgacatcctccatctcctggctcaagccatcctcccgtctcagcctccgtaatagctgagactgcaacacatgcaccaccatgcctggctaatttttttgattttttttttagtggagacgaggtgtgactatgttgcccaggctggtctcaaactcctggcctcaagcattcctcccaccttggcctctcaaagtgctgggattacaggtgagagcctctacacatagtgggaagttagtttttaatggtagttccagtttgggaagaaaacattctgcggatggatgatgatgatgattgcagaatggtgtgagcgtagctaatgctgtagaactgagtacactccagcctgggcaacaagagtgaaactccccccactgcccaaaaaaaaaaaagaactgtgtgcttaaaaatggttaaaatattaaattgtatgttattgcaatttcagagtatattgcgatcatttcccacattacatatattttgaaaatgtgtttaatattccattttgtagaatatcttttaccattttatttttagccactgtcatttttctgtttttcactaatgcgaggaatactatgatgaataacctcgtttatcaggtttttctttatagataattacttcaggtaaattcctaggggtgagattactgggctacatagtatgaacctttttaaggctcttgatccatatcatcacattaccctcagaatagttactaaatttcatttcagccaagcacacttccaccagcagtgtatgagggtcagctttcattttatcttcccagacaccatgtgttatctttaaaaataaattgcctgttaagctaaacaatgatatgtcatcattgtttcaatttaatccatttttattactgatgacttctgttttttttccactttcattaatagtacctgaaatatagggagtgcttcatatttgttgaatgaatttgtcaagtatctactaggtgccatatccttttatagatgtgtgggacataatatcaaacaagactgaattatattatacttctctcactgtgtttacagtctagtggaggagtcaattaaacaattgataggtgctatcagttgaagtatgcttgacatgcaaacaaatattggtgatccctaacccaacctgtaagagatggggcttctgtaaggacgtgatgtttaagccaaaatctcgttgaatgggaggcatctcaaggattctccttccaggggatgaaatggagctcaaggaagaaggaatgtttccagaagaaaaacctcaagatgtaaactaaagttggccatttgtattttttcttataggatttggctattcattgtgctttgctctttttccccctctcctattggcttaagtttttttggtggtggtgggggagtaatttaaaagtacctgttatatagtaaattattaaacatttgcctatatagtaaattattaaacatttgctattcatatataatgttttacccttctctggttaattcgccacatcctgaacccctgcaaataagtttgtgtgtgtgtgtgtgtgtgtgtgtgtgtgtgtgtgtgtgtgtgtgtgtttgagacggagtttcgctcttgttgcccaggctggagtgcagtggcgtgatctcggcttactgcaacctctgcctcctgggctcaagtgattgtcctgcctcagcctcccaagtagctggggttacaggcgcccgccaccacgtccagctaatttttttgtacttttagtagagatggggtttcaccatgttgaccaggctggtctggaactcctgaccttaggtgatccgccctcctcggcctcccaaagtgctgggattacaggcgtgagccaccgtgcccagccagacgtgccttctttattgatgtaggaatctgtttaattagatcatttttttcctccgcagagtcaaactcatagtcttgggaggaagataggaagggggcaggcagggaggttacatggggactctgagatgtctgagggtgaggagaggatgaaggcgaggcaaaggaatagatatcgttggtgatccgctaaggacagtgaccttctcaccttatctcagtcctcaacatgtaaagattttcctccattttacaagcaaggaaatcaagtttctaagaggtaagtattgtttgtggtagatctaaggttttgttttgagacagtctcactctgtcatgcaggctggagtacagtggcattatcatggcacaccacagcctcgacctctcaggctcaagtgatccttgtgcttcagcctcctcagtagctgagactaccggtggttgccaccatggccagctattttttttttttaagagatgaggtttcactacgtttcccaggcttgtctcaaactcccggtcttaagcaatccacctgccttggcttcccaaaattctgggattacaggcatgagccactgtacccagcatggatctaagttttaaacctggttgagctaataggaaaacctaacttttaaacttttaataatatacctcaatggttttttaaagggaagtactggaaaactggatgctggctttttgacttctctttgaatattaaatgagcttgactccatggaattcttgtaatcttaaatgccaaagctttagaccataaactaatcactttgtggctttctataagtcaaaaagccaattaaaaaaaaaacttttattgctaaaatttgtaaccagtatggagatttgtgtgtgtatgtgtgattgaacctgggaatcttcccccccctccgccccccttaatttccaattgagtagtgattttttgtggttggagaggtagttttaacccggtgaattcctctagcggttcttgctgaatgatttcctaaggcattttgaaaatctcttgggtagtgcttttaacctggcttcacatttcatctttctttattcagggagtgtttggattttacaccatgcttgaggctgccatgtctcggctgcaataaccagaaaacattggttttctttggtcactgaccaagcttgtcactactcatttctgcctggctctagactgaagacttcagtccaattttccgaatggcctcttttgacttactgtgcaaaacccccactttggctctgaaccattctctgaatattagcataagcacctaatgctgcttgactaaattgtttctgttgagagagggggatgaggaaaggctggcacggggaacatctgttagggctgtaccttttcattgtattaatttttctgacttctgggattattttcattatgcaactcttcaataaagcaaatttggtatgataaggacttaacattcccccccactcattttaaacatatggggtttccaggctgttattcaaagctgtcctacagactaaaatttaaaatacaagtgaaccaagattctgcagctgaatctgggctttgaggagcctacagtgggagaaggggatgaaaaaaaatattttgtggaatgtactataaccaaccaataagatgtttttgctattttaattggctcttcctggcaggagtttcatacagcggtgtctcagacactgaccaaatctgtttatggtaagtcatttttgtagagaacaacaacattcaacaggctatggtatcactccatttggaagtatgtttcctgatcttgaggtcgtagaagaaaatgacaggaacatacttgtgcccacacaggccctaatctgtcttgctggcattccttagacatttatttattgaagagtccttgtgtctatattgaggggagaaactagataggttaaggaatggatgataactttgattctgagagctcttgcgctatcagaaggaatgtgattgacggtgcttgaatgaaagggtaactgttacagtatcaaccaagagatagaggatggctggttttggaagctgacttgcaacactgttatatctggagttataaccttccagagtgttacaaagtttccagtctattcttcctatgtctgccctcagtgagctagcattgagattcggctgtttatttgcagaaatagttaatctatctttcttttaaaattaacgccttctggaaacagtggctcaacggggaaatgaactcttcactaaaatctcacatttcttacgcttccacttggaataagatccctctcaacacaaataatgtttaatttttttaaccactctgaagctaacttaggtttaattttagtttatgctaaaagtttttcttatgtgactcctacagttttcctagagttattgaaaaaactgctcctataaagcaagtttagtttttattctgttcattttagatccttaatattgttctttcattactacttgaggggaatttaaaaagaaagaaatataacagctgttttgaagtacatttgaaaaatggtaaactgcagaatctgttgcttttccttgactctcttcactctcccccaaagacctttaaatagaagctgtttccttttgctgcattaaccccaaaccctatctgatttcttccagttgccgagcaaacagtggcagcttgcctctgaaggccaccaaaaaggaccaaaatgtttgcatggaaatggcaaccaagaaacccctaatattaagaacctaccttgaaatctgccaattaatgaatggaagcttcatcagattttcaaatggcttttataaaattatataatggaggtgaaagtgaaaggtctacactataactcctattacatgagctaaatgtgtaagccttaccatttgatgtgctcttctaggcttaacagtaaggaccattttggagttaaaattgtgtggattagttctgtgttaaacatgtcttcatctcatttatgtattgtattaaactctttggggaaacagataaaaaggacattttaggctttacaaacacgctacacaccataaaatgtttgtttcagcccattgcttactccaaagcaatggccttttgcttgaagataatctcaataatagaaaacagttaccaaaggaactaggttttgggtggacgacttagccctccacaagggactgcagaatcctggtatttgaactggcagggtgtttggtttctttttttttttttcttttttttttttggcttgtttgttttcgtttgtcagaatatggccccagtttggtttaagttttgaatgttcaggaatttctcagagcagacaggggtccataagggcttagtagtgcttctactgtgcaaacagtgatttcttttttctccaaaaattaatttggcgtaagtgtgatcatggctgcttgacatttttttgttttgagatgggagagcataaaccacattcaaaggaaaaattagagcctatgtattagaatatttaaactgcttaatgtagagcaaaggaaaatgtcacaattggatgctgttgtgttctaagcaagcaatgcttctctggatttggatacttgagaaatcctttatttagaagtcattcatattcatctttaatacagcaactgtgaatatcattagccagaagcaataaattttgtgaaaattatttggcaattgagaaggtagggtagccagttgaagtcctgtgggcccaaggaggaacttggcagtgagttattgtcaaaagctgcgagtgccaggagtcagcccaaggagagttctgtgggaatcagaggagtgtggggccagttgagtccttatattatttattcctgcaagcatgacagattgattattacggatctgaaaaatcacttgcatgggtcttctcattctttttcacccctcttttctttctttttgggagtggataagacttaaaaaccacatacctcaggatacattgccgaatcaaaatttttctgatggtcgcagacttccgtgtctagaaagctgctagctttctactatttaaaatacaaattttgggatatggcaagcctcaccatttcttcactgtatgtagtactgcttgctgggcagcagacagtaaatattaagtaagctcttcaaaatcagtttcattccatcagagcatggtgacatttttttcccctgcttttaatctctaaggtgcaaattttgagggatgttaagtaattttaaaaatttatctactgtctttgtgtttgctgtgagatatctttctggagatagaaaattaagtgaggcgtgttgttctgaaatctgggtgccagtaattcttgcatcgtagggagctgtgccttgcactgtgtatacatgtcaaatctgaacatctcacctcgaaagaagtttgccaaaaggtaaaaagcacttcccaaacaatcctacggttttgagtaaggagtactcaaagaaagaaagggactgttttcagatgtttcataaatggtaatcaatcactaataattaactaggtacttgaccatgcaggtatgctcccagcacagtgcgatagcagcttagaatttgagattgaacttttaccctggttatctttagaatactgtttctctttcatttatgtgaataaacatgtattttgcatgttactgtaaacatttatatatccttatacctttgcagtttaccaagaaaggcttataaaattgtgataaagatttctagtgaattattttcttacagctcttatgcaaggaattcaagatttttgtattatcctgagtcatagatataagtggtttgataggttataagctatcttgacactgttctgcatttataaattcagccattctgcaaatgtttctggagcacctgctgcacacagacaccaaggacacaccagcgactaagtcagttgtggtccctacttttgagggagtgttgaagtctattcaattaaaagccaaatcatggcggggcgcggtggctcatgcctgtaatcccagcactttgggaggccgaggcaggcagatcacaaggtcaggagtttgaaaccatcctagccaacttggtgaaaccccgtctctactaaaaatacaaaaatcaggtggacgtggtggcgcatgcctgtcatcccagctactcaggaggctgaggcaggagaattgcttgaatgcaggaggcggaggttgcagtgagccgagatcaggccattgcactccagcctgagcagcagagtgagactccatctcaaaaaaaataaaataaaataaataataataataataataataataataataataataataataaattcagagatggagaaaactttgggaggcagggtgagcatctgaacctatttgaatgtagatataactaatgccaagcaagggaattatggggacaggacagaatgtcaaagttatacacctagaaactataaaaatagtgtaacagagccaaagtctggaggcagagagaggaaaagtaagagaaggtataagcatgctggtgtccacatctttgatagtagatttaactgattctgtctaaaacaaaagcattgttcaaaaaaattgcttcagctttttaaatattttcaccatctcttaatctgaaatttcattaattttattttgttagagtcaagaaaaattatatcagaagtgaaaatagcatgtggaacatgttcccattttcataaagattacttgtcatccatccttgttcatagaaagatggctagaatggtttttgcttagtgttaatgatattatttctgtgtgttggcatttgagttgatttatttttacatttgtctttctactctgcattgcataaattctctatttctttttttaaaaaagaagcataatatgccaagatgtttaaagtagataattttggatgttgagaacctgaataatttttttttttgtagttttaatttccaaaattaggggagagggagcatcttgtttggtttaccgtgctgaccataggttatatgtcattttatgcatataagtttaagtaatttaagtaccaagttactactagtacttgatttcctaagttgctgggaatatacactgtgggctgttcataatttttggtacttaatccatttcctctctgccatgcttagctttttctctatcactttcttccccccttgtctattctggggccatatcactctttgttatccatcactgaatggcctaacttcctttcaaacagagtttccctcatttggttggttttcggttttcatggaaagctattgaagtggtgtaagtgagtatggggtaggggaagctggttttgttatgatcaggtttagaagttcatttggcctgctgtgcagagaccggattggagggagactggagtgagtgagactataccagttgggtactgctgaacagccatccctgaaagtgatggcgacttggacggaggaggtggggaggtggacttaagaggctgtacttgaaaaatggactagacttagtggaagattagatataaagggggggttgaaggacagggagtatccagggtgacttgtaggttctgagcttgcacaataggatggatggcaatccatttgctgagataaggcatgatggaagaggaacttgatgtttgtttatgtctgaatcatctgaatcatgaggctggaccaggtgaccttgggcttcattttaaaattgatagcaccatgatgcctaccattgtatgttttcagtgagggctcatgagtgggtgtcttgggccccatccctccctaacttagaggaaaaaaaaaattgtcagcagcattttctggggagaggttccttccatatttttcattaggctttccaggggggccttggctcaagaaaaattaagaaccactgactaagtatgttcagtcacagtgaccattcaataaataattgtcataggctcgtaaagcagaagaacagtatcgatgaatggaaatttcctattcggcattttagaagggagtttgaagtgctcctaggagccattttcccagcatggtcttttctgaccacctaagaccaaaatgatcattcagtctcttaattcctttagcggtaattgtgcatgtactatttcttggctttatttttatgtttttttgactatgctgtttagcttttccaatagaaacagctagctgtgccgggcgctgtggctcacgcctgtaatcccagcactttgggaggctgaggcgggcagatagcttgagctcaggagcttgagatcaggctggccaacatggtgaaacccatctgtaccaaaaacaaaaaacaaacaacaacaacaacaacaaaaaaacagttagttgttattagcctatccccatgctggctaagttacataatcatccctgtaaagttagtgttggcatccttattttagagatgaggaaactgaggcttagaaatgtaagtaaatggtagctagtaagtggcagaactgtgatttgaatcaaggctctttgactccagagctttctttttgtcacagatattgacaagtcctgctggttggcagaagtcatacctatactctacttttatttattttgagatggagtcccactctgtcacccaggctggggtgcacttgcgcgatctcggctcactgcaacttccacctcctgggttcgagtgattctcctgcctcagtctcccaagtagctgggaatgcaggcacgtgccgccacacctcatgcctgtactttgtatcacacattgtgcattcagatttttactgaaagaacgaatatacctattgcagtatgatcaagcctgttttatgtaatgcccctgcatatgctcagaatcaaggattaccctttttatttttctcatttgtctcctatttcttttgcaaactaaataccctttcccccgcaccctctattgctggattttcttaggaactcttataccttatcttgctttggaaatagcaaaatacacaggattacagaattgttatcaattcacacatttgagatttatatgttaccaccattacttcctacaccagttttctagctacttttgtgtgtgtgtgtgtgtatttaaattgtgattgaattagaaaaccttgttaggaagttgaatttctgaagcaatcatttatgttcagcctgtgtaactaatggacaattatctttcagtttcctctggaatcttgctttaatgactttcagagtagtgtttatatatgccatcacttgcctaattagttttataaggaaatccgtgtcatcccgggtcatcctgccaatagaggcagcttccagttctcttgagcctcccgagggatgcattcccttcacaaagtgctggaagctggctttcctggagctccagggtcagggaccattttcctttttttatcatggaaatgaaaaagtcagtgtcagggaggtggctgactgtacgacagtcctgattattgacttatttctcttaccttaaaacttgagttatttcatcgtaaaattgcaggcaggaaaaatatatagaagcagtagccttcagattgaggatgaagaaatctctctgaacttcaaggaaatttggaaatgagcaaaaattttgaaaacatttgaaaatggaatttatagccctaataaaaaatgcagttaggtgtatcaacattttgattcctagaccaagcacagtgcctggcatataatagatggctaattaatttcattgaacgaatacctaagtagatgatggatgaatgccactggaacataatgtccatgagggcagtgttgctgatatttctagcatcatctggaaggtgctcagtaactacattctgagtgaatgactgagtgccagtaaaagataagctattgcgttatctttttttgctttttttttttttttgagatggagtttcactctgtcactcaagctggagtgcgcacgtggcactatctcagctcactgcaacttccacctcctgggttcaggcgattctcctgcctcaacctctcgagtagctgggactacaggcacgtgccaccacgcctggctaatttttttgtgtttttagtagagacagggtttcaccgtgttagctaggatggtctcgatctcctgacctagtgatctgcccaccttggcctcccaaagtgctaagattacaggcctgagccaccacgccctgctgagatatcttttttaaattaaaaaaaaaaaattagagacagagtcttgctatattgcccgggatggacttttgaactcttgggctcaagcttcttgcttcagcctcccaagtggttggttttacaggtttgcgccactgtgcctggctgttgggtggattttagtatgaaaactacagatcctaagagatgatccctgggcatatcaacaaagtatatgttttaaaaagccaagcttattagaaatattatgtcctatgatactggaaatccatttttatttgaaaatattaaatagagttgacatgttgaattttttagtatagattaaggcactagttcttaggatggcttttggtgcagtgactcacgcttgtaatcccagcactttgggaggccgaggcaagcagatcacttgaggtcaggagttcgagaccagccctggccaacatggttaaaccccatctctactaaaaatacaaaaaattagctgggcgtggtggctcacacctgtaatcccagctactccagaggctgaggcaggagaatcacttgaacgcgggaggcggaggttgcagggagccaagatcatgccactgcactccagcctgggtgacagagcaagactccatctaaaaaaaaaaaaaaaattattggggactctaaagagttttatttacatagattttatctactgatattggtcatattagaaatttaagatgagagattttaaagatttattaattgatttaaaatagtaatagtaatccctttatacagttacacaaactacataattttatgaaaaaggacattttccctaacaaaaaaaatttagtgggaagagtggtgttttacatccctcttctgtctgacttaaataaaacatagttggactctcagctgcttctgcttcaatctgttgtgatatgttttggttgaagtgtatgtctaacacatatatgtaattgaaaaaaggagggaatattttaatagctttttcacgtaactggagatattctttgatacttttgatagtggtcgttggcaagtaagtttctcaaaggttggttgcaaggtagagaatgaaaccgtgtctgtgtttcatattggtccatcttatgtgttgaatggctcttttatgtgttggtgtgaccgcattctttagtttggaaaacactatttcattgagttctgcaggttcttctaaatgttgacacatttcattattcaacatcaaaaaagtcacaattattagtatcaccatcagtctcatcaaagagcctttaagtattattaggaagccgtcaagctgacggtagatgcacattttctaagattgtgtttttcacttggaaaactttattgtatttcaaaaaagtatctgccaaatatccaagtctaagcaaccatattgtagttgttcttttgagtcaaagtggtgtttcatggagagagtggctgctcagctcaagacagccctcatccctggagtgtagccaaatgctttatgtgtcagaatatttactcagaattctgaacctttttttttttttttttttgagacaaagtcttgctctgtgcccaggctggagtgcagtggcccagtcttagctcactgcaacctccacctcctgggttcaagcgattctactgcctcagacttatgagtagctgggattacaggcacacgccaccacgcccggctaatttttatagttttagtagagatggggtttcaccatgtttgccaggctggtctccaactcctggcctcatgtgatccacctgccttggcctcgtaaagtgctgtgattataggtgtgagccaccatgcctggcccagaatcaataattgttaatgcttcatcgagactttcttaaatgaaactggcataaaagacaacaaaaagcccctgggatttcatggtgggaagaacataattcctgctagtaccgcctggcactgtcaccttgactcaggctaaggttcctgctgtcacaccaccattgctcttgcaccatcagtgcaaacgtcaacacaaggaaaaaggcaaatagtggctcagtattatcattaaagtggtttgatcatgaggacccttaagggtttgtggagcatactttgaggcacactttgatttaagaggttagaaacatcacattaaaattcatactaataaagtgaaattgtgccaattgcccaaaacagtgcatcaatccaaaactcttatttgtcttggagaaatgcattcaaaacatagtcaacaccactatctcattttgtctctgtgttgtgttaagatgggtttgcatactttcagcctcttagagcaggcagttggaacattatccagcagcaggttgaacagcagagggggagggcagctggaagttaggctaatctaacaaatgagtcatccacatgtggataatggagttgtaaaattactctcagctttagtcagcagcaaccaaactatacggttaaaaattacaggtctccaaaatagagacttcctgagaacttttagtatagcatttaactgagaatgtatcaagggtttggttgaggattttttcataaaacctttctgttctggaaggcaagtttgttattaagagcttcagtaatttctcttacgaagtgttcaaaatgcaccagaacctgaacacaatgtgagcagctgagtgttcatcttagctgcgtccatcaagtgaacggtttgctctcttcctgtccataatttgagagtcagcctaatggtgagtggacagtcatctaataaaatatttcatacctgtggcagcaggtataaagcaaatagtttatttttgctttccatgtaaagtttggcagtaaagtttttgtcttgagatttttgttttataagagaaattaaaattccttctgggcttttgctgttctcccctgaggatgaatatgctgcctgcctaccctgctaccccccgcatttggcaaggttgcacatgtcttagggatggaaaaccagtagccaacactaaaccaggcctgctgtgtagacctggcttggtgagtatggagctgttccgcagtagaggtttgcaaagaaaccatcacacccttgtttcctctctccttctggcttttcatttttcttctggccttttgcatggaagaaataagtcatcccttttgaacagtttgggtatggagtgtttgcccatgcggtagactctggcaggacagagagggttttcccgggcctttagttgtccaggtcctgtattctcacatctcctctgggctgctgactgcgcacaaacacaaaattcattcctccaatagaacagtgtttggcctggctcccaaaaactgctctcctcacttgcacggctttgattgagtgttaggtgtctctttggctgcctccagtgtctcttatttttagggccttcgttaatgtcttctgtgtgtgaaacatgaaaatggagccatggctgctggaattggaaacttagggtttttaggccaccattcccttatcacatggcgttatcaggttatttagttacagaggttaaaaaaaaagtccaccctaggagccggcgtgtgtggggaaaggagagagggggcagctgagcacctaatgggcagtgaaaaaagatattgtaactaaagctcgggctagtgtcctcagagcgatggcctttcaggtgctggcaggggtctgcttacagctcagcctggttacaaatgaggggataaattggtggtaacagtgcctttttatttttttcctttttcctttggaaactggcttttcacatgttggaaaacgagcttggatgctcggtgtaggtaacaggcaattctgatctgagaggaagggctcaggaaaggtgtgaccaaatgagccgtctgagtggtcagtcctgcccggggctcacccaggcagggagctggggtctttcatgtgggtgtccgtggacccacaggagacagggagggattgattacaggggagaccacttctgtttccctttcctaaaggaaacagaaaatggaaataaaaatctaaaattatgttattttccatttttggaattctgttcatttgtgtttggggccagttttattattttttttaatcttttttgagacaggatcttactctctcacccaggctgcagtgcagtggcaccgtcgtggctcactgcacccttgacctcccaggcttaagcgatcctcccacctcagcctcccaagtagctgggactataggtgcacacaaccacacctggctaatttttttttccccttggtagagatggggttttgctgtgttgcccaggctggccttgaactcctgggctcaagcaatctgcttgccttggcctcccaaactgctgggattacagacgtgaggcaccgtgactagcctgggaccagtttttgacggtccctagccttccatgagcattcgtgtgcaaatgcacagtccagaggcatgtttagttgactctggtttcctccctccctttcaatgtgtggaactcgcagcgttctttctctgcattgctgcgatctgccacacttctcgttttatcatggactgcagtacaatgtaattgtctgtgtgccagtttcctctgtcttactaaagtgtgaatgtttgatggaagaaactctgagtggacagggtctgtcataatcaccccagtattccccatcgtgtggtgctgagcttggtatgtagtggggagtgggtatgcagtgaatgtggaatgggtggatgcttgaatgagtacagccgaatttcctggccaggaaaaccatgaagtgttagcactgttctgattttacttcctccttcaggctatgggcgcgtgccaactgacagggcagggactgccatggctagtggctattacctaaactccagcccagttttggtgcccccgtttctgagtcctgagcaagtgttcctggcattgtgttggttcctatggtatgtgttttagtctgtgagactctttcctcagtttgaagatctgaaagtaaaatgtttcacccaaggtttttagattcgagagctcatcccgtaggccagggagagtgagtactaataccctatatgtggctgtgtttagaaagggctattgggaaacataaaaaatagattttgacattggaaacaaatacattttagtatgtgctgctaaagaaatgtgtgctataagctattctcctggggttataaatcattaaatattaactttttaaacgattaaacatgtgactatatcttattggttacaaataataaatgcctactcaaaccagcgtaaaccataaaagtagaatttgtataaggattcacagggtggtttatggggagaagggcaggaaatgctgccaggctacaagggagtctggaaccaggactagggcaataccaggagccaaggcactgctctttcaccccgagaaccctgggactcacccgtgcttctctcccagtatcagattcgttctctgtggcagtggttgggcttcctccacttccctgctcttagggtctaaactggcagtgtcacgtcgtgagcatacctctgccttcaagttcaaatgcagacagacacaagtctctgtttaaattcctgaggaagaatttggttggcccaatgtggtcagctgtctacccaagtccaatgaactctgctcatgggaatggggctggggaataaatgtggcttagagggctgacgtgagatcccagagtctggaagctatttcaaggttctggaaatagtctagtagggctacaaaactcagagcaagccatagggtccggacagtaccctatttcctttatttctaattattttctgctctgccttttgagggaactcatcagtgtcttcctgaggcctggaggcttttctgtgatcatgaaatgtactatctgaggcctggaggcttttctgtgaccatgaaatgaactatcaagagcagggcatgggctctgcagacagcccaggagttctctgctgcagggctaagtgataattctgctgaggcggttgacattcttctggttagctttagggcagatgaaagggaaagaatatcaggagaaaaaagagcatcttgaatttgtggtgttttttgaggttttttttttttttttttttttttgagatggagtctctctctgttgccaggctggagtgcagtggcgcaatctcagctcactgcaacctccgtctcctgggttcaagtgattctcctgcctcagcctcccgagtagctgggactacaggtgcgtgccaccacactcagctaatttttgtatttttggtagagacggggtttcaccatgttgaccaggctggtcttgaactcctgaccttgtgatccgcccgcctctaccttccaaagtgctgggattacaggaatgagccaccgtgcccggcctgagttgtattattttagggtttggggaggagggaagtggcgaagaatggtatatgaagggtgttcttgatttttcagagatgaaataattttatccagccatttatatttctatgtatttcttcggtatctgtttttaatatcctgttagacgttttagtctgtcaagagttattgctaattgtcaaccaactacctggttgcaatgaagataggttctttttatgccatgcactccagagatctactacacagctgggtggctatgatttgcattaaactaataaagtcccctggttaaaggggtatgtcctagatttaacatttgaaatcctttccattaagtgcagcacaagcagatctttctgcacattttggtgaagcttaaccatttttgatgactcattttgatcctaatctttaatttttctgattgcttttggtaaccttctatttgggctgtgtgccgaattttatgataggtatcctttagacggcagatataatcaggtgatttgattcagaaaaggagtttgctttcccttccgacttctgttttgaaagcaccaaggcactgggcatggtgactcatacctgtaatcccagcactttgggaggctgaggcgggtggatcacctgaggtgaagagttcaagaccagcctggccaacatggtgaaaccccgtctctactaagaatacaaaaattagccgggtgtggtggcctgctcctgtaatcccagctattcaggaggctgaggcgggagaattgcttgaacccgggaggcggaggttgcagtgagccaagatcgggccattgcactccagcctgggcgacagagcaagactctttctcaaagaaagcaccaaagaattcccccaatagaaacagtgtgtagaaaataatttggaaatgaaggaattaagatggtctgagatttttgtggcttgctctgtgttttatagccctggtgggctgcaaacaggtatcttgcttcagctctcagagcagcctcagtcactgggaactttttttttttcacggatgctgctttctcagcttctagaattgcctccttagtcctgagttagaatgtcagagacaggttttatgctactttgctggcaaggatcaccatcgcacacgtcatgtagtttatcttgaaattttatgatttgggaatcagattccttcaaataagtttgtgtcatctgttttgttgagagagctcgtggctaggatcgcagacgcgaacattgtttcttcctgaattgtgtccttgagttggttggtgtgtatctccagagtccattgtttcttttgcagaatgaaggaattggtctgcagtgatctcaaagataattccaacccagcacaccaggactcaaacttaagaaagaattatttttgttatgagtcatgtacatttagggttcttaccagacagaataattaaatacatgcagctctgctccatgcaggcaggctctgggtcctcacctctgcatacaggatgctgagcatggtagtggtttaatcaatactgttggtggtgtaaatggatgaatggtggccattctgaaacggctttgtaggatctaagctgtgttgggagccaatgtaagtctggtctctgtcatttggagtatattttgaaaatagaagattaaaacccctcttcatttaagttgccgtctaaggtcctggaccagccttggttcacccaggttttttcctctgcaggacattggctcacagaaaacagggctgcccccttttcctgcatatttggcctcggactgcctacttgactaatcagtttaagctcttccctcttaggccattaatcctatttctccagccgagaagcagcaggataatagtaatgtgtcctgtagctattaaaagatgatattgccttgcacataaataaagtacttttttttcctctgcaaaaggatgatcaaacaaatttaattttcatttatgcttttgcctttttgtgatatttctttgtatcttctagtacaatcaggggagaacatcatttttactgttattgatggttattttctacttgttttcagcatcctaacaaggtatttgctttcctatacatcgttacattttgtcatcctatgatgaactctcgttgctcgagggggcgaaaacagagtgaacgtggaaatgatctttggcatgtggtattttctgaaaaactgaatttcacaataagcacatttcgtggcatttgctaacaataatctccacattcctagaggtcagattttctcattgaacacatttttttttcttttcagtttatatatgcagaaagggcttcattaaaactgagatcattctcattcaatcttaagctggcagccaacccagatccttttaatccctgctgtatgtgctaatgaaaactcagggaagtgctgatgaaagggaggtggtgaggctccttcctctccttgcctggagacttaacctgtacatttctaggcttttcagagttaagttttgcacctgcttgtgcagtggtgatggagctcctgaggtatttctgcatttgcttcctgggtcttgaatttccaccattaaatttcagtctagtggcgggtgcatgggtgtgtgttacatcattctgagtttttttgtacatccaaaataattttgtcatcaccatgatcgtggctgccatcatcatttcgacttttgagagtcagtttatcctctcacccagcaaatctgcttttgagaattggccctaagcaagtaatcttgaatatggaggaagatttttgcacaatgaacctgcccattgctggtttattcataacagcaaaaacattggaaacatccttttccagttttgggggaaatgattcagtgatgattggtactgtatattcaagtaatagaatattaagtatcctttcaaatcattgcttaggataaatatggaaaaatgctcttgaaaatataccttcccaattataggaaagatagtaaattatattcacagtatgattaaagtgatgttttttttgagatggagttttgctcttgtcgcccgggctggagtgcaatggcatgatctccgctcactgcaacctccgcctcctgggttcaagtgattctcctgcctcagcctcccgagtagctgggatttcaggcacgtgccaccaagtccagctaatttttgtatttttagtagaggtggggttttgccatgttggccaagctggtctcaaactcctgatctcaggtgacccacccacctcagcctcccaaagtgctgggattataggcattagccaccacgcccatcggtgattttttttaaatctagtttttaaaatacctgaacagtgatggtgtaaaggacaagatgatagaagacttttttcttttcattttcttgattttctttatcatccacttttttaaaagacaccaacattatttgcataacaaaacaccatataggccggcacggtggctcacgcctgtaatcccagcactttgggaggccaaggcaggcagatcacaaggtcaggagatcgaggccatcctagctaacatggtgaaaccccatctctactaaaaatacaaaaaattagccgggcgtggtgtcgggtgcctgtagtcccagctactcgggaggctgacgcttgaacccaggaggcggaggttgcagtgagctgagatcgtgccactgcactccaacctgggtgacagagtgagactccgtctcaaaaaaacaaaaacaaaaacaaaacaaacaaaacaccatacagatggatatctaaaagtgaatgagacttgaaaatcagccagaaatgtttgctgtggtgataaacataacccttaaaatgattttttaaatatttttttaaaaaatagggtcttactccaatttcccagcctggagtgctactggagtggtgtgatttcagctcactgcagcctccacctcttgggctcaggtgattctcccaccttagcctcctgagtcgctgagactacagccacaccaccatgccctgctatttattgattttttacttttgggagagacggagttttgccatgttgcccatgctggtcttgaactcctgggctcaagtgatccacttgcctcagcctcccaaagtgctggggattataggcgtgagccaccacgcccagccaaaatgaattctttggggtccagaaatcttgtcttttgcaaagatagtttgatggggcagggttgctgggaaatgagggtcccaggctaacagttctctcaaatgtgcttcatggctcctgagtgccagctctgagtcatgggtataggaactggtggaaggagacagagagagagggtgctgaagctgggtggtgggggagggcactagaggcagctgtggtctaagtcacacttgggtcttgcatctggctttctgcttttattactattatactttttaatggcaatgagctgtagatacaaagccagctttgagttgttaagaataatgaggtctgtcctgacagtacaggcagcagaggcataagcaaataaatcccaatgtattataatatgcaattttatatttagacttcgaatgcattatgatcattataaaaaatgtctatttctaattctgttaaggaagatggtatagcagtaggggctttggaattacaacagggttgaatactggcgctacttgttagctgtggtttttggataagtaatttaacttttcctggcagagttttctcgtttataaaatagaaataatactacctttctcataggagtttgtgcttattaaatgagaggtaatgtatgtgtgattcatggtgtatgtttggtagatgatgattatcatgaataactagtaaagtaagtaatgtgatttaagttatgttattagaagtcccactgaatgccgtgtcaataggaacacagactcatactagtttggaagggaaatctggctcggattctaaacggtaccttggaagtgcagatggacaacagaatgattggagatgagtgccttggtaagccagttctttctggtgaacttggaagcagagaaaagagtaacaaaaattatggaatttaattatattaattagaattatatgatgattataatagaattgccttttgttctggagttaacattttataactttataattagatctcttgaacatttgaaaagttcaataagtacttgtttgtgtcatattagtctattctaattgatacacatgcacatagagcacaattttttttttttaagcccaaaaagtttattagcgttgggatgggatttgacgcactgaggttttccctggacaagattcttaccttctttgagggctgagtttaaatagttattcccaggagggcagaggaactcttccgttgtaattgaataataagtgtcattcttgggtaccagataaacttaactgatcacttaattgatgctttgaatggctgcataatgtgtaagtccttagaagccagagatgagatttgttcatattttgcccttctagtacctagaaggtactttgcacatggtaatgaatacatgtgtgaattaatagatggtaatctattacactctacccatttcctttctcaaagattcaagcctaaggctaacatgatattgagaagaagaaacgtaactaccttgctgttgacagtgtagcagcaaatgtaataatgtgtggaacttcagggtttcttgttcattcggtggtcagcatacaaaacatgcgtcagtaccttttttcttgtcctcttaaaattttatttctttacccccagagtgatgttggcacatttgctctgctgaaatgatttcaagagctcttcattgctgattcatttaatgattactgtccaaatggccccactcccacaaggaaaagtgtctccacattaacaagcactttcttctgcttgatttctatggttacatacgttgtgtcactttgaggagttggaaataaatttaacaggatattaggatgagagtacctttaaaaaaaagttctgctaaggaagtgtttcatcctggtgaataatgaaatcaggttaaaatttgtcttaaattaataatgactttcgacgtagtccttgttctcacatttcatgggctgattgcttttttattttagctgaggtcatgttaaaaccaaaataaagttatttgaaaatctagtgcaaaattttatttttctatcaatttgtgattcccagagcaaatttggggagagccaagtaaattaaaaagtgaatttaggtgatgttaagtctaagatagccctcaataaagatcttctcagaaaattcttgagtggcaccaacttttgtcactaatagcccacagacacgcgtcactttaattctttgaaaacctacactcaacagaaatgataaacttataaatgattttgcaatctgctgccggtttcttaaaaaaaattatcagtttcttagtttattctgaactggatttgatacacagaaaactggttttcctgcctgcttaggaatatatcacatcatgtaataagcctctcagagatgtagcattgagcagattaaggcctcatttatagaagaattccaccctggccatgtgggcctgaaactctggagggctttaacaatgtcttgaggtcattgtcatttaaagagatgactcagtggttttatttagtagaaataaatactaaataaataatctccacagattatccagaggggtaagttgaaggatgttgacagataactcagtaaattgcgtctcaaatattaataagtttattctatgccagcaccaaaaatatttcagagatgcttttaggcttctctcaagtatgtcgggaacagaaaaggattatagaaatatttatagtaggcataaacttgcacaaaagctcaaagtaccttaagcaagcttgttgcaattattcttttggagaactggattaagtaattatttcttgttgcctctgactatttaacctcctactaaactgcccattgtttaaatgtctcttatttagctctgtttttatcactccttaaatttaatattctcaaggccaaaattatagcagtgatggtcaggacatctttgaagacaattagattctgagaggataatttatatgtagaattaggaatattcatatcactcagaagtatcataaaaaccattctttcacaataacttttccactcaaacatcgccgaacttgattaccaagaccctaactgtatttcacttctttgcagtatttgaagttggagggaagggcttccacagctgaagagtttggctaaaccatgggaccctttcacattggctgagggggtgacagtgggtattgatccaagccagcccgcccttacttggttggaactctgttttagtacttgggggtgacaggggaaaggcctggagagcatcagtcctccatgagtcttagctgctccacgagaaaaatactcactgttttctcataggcattgccacagtattctctgacgagtgtttagcaggcatggcctggtctgggaaagtcctctattccttggccctgcctggaagttgtggtgcggggaggccatggattggaagaaaccctaaggtggatatccgaagggctcttaaatgttgcttgtggcagctgggaacagggatactaatgaggaaggacaagctcttcgatttcaggtggttcaggagcctcaggcaggagtcagatttaagggataagtggttcctattttcagtatctctcctccacaggtctttatggaaaatcttaaaacccactcttgtcatccgaactggataatgcaggttcttggcccttccagtgctacattgaaccaagggttcagaaacaattgagcggtgggtggtcagttccaaagtggcgcttagaggaagtctcgaagtgaagagggaggtttagggaatgagtttggagtcgtgttttcatttcttttggttgaaggaatttaagagtatcgtctttatctggttttatgtattgcttttctttttgtttggggtaggtgattaaaaatagaaaagtggggaaagagacaaatttagccttcaacaagctctcggtgatctgtgaccatattgttttcactgaagattatttacaacatgatgcggccttggttgctgctgagctggcttcagggcagtagataggaaggatgtttccaaggaaaactactctgaatgaacttgtccttgggtatgtgagtaactgatatcaaccaaaccaaatgtcaataagtcattcattgtgaatcatcctttttcggtcttgacactgcacgtaccagatcagttgatctctctcctttgtaagtctttcaaaagacgcatacattagattttttttttttttaggacagggtctcgctctgttgcccaggctggagtgcagtggtgtgaccctggctcactgttacctccgcttcctgggttcaagcaattctcctgcctcagtctctcgagtagctgggattacaggcacccgccaccacgcctggctaatttttgtattttagtagagatgaggtttcaccatattggccaggctgatcttgaactcctgacctcaagtgatccatccgcctcggcctcccaaaatgctaggattataggtgtgagccactgcgccagcccatacattggattttattttcctccaacagcgtggactctacccagtcttcctggttctggttttccaatagttttcttttcttgaaggtggtcactgtttcttaaatgtttatagatttactttagctttccattaagaaatcaagtaaatcagatgtacttgtcctaatgtagtaatatagataataaaattgttagtggttaatatttcctgaacatgttctctgcgtcaggcaccaatctaagtgggacttggctcagtttccacaaagccccatggaatctggtttacagagaacaatgtgagagtgtctgtttccccacagccttgctatagaggccatggtatcatctagtgacaattttcatcacctgctctattaagccacttgcgtgttctagaaggggttgagctctttctttctttctttctttcttttttgatacggagtttcgctcttgttgcccaggccagagtgcagtggcaccatcttgtctcactgcaacctctgcctcccgggttcaagcgattctcctgcctcagtctcctgagtagctggaattacaggcatgcgccaccacactggagtaactttttgtatttttagtagagactgggtttcatcatgttggccagactggtcttgaactccagacctcaggtgatccacccaccttggcctctcaaagtgcaggggattacaggcatgagccaccaccatgcccagctgggttgagctctttctcacctgtaccttttagtgccacttcctctgagcagactctcccactctttagccttcctgatgcctcttggctctccaggctgggtgtcatctgtcctctgctcaattgtcccacgatttccaatgttcaatgttataattgcctggtggttgttggatgccttcactggatcctgagctccttaaggttgagataagtctcacttttgtgtctcatgggcctgggacacaggagataacaggtgaagtctgttgatcttacctgatggggaaatgtattttttctgtctccctcaactagtgaggtgccttgcaggtttttttttttttttcctctttgttttttaattttttgagacagagtctcagtctatatagcccaggctggagtgcagtcgtgcgatcttggctcactgcgacctctgcctcccaggttcaagcaattcttatgcctcagtcagccgagtagttgggattacaggcatgtgccgccatgccaggctaatttttgtattttagtagagatgggattttgccatgttgtccaggctggtctcaaactcctggcctcaggggatccacccgcctcagcctcccgaagtgttgagattacaggtgtgagccactgtgcctggctgccttgcgggcttttaggcacctcaatgtctagttttgtcagaatagcatcctagaggtcttagaaatcttacctgttggagaaagttttaaagtgccccaaacatcccagcagttgtacatcctttcactcacactaaaattcatcctgttttgctttcacaggtatgtacattttgatgaaaagacactgcaaagatgagcaccagctagccaaattgtgtagtaaacattgcatgtctatctgtgtgtgttttattgttttgttattttatttagtcaacccttttgttattttaccataagttcatttacacagggtaatcttctcccattacagttgcatggaaggaatcttagaggaaacagttactgattttcttagtgtgagaccagaaaaatgaagcgttggtattggccttggggatttgctgtcctttatcctcggtaaagcaaaccagccatccgaatgtaaaggcagctcctttctttccataagtaataagtcatgatttcttaatgaggcaaattatctatcatttagtgaattcatagtatttgttacaagtaaattcattaagaaagagcgctattccaataaagccaatttaattacgcagacaattaaggggcatcttccatgtgctctgcactgtgctagccacggggtggatatagaaatggacaaactagggatgggcttatttatttatttatttgtttgttttgagacggagtctcaccctgtcacccaggctggagtgcagtggcacgatcttggctcactgcaacctctgcctcccgggttcaaacgattcttctgcctcagcctcccgagtacctgggactacaggcgcgtgccaccatgcctggctaatttttgtatttttagtagagatggggtttcagcatattggccaggctggtctgaaactcctgaccttgtgatctgcctgccttggcctcccaaattgctgggattacaggcatgagtcaccgtgcctggcctggaatgggctttttaaaggagattatagccaagggcagtggtgtgcacctgtagtcccagctactcaggaggctgaggcaggaggatcacttgagctcaggagcactgagctgtagtgcactgtgccagttgagtgcactaagtttggcatcaatatggtgacctcccaggagtcggggaccaccaggttgcctgagggaggtgtgaacctacccaggtcagaactggagcagatcaagactcccatgctgatcagtagtgggatctcacctgtgaatagccactgcactccagcctgaccaacatagaccccatctcaatcaatcagtaaattcatttattcattcataggaatcacagacaagggagtcacttaccataaaaaatatacaaaataaatgactccagaggcataaaaccaaaggggttttgtgccaaaaaataggaatcaaggaagtaacatttgaatttgatcttagggaatggatgtaccttaaacaagtagccctgtatggagaagaggagagagggaacgataatgaagaacagagacgtggaggccggaagatgccagctctaccagaaaaagtagcaaaagtcaatgtgattgaagtagggggagtgcgggagcagggagggtgtgattgatgcctggcagctgcccgtaacgtatgatgcagtatggttttcgcctgatttggggtttccagttctccctggctgctgacggggctccctcaggcacacattaatggattcactcagccagtgatttttctgttttctctttcatttccacttttctatcccatcatggttttctgcataaccccatctgattttagaccaattttgatgtgatttttttcttctacgtgagtggctcagtgaaggctttcgaatactattttcccacttgcatactgtttcagaactgaagaaggtaaaatctaattgtaccaggtttttgaaaagcagtagtttccattgtatgtgtttaaaaagtccccaaaggtctatctgtaagaatctttgaaaagacacattgcagcccaaaccttaggagaaaagaaaaaggggacttcacattgtaaaagcagcatttatctttgcatcttgaagttcctagaataggctctcgcctttataagtggagttttcttgtggcttttgtggggagaattcactagaattagggcagattttctggaaagtcccgaaattcagtgttctgttggatttctggcatctattgagcaagacagttgggataatgagtcttggtattaaatgtattctacgggagggaggagagagaagtgggaggaaggtgtatccgtcttgctggcttcctgcagcttaagtaggaggaagaaaaggagagggtgtgagtagatgacccaagccctggactaagccctttaggtacatgatctcatttaatccccttttcagaggaaactgcctgagatatgtttgacccaggctttgtgctcttagccactaaatggcttccctttactgatgattttactctgcctttatcctatagttacttataggcagctatatttacttcctccaaatagattaactctttgtatactctttggtacctggaataagtcctgtgtaatcctaaacgctcaataaatatttcttaaaatgaagataattctccttgacagaaaattgatcttactgagcatatatccactgagaaaacagacgtatgaatgtttaatactccctgattatcgtatgctttcttatttaagcagaagtattaaacgcatgccaaaggctcacataaatgatttattatgcaccaattaacgttatctgagccatggtttttctttgttgttatgaattgagcattgacagcaaggcagcactcatttaccttttgtttctatgcagaaaacatttcaaataggcaactgttgtctctcctgagtagtctgagaaatgtgaatggagacatttgtattaggtgtccatctcgtgaccaatatgctttgtacttttgaagtttgctttatccttaagattgtgagaactgtaaatctgccactggaaccatccctgcagattgtcataatgtgatcagctctaaaaagcttcctgctttttagagtgtgtacccttaaggataacaatcatatagataaccttttagatgtcaacacaggcgatctttttatgtgttttattcatgatgcaatttacagtacttaaaggaaaaaaaatccagaagccttacaaggtctttaataagtacaaatatagattgctataggtagaaagtatgctttaaagcaaacttttttacaccattttctgaggcttttattaattactctgttttccagcgaggctttttcatagggatatgcacctgactaacttattaaaagtaaattgcctttgtggtcttattttcagggcgtggtgctgaagttagaaggcgattgggcagttttgttttctacagagaaaacacaatctgggaagagatcttaattgacctattagctgaattgaggagatgaattagttgtagaaaatttgtcaaagttaaataatagcagtgagtttgaaggggtgagctagcagaactagaagagaaaggagaatgagaagtaactcacaggccagctgcataatgggtagagcgagctataggtgaactgtgagtagctggcttgctctgttggctgaattccttgaaaagaaaggatgagacatttttactccagtaaatcttatgtgtatctcttgtggattgaagaaattattgactcaatatgatttaagttagagacaaagcacactcacaaaattccaaaatcagtcttttaaaaaaagcacttcatagtgagcaaattttaaattaaatcatcatctaaattgtgacatgcattgagaggaacaggtgaggtttttactccacgttggtctccatgtaacaataattttcatgtcaaaatgatcttttcaggttttcaggttgccctcttcccctctcctttctgttttcagataattggatgaaagtaaaatcttttgaaaacattgctttcagcgtgccaaaagcaaggcatttataactggcctcaatttgcaaacaatttaggagtttgataagtttctaacaggaccatggtgagttcacaaaatctgatttctttaatggaaacaaaaagtgtgctttgtggaagttgatgttaggaattacaaagaaacccactgttcagcacaagtgcgcaggcctttggccaagaattcctcagcttggaacctgagctaagaaaaagcccctggtcacacctgtggataaaagacttagtgagagctgggaggacaggtgaaaaatgatggtttggaagccagagactgttaaatagaagtgacagaggtgagagaggtatccaggaaaagccactgctgtacctaaaacagtagttaaaaggaattaaaaatgtaaagtcttagacgtttggaactctgctatttctgtacctttctaaatgatcttctcagcccttcagagtctgttacactgttgcattctaaaagatggtcttgatagtaaatggggtaaaatggtctcatcaggtctatttttctctcctggttaaatgtctacttaggttaaataaaagctgtcctgttgtagtcaaaacaattagttcctggcctcataagaccaggtttgaatctgagctgtgtttttgctggctttatggtattgggcaagttggcaatgttcaacttaattatgtcttctcatttgctaaatggataccaatttatgagactatgctcacaaacctaaagtgaacaggtgaaagaccctctgcaaaatagctgctcaataaactgttgcatgctaatcctaaataagcacttaagaggtatcagttacaatgaattccctgtgtttataaaataacttacaggtgcagttcctcttcatagggagtaacatgaatgagtaacatcacatcaccatactgttctgagaggtacttggcagattggtcaatactgtgaactcagaactccaaccgtgggatcccagccatccattcagtggcatttctaccagaacatctgtgtaagagattgaaggttaattttggcaattcttaccttgtacagaattctgtgcattttaagttaaattactgtaggtgattggggattttgaaaatctaggctcaattgttgacaattccagtgacctttggtctggagcaaatcccttagcctatatatatacacacatatatgtgtgtgtgtgtgtgtttatctatatgtgtgtgtatatatgtgtgtgtgtgtgtgtgtgtatatgtatatatatatatatatatatatttttttttttttttttttttttttggagacagggtctctgtcacccaggctggagtgcagtggtgcgatctcgactcaaggcaacctccatctcccaggctcaagtgatcctcccacctcagcctcctgagtagctgggactacaggcatacaccaccacatccggctaatttttgtatttttttgtagagacgggattgcgctatgttgtccaggctggtctcgaactcctgagctcaagtaatctgcccaccccagcctcccaaagtgctgagattacaggcataagccaccatgcctggtctcttagcctgcatatttcatgtttctcgttcataatataaagacagaaaaggtgcttcctatgggaagatagatgtggacacaatttcacaaattaagttttatacaaatgtaaagtactgcaattcatgttgacctctcagcttagttggttttagagtaaaggggttagctagaggcctgagtcttgctccctggcctggcccaaattacctgacccaggagacatctcaacctctctagcttttagtttcgtaatctgtagatcgtgaggggggttgactccatgattccgtgagctttcttctcaagcatctcattctagaatattccatcggtccttttctgtcaccttcttcccaagtggttgtgaaagggtggcttgtaggcattaggccagagctgtgtgttagccataattcagataatacagcttataattcagcttgtgttgatcagaaactctgcctaagggaaggcccaggtaaaacctgtaaagtcctggagtttcatcacagatgatgctattgcagagcctccaagattttgcctcttttttatgagctttggtgactaccccagcctaatgaggtccaagatatcccagtacttccacgggaggatcatgtgaagattgctgtctggttccaaaattccctcctaaaacagcaagggtggcacctggggaggaggagggacctgggggaggaggagggacctgtgagaggggtatcagtgattctgcaggtgattcctcctcttcctgtcctcttattaaaattccctgaggctgacttcagctagatgttgatcagattaaagcagttggtgctgggatggattaataagcttgaaattttttaacttggatgccttgaggtacttatttcatccccaagcattttccatctctatcccaactagtccagtaaaacctgtggcattgctgagcaataagcaatgcacctgcccgttttcactattggatctggctctgtccactcttttctgggagaacagaggggatgggtggcgtgatggcccactgagtgctgggcttctccatcctccatctgagttggctgcattcctgtcccaggtgtcctctgcctctgttgagcccctgccactgctacctccaagtgtccttccttccctccacatgcagaatggagctttccatccccaaagaactcgagcagcctgtttgcatcactgccaggagacctgtttggtactgccaagcactgcaggtatttctagctcagttgtcttatcattagggtgaacatatttatcctctaaaccaggacacttttgaaagtgaagggaggagagccattaataattaagctgggacaacagtcataaaccaggattgtctgggcagactcaaacatgtggtcgccctacttgttccctgtacttgatggaagccttcctgacggtaaggacagtccttccacatcccctcaacctccacagtggcacagacataattatattgaatgaagcgataaataaagctattttgatactttttttttttttttttttttgagatggagtcttgctctgtcgcccaggctggagtgcagtggcatgatctcggcttactgcaacctctgcctcccgggttcaagcaattttcctgcctcagcctctggagtagctgggactacgggtgcacaccaccatagctggctattttgataagctttaatgacagggatggcgaacagtggttaacagttagtgaggcattgccaggtgcagtatgtgaggtcagcactttgtataattatttaatcttcacaatagcgctatagatttgatactattttttttcttttcttttcttttttttttttttttttttgagacagggtctcactctgtcgcccaagatgcgtgtagtggtgtgatcataggtcactgcaacctggaactcccaggctcaagcaatccttccacctcagactcccaagtagctgggactacaggtgcatgccaccatgcccggctaacattttatgttttgtagagacggggtctcattatgttgcccaggctggtcttgaactcctggactcaagcgatccaccactgcccatcctatttttctgtttttcagagaagaatattgatgcctagagaagttaagttgcttgagagcagagagtaagcagcaaagctagggttcaaacccagagtgtaatctcataggtgctgtattatacagataagctagatgcaggggcaggctggtttgtaagagggcatgttgcctgtagcatttctccttagtgaatctccgaaacaaatcacatcctgtttatttccaacaaaagagaacaaatttgggattatatctgattatagcatgcgagtagcaaataagatatgatgtatgtatttttgcagttttttctttccaagttcccccatctttggccaaaatatcacattttaaaccaatgaagagttaaatctagagttaatcacttagcatcagcagtgcagccagaattctcatctcctgattctaaaactgcctgaccctaccctggagtcactgatcaggttgagaggagttcagaatgaagagagaattgtttcaaccacctgttctgcatgagagcctttcaccattttctgtgtgtttgtgaaatgaccattctgaagttcagatccacatataagactcattcaaaatgatcttcctcaatggaaaccgggggtgagatttgaacctgagagagacagtctgctctggttgatgaacagcatagctctggacccagactgcctgggtttacatctcagctctgccacttctaactttgtgattcaggcaaattatttaactcccagtttttttatctgtaacatggggataataacagcataagagcactagccacactggatggctataagattgaaatcaattactatgtgtaaaaatcttagaatagggcctggcataaagcgacactgtgactgttttatctgtaatatatatgttgctttttaaaggccactaggtgatacattagagcaggcagggtgccatcgaatgacccaaccctttgtcatctggcaatattgcctaaaatccagacggtggattttcaccttcaaagtggttctttgggcacaaggcaagtcttccgaaactccctacttgatgcctggcgtattataggcgtctcatattttttgttaaattgaactgaaaaattgaagcgctttgtatctaaacaaatgtagaaaagtgagacgctgtatccagggtctgaagttgaaaagatttaaaatgtggatggaaacttcagggatgggggttgcatgggatgtttgtaattacttatggatgatatgaagatagtacctgctgtattttaccatgtatatgagtctcgtggggacttcatttaaaaatgtgtcttctgcatctgagatcctgactcaggaggtctagatgggacccaggaatctgcactgacacaggcggtctgtgaaccagacttggagaaacactattttagtccagcgtcttggatgcatgagcttatagttccttgacaatggcaaaattagaagtctaactgaaatcacctacaagatgtgcatgtattacatataccattggagacacccactcggagttttcttattgagagaacatttcagttttgatttcataggtaattgggcggtactgatgaatcactaggttttttttaaatgtaagcagtgatacatccacaaacactttcctgagaggtgatagtctcacgcaaaatttaagaaacttttattcttggcttaatctttgtgactgtattttgtgttatgtgtattctttattttgagacatcctgaaatccttaaattttgctcattttcttaaaagccaaatcccacataactatgtaagtatattctttttcagcagttttctctggggagtttcctaaataaatgaattgaatgggggagccatgatgaatgggtcagtatgctcattgcagtgccatctcttaaagggataaactggcagcaatctaaaagggcaacaggccaggcgcagtggctcgcacctgtaatcccagtactttgggaagccgaggcaggcagatcacttgaggtcaggaattcgagaccagcctgcccaacacggtgaaaaccctgcctctactaaaatacaaaaattagccgggcttggtggcgggcacctataatcccagctacttgggaggctgagttccagcagaattgctggaacctgggaggtggaggttgcagtgagtcaagattgcgccactgcactccagcctgggtgacagagtgagactccttctcaaaaaagaggggaacaaagggagagagattgatttatggctcacatgcataataaatatacctaacaattaactatgaaaatgtagtgtatttgctgtcatgaaaagatgtttgataatcatcttttatgtaagtgaacaagcatgttaaagaacacattgtaaaaaaatatcataatacagccagtatttactgagtacttgctatgtggtggacacttggaacgcattatctcatttaatcctcccgtaaacctgtgtgtttaaagtactattatctgtattttctgatgagagacttgtggcccagagagggtaagtgacttgtccaaggtcgtacagcctgtaaatgttccccaaaagcccatgtactttcttcactgtcatgcattactgcacctggggcagtagctacacactttgtttaaagggcctgtatgaataccccaaaatattcatgatatcgattcaagttgtaggagtttggtgatttgattaatttttctttctgcttccctgcattttcttttttcttccaacagccagttattaagtcaaccaacaaataattctaatggcttcctaaatgtagaaagttggttaattttggtattgcttttgccattcagggatttacatagggacaatcacagagatgctaaaccagttaacctttgtaggaaagcggccattaaaaccctccctcctgttttcacgatcactttcatcctaaaatcgggtagattacctctgcgtttgtaacatcttcagtattcaaggcttggatgtaggagagaagccagtttaaatggtcctcacttgtttagcacctacttatcaccccgggagcccttagagttaataaggagcccagtgcaccggtgatcagctactttatttccagaagtgggatgtgggggccctgctgctgcagtgggggtttgagggcagctgttcacctgggtgcatgtcctggatctcatgttgggggcggcagtgctcccctggaaggggatgagccagggaggagtccgcaagggaggatgggccagggagggagggctctgaagcacacccttgctccctgggcagggtctgcatccagggctccttccttccgcctggagctttcccatgaatccttcctccaccacctcctcaactagcacctccagctcgccccgcctgacccagctccctcagcccatgtgtccccgctttgccagctcttctgtgtgctaagtggcacggactgctgtctgtggcttcagtccccggtgggggagcgctggggtgttccgcctcctaagagactgttggttgagggcccgcatatctgtttctgggtttggtgctatcaaggtcacacgggtgtcgccccagactcctctgctgcttacagggcctcatgctggcgtcaccatggcatcagcccagcctagtggagacttgctatctgatttccatcatcctccattcccctttgcaccgcagccccctgaattaattaagcaagcaagcaaacaatcaagtcttgttcgacactgttaaagggagcaggcttcctggtctgtggggagctgcaggggagggatgtgatgacttaattacaactgccacttgactgagtgtctgctaagtgcagggtgctgagttgcattcttttttttttttttttttttctttctgagacacggtcttgctctgtcgtccaggctggagcacagtggcttgatcttggctcactgcaacctctgcttcctgggttcaagcagttctcatgtgtcagtctcccgagtagctgggactacaggcacttgccaccatgcctggccaattttttatttgtatttttagtagagatgggatttcaccatgctgcccagggtggtctcaaactcctggcctcaagaaatctgcccgccttggcctctcgaagtgctgggattacaggcatgagacaccgcacccggccttagttgcattctttattctgttgaatctttatcctttctgcatggtatgcagccttgaggggggtaatagcttaatgggagaatttatagttttacctgtatattcggtggaagatttcaggtgagcagaagttctgggaggattaagcgtcgagggagatcttgagaatgaacacagttgaaaatgaaatcagtccagttgtaagtaataagtgatcgaggaaaaggaagttccttcacctggttaatgaatatttattgcctgtcacccggaaaaaccctggtctcagaagacttaagggtaccgggtttgtacaacaggcagcttttgcattggacttgctggctgaagccagatacctacatgggctgtatagtgatggatgcttcattcttccttggtctgcttggttggaagtggagtcgatggtgcttctagctgatccccttacctctgaattttgtcccggtagctggtgactccttggtgaagtcagtttaagtctctgggaaaagcatcccatgcatatcatattccaaatgttctgtgtaagccccaggtttctttcacaggccttgtgttattagagttctgggggcagttcttgagggcatgtgtcttttctgccaatatttaaaatagttgttggctttaggcttgttttacacttcaggtcatctacaaaggaaatgttaatttgggggaaaagagatgcaatgaagagataaatatataaagatacagaggctcataaacactctggttcacagctcctggccagccctgtccataggagccatatggacccggcatgtggcttaatcctcgtaagcctgggtccctcagacaactgtgaagggggatattgctacctgcttgctaacatgctgagctgtgaagataactgaggtcatggataatgaagtgctgggcacttgcaaaacatgatttacaatctcagcaaagacttcattgtttattcagtatatatttattgacttccttctgtgtgctgggtacagagccacataccagctctccttggagtgtagtccctgggcaggaagcttcagcctgatggaaacactgtttcctaggtttcctgggccctgctgaagccggctgcatcagaatcttcaggaatcagtgtttaaccaccctcccctgactgatacctagtcatgtttgagaaggccccctggcacagtaggagaggttcagagacaagctaactgctatgggcgaggctggcacaggcagtggaaggtggtagtaaaagaacaggtggtctggcctggcgcggtggctcacgcctgtaatcccagcactttgggagaccaaggcgggtggatcacctgaggtcaggagttcaagaccgggctggccaacatggtaaaaccccatctcttctaaaactacaaaaattatctgggcatggtggtgggcgcctgtaagtccagctacttgggaggctgaggcaggagaatcgcttgaacctgggaggcagagactgcacagaggctgcagtgagccgagatcatgccactgcacttcagcctgggtgacagagcgagactctgtctcaaaaaaaaaaaaattgaataggtcgtctgctgggtgaggacccctccaccccagctctcatcccctggcccgagggttggagcactagacttcatgtaccagttcaggatatgcatatctggggagccgtcctgggcatcggcatctgggagagggggtgaggatgggtgggggtccccatgtaagtcctttcttcaggttgtggcttctgcatagctccttgttgtgtggacctgtgagtacacaccctggaaaggcaagtcaaggcctcctctctgctggtttcaagtggtggagaagccctgcatgactgaggcagagaagatgctggaaactgtggcaccaaaccacctcagagcttgagttcagtcccctgcaaaatcccaaagcctccggatttatttatttatttatttatttatttgagatggagtttcactcttgtcgcccaggctggaatgcaatggcatgatctcagctcactgcaacctctgccttccaggttcaagcgattttcctgcctcagcctcccaagtagctggaattacaggtgtgtgccaccacgcccagctaattttgtatttttagtagagatggggttttgccatgttggccaggctgggctcgaactcttgacctcaggtgatcctcctgcctcagccttccaaagtgctgggattacaggcatgagtcgctgtgtcaggccccaaagcctcaggattttagagcgttgtcaatccccttactctcttggccacctcagaaaaccaagaaacaggaatttacttgtcccaggtctatctggggctgagctaatgcagagcctaggtacacagctgcttttatatatatagatatacgtgtatatatatacatgtatacatgtatatacgtatatatgtatatatataatgcctatattatgtatatataatgcctatattacatatataatatctatattacatatatgtctatattttatatatataatgtctatattatatatatgtctatattatatatataatgtctatattatatatataaaatgtctattatatatatataaagtctatgttttatatatatatatatatatatttttttttttttttttttttgaggcaggacctcactctgtctcccaggctgcaggttgctaattaatttttttcttttaatagagacagattctcactacattgcccaggctggtcttgaactcctggcctcaagtgatcctcccccttcaacctcccaaagtactgggattaggcatgagcccctatccctggcctgctgcttattattgtcattactgttcatcatggtttactgtgaatggataaaagggaaagttaagaaccattgatgggcacattatattgtaccccacatgttaatataaaggttcttctaggctgggtgtggtggcttacgcctgtaatcccagcactttgggaggcccaagtgggtggatcacctgaggtgaggagttcgagaccagcctgggcaacatggcaaaaccctgtctctactaaaaatacaaaaattagctggctgtggtggcgtgtgcctgtagtctcagctactcaggaggctgaggcaggagaatcgcttgaacctggaaggcagtgagctgagattgggccactacactccagcctgggcgacagagcgagactctgtatcaaaaaaatgttcttctgatttttttccctctatcacatatgccatttaaaatataagggatatatggaggtatgattcatgtatcataaaattcaccattttggtggttttttagtattcacggaattgaatgactattaataccatctactttggaacatttttgtcactccagaaagaaaccccagaccccttagcaatcactgtctattctccctctctgtagcccctggcaaccatgaatctactttctgtctctttgaatttgcctagtttgtacacttcatataaatgtaattgagcaggctgggcgtaaagtctcacgcctgtaatcctagcactttgggagaccaaggcgggcaaatcattgaggccaggagttcaagactgtcctgtccaacatggtgtgaaacccggtctctactaaaaatacaaaaattagcctggcgtggtggcacatggctgtaatcccagctacttgggagggtgaggcaggagaaatgcttgaactcaggaggcagaggttgcagtgagccaagatcacaccactacactccaacctaagcgacagagcgagactccatctcaaaaaaaaaaaaaaagtaatgatataatatgtggcttttactgtctggcttctttcacttagcattacatttttaaggttcatttatactgcagaatgaatcagtacttcacccctttttatggcttaatagtaattgattttatttatcagttggtagacagttgagttgtttatactttgactattatgaacagtgctgctgtgaacattcagttgtgcatgagtttttttgtggacgtgtgtgttcattcctctcgggtatatacctaggactgaaattgctggatcatatgttaattctgtggttaacattttaaggaattgccaagctgttttccaaagaagcggccccattttacaatcctaccagcagtatggtagagttcatgtttctccacatcttcaccaacatttattgttcatcctttttatttagtcagcctggtaagaccaatgatgctgagcatcttttcatgtgcttatcagccatatgtgttttggagaaatgtttcttcatattctttgcccattgtttaattgggttgtctttttattgttgagttggaagagttatttatatattctaaacatgaatccctttatcaggtacaggatttgcagataattttctcctattctgtgagttgtcttttagtgatgccctttgaagcttcactaattgtaattttgtaaggaacaaatgtaaattttataccaggctgcactttttgcctgttcggttttggattttcttattgttggtatcattcatgaaagacttagcagcatttcattggttaaagctaacttcaattttgaggaagtccagtttgtctttttttgggaggtcggtcacttatgcttttggcgtcatagccaagaaaccattgccaaatctaaggtcatggatattcctttgttccaagaattttaaagtgttagcaactacacttaggtctgtgatcttttcgagttaatttttgaggtctaatttctattaaaagtgatctttagtcaaggatattgaagtataaagctaaaaaaaaaatagccttgatttttctaaaatggactgtgatactcagctctgtcctgtcaattactagtcacaggatgctaaaattataggtttagttttttaagggaataaataaatgcctcaatctcaaattaattttgctctgaaattgagctgactactaagacgagatccaatttaggaagtgttttgacattacccccagtgagcaatttgagaagcacataagcaaaaataagaaagcattcatgtgggctgcttcatagggtttttttttttttaagtgttgtattcaaccttatgagaaacacttgaaagtatgcaacttgattgtctgcccatacatacatatgttcggatgtgtaggtacaatttctgtagttttactcagggagtaagtgatgtatctcctcaggttcctaataattcccttttcaaaaatgaataaaataatattagatacctcatggggttcttgtgaggattagaaaagtttattaaaagggttggaataaacctgccacttagtaaatgcttataaactgcttactgttattaagtattccatttatttatcctgctatttccagtacattttagccaccagcataatcagtacttctcacttaatgttaaatactgctatatttttgaattattgtataaatatatgctaattatgatttttgcctgcagtaaaggaataataaacagttctcatgaataacttaagtctaataatgtttttattgttttataacatatttttcatctaattgtaattacttaaattcagaaaagcaattgtagaactgggtagcagagtgttttggtgtgttacttgtcctgaatcacgatagtttaaccaatgaaatgatgctagatcttctgtgaatgcacccaaaataaaaagcaaaaccaaatgggcaaaaatacagtctcatataagatttacatttgttccttataaagaatctaaggtatttttattttttatttttctttttttttttttggagacagggtctctttctgtcactcacgctagagtacagtggcaccatcatagctcactgtagccttgaactcctgggctcaagagatcctcttgcttcagcctccagaatagcagggactacaggtgcaagccaccacgcccagctaagttttatattttttttgtagagctggggtctcgctatgttggctgggctggtctcaaactcttggcctcaagcagtccccctgcctcggcctcccaaagtgctgggattacaagtgtgagccactgtgcctggccaggtgtctactttctctcccagaccaaacaggagaaaagttctgaatttgaaagggaaactcatggagcattttgaagatagctttaggccaattatgagtcagtttttctagcttggagttcaaggagcaaagacggtttgtttggatggatgacctgtggaaggactaaatccacctggtggaaggttcaggatgacaaccccatggacatccaggtagaaatgaaatgaccactgggcatcagcatgagagggagggccatgaagtttaaatttgagaggaggagaaggattggacaatcaaggttgtaaaggtagcttgaggccagtttggacttcattccatatcttgctctattctacaaggagtcagatttgcctatgaatgtacttatgtagcatggagcagcaaaatagatgtggatttgctaacacataaagctaaaatttaatagaccatccccactgtcttccaggttttcaattttactgccctgcttgctggcttctaagaaatagtttagcttcttttaccatcactttttagacattctgtgatttctctctgacctgttgtttccaaagcaacagcatgtggccagtcaaaataggatttcactcttgtttgtggagctctgtagtaattaggaaaggattcgaaactccatttgaaacggaggctggtaatacaatgatgtgttggatgtttctcagtggagaataaggtgctccaaaaccatggcagcaaaatactaaatgttgtgagagagatggtgatgtcttcctctgtttgtcaccattatgggaaacttttagatgtggattaactttgcacagatggagcggtgcaaggcaaggaaggttatcctgggggagctgctttggtggagaaaacctggtgtcctgccaaaccttggccttcagagtgaccctagggctggtcttccacattgtggaagagacagacctgctagtcttgtgatctctactcgggggcaatgcactgaagagaaatgcttttagttttgagtaaagagatagtcattaaatattggcttcagctattatttatttatttagacagagtctcactctgttgcccaggctggagtgcagtggcacaatctcagctcactgcaacttcacctcccaggcttaagcgattctcctgcctcagtctcccgagtagccgggactacaggcgcgtgccaccatgcccggctgatatttgtatttttagtagagatggggtttcaccatgtcagccaggctggtcttgaactcctgacctcaagtgatttgcctgcctcagcctcccaaagtgctgggattacagcaggccactgcgcccagctgccatttatttttatttttataaaaatatgtgtaataataagacagaaaaaatagggagtagacaaaagaagtaacttaaacatagtggttctcaatcagggatgattttgcttcccaggagacacctgacagtgtctggagacattttttattgttatactggggctggagggctgctactggcgtctagtgggtagaggttagggatgctgctcaacatcctgtatgtactggacagacacccccccattaccaccaacaagaaagagtgatccagcccaaaatgccagtagtgccaaggctgagaaattctgcaagaatccacccctaacacataataatcccacccctaattgcgttatgatggtgtattttctttcattattttatttccacattatacgtaactgtgtacttagtttttttgtatctggttctcttcattgagcattatatcctaacagagtaattttgtaattttcaaaatttttaaaattcacacatttctctcctatactacatatattctaatttactgctgttgtgaataacctgtaatgaataactttgtgtatttggcttttctttttcttttaatttctagttatttcttaagggtagtatttgtaagttgttcatattatttttctaagtggtgaattttttatgattctcgacagatgtttccaagttgctttccaaaggcatggtactaatttcagtgtcatcaacaatgtatagactttctgtttgcttgtgtttttgcctgcataaagcataaagttactggggaaaagcctatttttttttttggctaagtcaatgggcaaaaagtagtatgtgtttgattagtaatgcttttgtgtgggagaaacactgttctgatcattgtcgtcacaaccctcagaagtcatgataaaaccatctgtttctgtttaacaaaggctctgagagttattctaggtcagtggaatgatgcctttctgtacttactgcgaagaagtttattaagataaattgcgatagtttcaactttcttggagtacttttaaaagagcaagatccactcagatcatcatggaaaatcctgtcaaactctaagaaaattgtctaggaggccgaagtgggtggatcacttgaggtcaggagttcaaaaccagctaggacaacatggtgaaaccccatctctactaaaaatacaaaaattagccgggtgtggtgatgtacgcctgtaatcccagccacttgggaggctgaggcagaatagcttgaacctgggaggcagaggttgtagtgagccgagatggtgccacttcattccagcctgggtgaaagaacaagactctgtctcaaaaaaaaaaaaattgtttttgatgaagccattaatgttatagttaaaatatatttaggtatgctaggactccattgcactttcctattttttatgagttatttgtgtatttaatggggcacctagcactatgacatttcatatatgtagaatatatatatatgcttgacacacggaatgctcagtgaaaatgtattaaatatgaacgaacaaacttctgcccgcactttagggccaagagtataattttctgctgtaatgatgacagagagctatagtggagtgtgaccttttgatgtactgctggtcctgattatagtttacttgactttgaaggcttgatcaggaataaaacctccaattatatcactttttcagtggcaaacctgttttatggagtagtgatttgtcttgcaacagggctttggaaactcattaaaaccagggattttctcgcacatttcctaagagaattacaaatatgaaaagctgtggataaaaattatctgatttttgaagatttgctcatttttagaataaaacgttttcttatattttcatatcatgttttctaaatttttattctttcttgagggaaccattccaagttgtacaagtacgtttctttaaatatttgcatttgacaatgactcccttctctggttcttctaacaccttaaatgacttttttttttttgagacggagtctcgctctgtcgcccaggctggagtgtagtggtgccatctcggctcactgcaagctccacctcccgtgtttatgccattctcctgcctcagcctcccaagtagctgggactacaggtgcccgtcaccacacctggctaattttttttatatttttagtagagacggggtttcactgtgttagccaggatggtctcaatctcctgacctcgtgatccgcccccctcagcctcccaaagtgctgggattacaggtgtgagccactgcacctggctgactgttttaattactagtatgtgtccgtaaatgcctgagcaggggttttgagaactgtgccttcctcttctttgacttttaaaactgatttcttgtgcagtattatctttctgaattatgtagcaattttgctttacccaggattaggtgtgctcctctgggttgggtggttgtgtagtacatcatgtgatcagacagcaggcatggaccaggacggtccctggcaggcactgtgtggggctcaactccttccttcccttgtcttaccttactcactggagcatttgttgctttctctcctctcagcccatcaacctagagttgagtaggaaagagtgcattgaatcaagtatttaaattgctctgatggttttgtatgtgctatagaaggaattcgaagacagtttactttttgtcattttcatgggaatcaagaacctcatttaatcagtagcctggtattagttctaaatcatccacacatagatgtggggtgattttggtcatgttattttatagggcattgcccttctcctccagccaaaatatttgtaatacaaagcccatgattctgtcctctctctgtctctggtttcattgataaacttgtaatattttttataaaaactcttttaaaaattaaaaatagatcctggtatggtggctcacacatggaatcccagcactttgagaggccgtggccagaggattgcttgagcccaggagttttaggccagcctggccaacacagcgagactcttcctgggcaacatagacgctgcctctacaaaataaaaataatacttgatagaaaattcaaacagatggaagggcacaattattttttttccgagacggcatcttgctgtgttgcctaggctgcgtggcgtgatctcagctcactgcaacttctgcctcctggggtcaagcaattctcctgcctcagcctcccaagtagctgggattacaggcactcaccaccacacccagctaattttttgtgttttttagtagagatggggttttgccatgttggccagactggtcttgaactcctgacctcaggcgatccgcccacctcggcctcccaaagtgctgggattacaggtgagagccaccgcgcccagccaggcacagttatttttaagtttcttttcccatgctataggttcattttgcagatgtaaccgcttttgaagtctcgttgtgtcgtttaagaactgcttttgaggtatctctgccctacattatatcatcctacagttctgagacttgcttttttcattaacagtatagatcttggacctctttcaccatcagcacagagacataacttattttgcaattgttcagtagtgcttcgttgtgtggatgtgccaaaatttatttaagcagagcccagttgatgggcatttaagtaaaaaacatgccgtgttttgcctttttaaaacaaagctgcagtgaatatcctttgactgcctggatttgaatcttggctccagcagttgccagttcgtcgactctgagcaagttgctttatctctcatgtctgcaggtttcccctctgtaaaatgggaatattaataatatatgatgggtatgtagaataaaatagccagtgcatatgatacccagaataatgcctgggacacagtgagtgatcagtgatcattagctctgtatggctgcctgtgcctttgcacacttgagagtaagtcagtcaaataaattcctaaatgctgaattgctgggctgctggttcaaaaaatgtacaattcaaattttggtggatactccctgttgccctacacacattataccaagttattcttccactagtaattaaacttttaacctctaaaagccttttttttttcttttaatgtaaggcttgaaagcaagaacattccttcattacttcctcctacttatctttactcttggccttactacgtcatgacacatcttatgaaatactggtgtgataataagcactttgtgcagccctaccatggaagaattggtgaaaatgtaaaggttctcagtggtcttcagacttgtgtttgagtttctctcttgcaacaaggtgcctgactaagagagtaaaggttacttcctgcatgtttaatggggcttgatatttgcatatgggcaggtacatcctgcttaatgaacagtgttgggagccatgtggatgattgacatcaacttgtagtacaacaggaaaacattcctagattaatgttccttttcactgggtagggctagagggcaactgcaacgagtgaaatgctaggctgcaggtagatggcttgtcttgagctatgaataatatgtttggcagcagcatgggcagaaaagttgagatttctggatacaggacctggtgaagcaggttctgtcacagggtcagatcacctctaacacctggccatccccagtgcaaaggaaaactaggagagagagaagtgagtataagaggcagctgagggactcttgacaaagttgagaaggatctggtgtcctgggagagctcctgtcttctggaattagtgatgcatcttttgtggaggctcctgatggctcagtaaaaggagcctttcatcttgcccttcctacagggctgagaggggaggggttcttgggacaagtggcttttagcagagaacaatagaagccgtaggctgggctgtcacttgctttgctacttcttagtttgtaatcatcctctgtgtgtccctgaaagtcccctggttctctctaaactgtggggctccaactgaattcctgtctgctccccaggggtgccccgcagcagttagagcagcttgttgagaaggagccgcaggggtagggcagaggtggaccggaagccggaggaggccacttgacatggcgattggagccctcccagcctgtgctttagacctgccagattcctacccacctcaccttggagtgggacatttcttttcacagtgcccaggcttaactatgctgtccccgggtccattcccaactgttcctattcaagatgtctagacctttgttccctgccttggcattttcctttcctggtgtggagtatctctttttgaaatagctatctcagcttcaacatagcagagcggaaaacctatgtctgggcttgaggcagggggaggaaaccgtagatagatccaggaatggccaaagtaagcagagatccgtgagcctggacgtgtcatgacataacaaggatatgtgggtgggaggggcagggatgacatctttagctttctgtgaaatcatagacatgctttcattattttgtagaatcaaataattttgaagatagagatatctgagtccatcgatacttacctctttttttttttctttgggacggagttttgctcttcttgcccagactggagtgtaatggcgccatctcagctcactgcaacctccgcctcccaggttcaagcgattctcttgcttcagcttcccaagtagctgggattacaggtgtgcaccaccacatctggctgattttgtgtttttagtagagacgggatttcaccatgttgattaggctggtctcgaactcttgacctcaagtgatccacccgccttagcctcccaaagtgcttaggattacaggcatgagccactgtgcccagccgatacttagctcttattggccatagttctcttggagaatttggggaaaagtatgggcctctccacaccataagtatacatgatgtacttaccaaacacgtgcatgcaagtttaggggttcacaggccctggaggtttgtctgcacatctgcactgtggggcagctgcaccttcctatacacaaagacccagggtcgtggagagacggcacttgtgtgggtcacagagttggagacagtgtaccagaagtcattggtccgcagagccgtgtcttgcattttatactccagtacgttgcttcggtgggaagggtgacctcattttttgtttaattcgaagacctcactgggaaagaaacacatagagatgtggaaggaaaaagaaaaagctgtgggaaatcgtgaattcgtggacattgatggtgaaaggttcatttcaacccttgatgggaacatcgtgattctgtttaagaaacagcatcatgtatatgcctttctaataaaacggcgcggcaccttcccacgcaacttgcagccacgaggttaaccagagataaacgtggctttccttttccttacatcttcctgcaacacccttcacaatagcccacaccaagagagttcttagggtaaatatctgtggcgttaaatttcactttaatacagaaaggctggccttgaaggggagggaagagaggagcacgactcacttgggcctcccagaggcaggcttgaggacctctcctgcagcgtagtggatggggaggaacagcacgcggggttcaggctgaccgcagctagactcctggggggtctctagctctgtgaccagagtggctctgcctcagtagcctcccctgcataaggacacctttgcagggatatcgtaaggaatggagagactgtattgaaaaatatgccggaagtatctggtttctatggggccctcagatgatggccagcatcgtcttcaacaacatctttcattgtcatcatcattgctgccatcgttgtcctgggccaggatggttggcagtgagggggtctggcatgcccatcgtgctctgtggtgctctggtgctgtttgaaacatgcgactggttcttttagagattggctgaggagcatcaccttttgtgaaccatgctgatcaagttcatctattgtttgatgttggttgagaaaatcattgatcctaacatttcattcttacacatagccttaatgttctttttaagaaagagatagaagggctttgcccatgcaaaatgcacacgaataatggcttacccacttgcaaataatccatgtgaaaataagttgcttggaataacataaaatcatgaagaggccgggcgcagtggctcacgcctgtaatcccagcactttgggaggccaaggcgggtggatcacctgaggttgggagttccagaccagcctggccaacatggtgaaaccccgtctctactaaaaatacaaaattagccaggtgtgatggcgcatgcctgtaatcccagctactcggaggctgaggcaggagaatcgcttgaacccagtaggtggagggtgcagtgacctgagattacatccttgtactctagcctgagcaataagagtgaaactcagtctcaaaaaagaaaaaaaaaatcatgaagagtggacctttttgcaatttatatatatgttttcctatattctgcgatgcttataatcatgatgtaaactaatccttctttggctgcaatagtcaaaatatagttataggaaataatattgagaagaaaaatatattcctgagctaacaaaaagccatataggaaagaaatgaagtgtgtacagtgggctctcgctcagctttttgttttttaagaaacactccattttaaagagaaaggcccagccatttccacagatgtgtttctctctctgagctgtcagtagcatctgcggttattttctggaaaatggagaggagatgccatgaacttggatttcagagttcccctctgattatcaaattgaccctcttggtgatgaatcccaccattggttcccaaaaggtcataccttagtcactttttaattatgtgacccccctggggtgcacaaaaggagcttcatggggacttcatgggcctctccactgtctgcaacttgaagcctgatttgcaaagccatcggaagagaattccctatggggtgagcagccatagttggcaaacagctccaccaccacagccttggagagggagggcggtgcagactgacccatccaaccaagccaggagtcaacgctggggccatcagcatgcgaagcaaaggaaccaagtagcagaggaaactcagcaaccccaaagagctgctgagaagaaatcagaccctcctgaagacttctggtgcagtccactgctggtgtaaagagagattttccattttgacagatcccatggactcatcttcagcaaaccattgggcagggaatcaaaagtcatcataaagacctccgggtatttttctacatcagtcccctgcgtgctgcgagtcctgaaatggagcttggagagcagcgggtgggaggagaaggttgtcgtccctactgtttttgcttggattgtttcaccctgtccccacacgtggacagattcagccgggtgcttcaagacatcattcaacttgcatatactttgttcgtttattacacaaatatttactggttgtgatgtgatctttgagtgctccttggttcccccttcctcctcctccaagaaaagatggatgttcctctccttccttacacagctcctcctcacctcccatccaaatgccttatggcatctccagtggtgtcatctgctccacattggccaagggtcggtagggtcaggacagaggcctgttcatcacttcatctgcagcacctaccacagtgcctggaggtggaagcttaaacacttattggataagaagtttccgtagtcctcttactcaaccactagatggtcacttagtagccaaaaccaaaaccaaaaaacaacagttttttactttattggacaagcactgattgagccccttctgtttgttttttcacttcaaaattattttctttcggaaactttcaaacagaaaagttgaaagtacagagcaatgaacacttgggtattcctctgtctggatccagcaactgttaacaactcggcacacccactctgtctatctccctccctcccctgtgtgcacacacacatgtgcacagacacagcctcctcttgcgctagatcatcggaaagtaggcaccccaaccctaaatatttcagtcttaggaataagatacgccattagaaactgtggttacaggccgggcacagtggctcacgcctgtaatcccagcactttgggaggccgaggctggcagatcacagggtcaggagatcgagaccatcctggctgacacggtgaaaccccgtgtctactaaaaatacaaaaaattagccgggtgtgatggcgagcgcctgtagtcccagctacgcaggaggctgaggcaggagaatggtgtgaacccgggaggcggagcttgcagtgagccgaggtcatgccactgcactccagcctgggcgacagagcaagactgtgtctcaacaacaacaaaaaaaaaaatgtggttacagaggactacgtgctttgggagtacagagtgggaaaagttactttccaaaaaaaatggaaacaattagaaatggtttctttgagaaggtaacacgtatgctgtgccatttgcatagataccggtttacagtgtttgggtctaaaactttaacaaaagggaaaagataacagtctttcaaaaagcttactatctcctcaaaaaactcattcccctttacagtatttggaggtttgatttttatgattcctctgtggttttgtaataaccacacttattatttccttagcttctcgggctgtcattgaaaaagtgcctttaattttgcttgcatttactagtaagatttattcatgtgcagaggggccgtgtagaccagtgaggtggtgtttagtcagctgcatccgccttgctgtgcgaaatgctggtgaaagctcagtgacttggagcaacaccaaaattcaatttttgcattttaataatagcttaattttgtgattatgcttaacaattctatacatccctaaataaaagaaagtataggccattctaagcagtcagaacttcagctttttctaccatataatggagggttttgctaaatttaaaaatgtgtccttgaagctgaaaggccacctctgaggcactctggggagagtgttcgctttccaacagtcgggaagcaagcaaatggcacacaccctagaccagtgagagaaaggcacttgcaggcctgttaggcattttgttggctaaatagaggggaaatgatggaaaacaaatactgaatattggtttggggagggaatgacaacagcttgtgtgaaacggaggtgattttaaacataagccagtgggtttcagagcacaggctatggtgggaagtggtggggagggggaagcttagcaaatctgggtattggttttgcctgtttttaaaccccctttggagtctagtaaggttaaccactctggttagttcagcgttctaacaggtgactttacattggaggaagatgttcagaaggcgtggaagacacatcttcgagcagccccagcttctgatgattttgttcatctgggttgcagacccaatctgtgtcccagggactgggactggccttcattaccttattgacatgcttctcccggacacacacacacacatcacatttgcagccatctcaatttagtagaggaattacacataaccaaaacactccccaaatgtgtgctggagaacagctcggagggatgggacggcctgtcgtttcctgacgttgactgacttgagtgcaagaccccagagcctgggtgtgtgcagagggcggatagcacatgggtccctgcaggaggcctctcggccttcttccatgtgtgtgcacgtgtgtgtgtgtgtgtgtgtgtgtgcgccgtcaaatgttggagcttctggggaccaccccaggaaccctctggacaggggtgtctagcccaggcctgagtgcagcgccctccctgagggtgagggttggcttttaaaagaggatacctttggctgggcgtggtggctcacttctgtaattccagcactttcggaagccaacgtgggcagattacttgaggtcaggagtttgagaccagcctggccaacatggtgaaagcccatctctactaaaaatccaaaaattggcccgggcatggtggcagacgcctgtaatcccacctactcgggagactgaggcacgagaatcgctcgaacctgggaggcggaggttgcagtgaactgagatcacaccaccccattccagtctgggtgacagactgagactgtctcaaaaaaaaagaaagagtgacacatgaaataaggggcaagaggttctgagggagaagccttagaaaaggcagctctgttcttcctagaggagtcttagtttagcattttaccacaaagaaatgtcttttttttgaaagcagaggcccacagaagctgtgacatggctaagcttagctgtcccaggccaggatcggaactgggtgctcatctcacacctccacacccagcactagcccaaggtgggacccatgaggtgtgcttgggcacagttagggagaaagtcaggatggattggcaggggaagattcacttccgaagtattggcttagcagaggagctggctcactgggggatgagactcaccgatggcagtgtggttatttatgtataatcttcactcatcatttattccctaatcacgacatcgggcacacctgctgggttctaggtgctgagtatttgacagtggataggacagtgaaatcctgttgtaaaggggcttttcttctgtagtattggggcggatgggacccataataagtaaaccccatgatatatttaggctttgtgtccccacccaaatctcatcttgaattgtaatccccataatccctatgtatcaagggagagacatagtggaggtagttgaatcactggggcaggttcccccatgctgttcttgtgatagtgagttctcacgagatctgatggttctatataaggggctctttccccctgctgggctcttctccttcctgctgccttgtgaagaaggtgccttgcctccccttcgccttctgccatgattgtaagtttcctgaggcctccccagccatgctgaactgtgggtcggttaaactgctttagtttataaattaccctggaaagtctcccactgggaaaaataattggaacaggcagcatgactatttttagcattatttcaatatgggtttaaacttttttttaaattgaatattgtaactattaagtttaaacctaaggatatagttgctaagtatagttcttctctcactatgatttaaattatgttataaagaactggcagttctttatagcagtctgaaaatggactaatacaccccacaaaccaacaggaccgtttcagatggtgatgtgaactctaaagaagataaacaatgtgatgatggcttagaacagcagagtggaatggagatccaatgcaagatgtgcaattttaaatattctagtagccacattttgaaaagtaaagagtgagggaaactaacttaatgtaacttataaccggtatgttcataatgttaccattataatatatataaataattgagatattttgcattttctttgcattaagtcttctaaatctggtgtgtattttatacttagagcacacctcaacttggattaaccacatttcacatactcagtaggcacacttggctagtggctttggctagcacagacttagtgcttgggggcggtggtacaggtccactttagattgcatggttatctttaagaaaagtcctgttaactaagcacaaggaacagttcctaccactgatctatgttgtgttttgtttgctgctaatgtgctcatacatcaaggtaaattattattttaatccagatttcagctgattttttaacagcagttttgctgtgtgcacgctgaatgggattctccaaggacaggcaatgagaaatccttcaacattataggaggagacggtggagagagatccttatagtctttgagagaaggctttggggtttccagggcctacattttgtcagagatcttctttcctgtacaggaaagtaggtgttgcaggttccttctttttcactctttccttaattatgggaaggaattccaccaacattgatgtttaacctggaaagtctcccactagggaaaataattggcacaggcagcatgtctgtttttagcattatttcaatatgggtttaactgttttttttttttaattgaatattgtaactattaagtttaaagctaaggatatggttgctaagtatggttcttctctcacctactcagtctttgggtgggtgaaatgctacttgttgaatgaaattagaataatttccatctgagtttttcaggttcagctgcaaatgcaggagttggtttagagtcagtttatgaaggaagttttggaaaacattagagtattttgtgtgtgtgaaaattagacttgtgggaaggagtgtggtaaaaactgctagcaaacactaggcaaaatttttctaaaaatcatttgccttttccttcacgtgtaaaagtcatatatgttctttggagccaatttgaaagagaataaatcatccataatgccatatctttacagtcttttttttccttgtacctttagatgtgtatttggtaatgtagtttttacatagttttatgctgctttttacacttgtcatgtgtattttcacattttcttattttttcaagaatttagcttttaaatggctgtgtaatatttttccttgtgaatgttctgtcattcattctctctcttttttttttttttcgtgacagagtctcgctctgttgcccagactggagtacagtggcgcgatctccgctcactgcaacctctgccttctgggttcaagtgattctcctgcctcagcctccaaagtagctgagattacaggcacccgccaccatgcctcgccctgtcattaatttaatctttaattcaccctctattgttgttttttatttttcattattataagtaatgctgccatgaatacctttctacatacatatttatatgaatatctaattattgcagtaaaaactagtagaagcaatcattcagtcaaacaatcaagacttttttttttttttttttttttttttgagacagagtctgtctctgtcacccgggctggagtgtggtggcacaatcttggctcactgtaacctctgcctcccaggttcaagcgattctcctgcctcagcctcccgagtagctggggctacaggtgcctgccaccatgcccagctaatttttgtatttttggtagagacagggtttctccatgttgccaggctggtctcgaactcctgacctcaggtgatccacctccctcagcctcccaaagtgctgggattacaggcatgagccagcatgcccggccccagtgtagactttttttttttttttttttttagggcttttgatatttgttgccaagttaccctctaaaaacctagtgcaagattacattttcacccctggggtgtgagtgccttttgccccacagtctagaccatgctggatttataattttaagggaatttattaatttgttagatggtggatgtgtcattttgatgcaggactttaaggaagaaaagatatatctttaaaaacgttttctgtttttcttttttagcttgtcttttggagttcttgcctttgacttaagggcaaatgtcttactgagagatgctgggtgcctgggtcacaggtggtttgtcgttgccctttttctttttttttccaactcagctaagttcagcactagttttgtgacttattacacagaagacttgaatacatcaagggcctctagagatttgtggtaacatcaagatgtgtagtctgtaatgtgtcatggggggtgtgagccattcaaggggagttactcttaatggtaccattattcaggatacagtgctgatgcctgcatcctgatggcaccactgtcgtccaactctgtttgtgacattgttcatggcctctgcagagtcagggagctcctcaggataaggctctgtgacatcgtctaaactccaaagaagtagagccatcatatttccttccccaagggagctggcatctaccatcactgaggattttttgagtctctgtaccaggacatggacctcaactctttatttccatgattaatccctatgtcaatgtacatggcaaatgctagcatttccttcattttattgacgatagaatcaaaactcagagtgtttaggtaatttccttgaaattacacagccaggaatggccaaggctgggaattgaatggactccagaacccatggtcgaagtccaagctcaatatctctgagacctggaaggaaatgaaacagactaaaatcagagtaacgcttaaaaccatgaagattccagcccacagattctatctgccacatgcagacacgatttatacccctagagggaaactgaagaaacaaggtggtggtcatacaataatagactcaaaacccaaccacacttttgaagtgaatagtggctcatgatggctttaaacatcttaggagaaaaatcaaagttggtgatgggctaatttggaagattagctgaaaaagttaagtggcaaagaactaagtgatagttggagtgaggaaggcattttggtgtggagagagtaagattggggaaggaaagctccctgggtaactgtaggattagaagctgtgaggagtgtggtttaatcagacaatttggaagcaagacagagagggaacagtccccatttggagagtgttagtgttcagggtaatcagaaaggaagagtcggaagcatatgtaattaatgaacgagaaaggcagatggatgatggggaggtgggtggcgtcgcgctactcatatgttcttttgataagtaaaattatagcataatttctcactcattggaaacaaggttatgcaattaggatcctgctgctgctaaaagcttccagagattttagtgcactgggcagacagagtgatgatgtttactttaaaaatcgaacttctcgtttgagatacttaattttatttaatgctcgatttttgtatttactggttctgcattttctcatgtagattaagatccaatttagagaagaaatatatgggcagtttggctgtagaaagcacagaggaatgatgctgtggatattgatgcaccatgtggtagacagcattttcttttcttttcttttcttttttttttttttttgagacagggccttgctctgtcttccgggctggagtacagtggtgcgatcgcggctcgctgtaccctcaacctcctgggctcagttgatcctcccatctcagccttccaagtagtgggacaccatgcccggctaatttttgtatttttttgtagaagatgggatttcgccccattgtctggtcttgaactcctgagctcaagtgatccgcccacattggcttctcagagtgctgggattacctggctgacagcatttgttttaaagcagtaaatgaaaatttgggtattccttttaagtttttcaaaatttcaatctgcagtttttaatctatacaaaaaactgtggtaaaagacgcctaacataaaaattacaatcttaaccacttgcaagcctacagtttggtagtgttaagtagattcaccttttgaaacagacctccagaactttttcatcttgcaaaactgaaactgtttgcctatcaaacaacagctcttggtttcctcttcctcctaggctttggcagttactattctactttgtttctatgaatttgactgctttaactaactcataaatggactcatacagtatttgtctttttgtgattcgcttgtttcacttagcgtactatcctccaggctcacccacattgtagcatgtgacaggcttcctttccttttcagggctgaataatataacattatatatatggatatgtacattgaatatcccttatctgaaatgcttgggatcagaaatggttcagattggggatttttttagattttggaatatttgcataattcttccaggttgagcatccctaatccagaaatctgaaatgctctaatgagcatttccttgagcatcatgttggtacttaaaaagtttcgaattttggagcatttcagatttcagatttttgtgttagggatcttcaacatcattctatttttttaatctgtcaatgaataaaattacagttttaaccacttgtacacatacggtttggtagtagtgttaagtatattcacctttttttgttgttgtttgagatggagtctagctctgtcgcccaggctggagtgcagtggcacagtctcggctcactgcaacctccacctcatgggttcaggcaattctcgtgccttagccacctgagtagctgggactacaggtgcgtgccaccacgctcagctaatttttgcatttttagtagagatgcggttttgccatgttggccaggctggtctcaaactcctgacctcaagtgatccccccgccttggcctccccaagtgctgggattacaggtatgagcaaccatgcctgggttaactatagtcaccttttgaaacagacctccagaacttttcgtcttgcaaaactgaaactgtctgcctatcaaacaacaactcttcgttgcttccacctcttggctactcttgagtagtgtggctatgaacacgggtgtacaaatatttctgagaccctgctttcaattctttaggatagatagccagaattgagattgctggattacatgatggttctatttaattttttgaggggcttctgtacaattttccattgtggttacaaccattttacagtctaagcaacagtgcacaaaggttccaatttctctgcatcattgccaacaccttttagaaacagtagccatcctaatgggcatgaagactatctatagtttattatgtcaagcttttcttcatggttataaacgaatattgtgatgagtgatttatctatgtttgctgctttactccccaggggaggatgagtataccatatatgtccatattgatacctatctcagaatactggttgtacaaaactattccaggcattgttcttctttaagtatttggggtgtttctttttgcttataatttagtacaaatgttctcagttcagttaataatgagtcctactgtgtggcagttgagaacatgaagataaccagaacacagttcccgccctcaagggactgatgagaagtagccacgttttgtaggaacgggcaaatgaagtggcaaaggaaggtggccatgggttgccataggagcgcaggtgagggatgaggaaaggaagcactaaaccaggtcagcttgtgacgtgggataaagaaggcttcttgcaggtaaagccagagctgaatttggaagatggtaggagttcacctgctaacctgggaggtgtgagtggagtgcctgcggctggacccactttgagcaattggaaagcctgtataggaaaccataggtgacatgatgccaagtggacatgacattcagggagatgataggcagaaggtgaggccaaagaagttggctggatgtatgtcagagaacgtggtttttatgcaatcattgatggaaagctcatgacgcattcagtgatgtggacggctttgtgctctctgcagaccactctgagggcaatgtggaggtggaggcagagagattaggtaagaggtttttgtgaaagttcaagtgagataaggaatgaactagggcagtggtagtaagaatgaggagaagggagaaaacctgccaaatacttaaaaaaattagcagccatatgccggttaagtgtatgagtggtgagacagagggaacattgaagataacccacagatttctggcagtggttccgtgatctgaaattaggaatataagaatagacactgagggtggacaggatcaattcccttttggacattttgggtttgatgtgtctgtagaagacacaaatggtgatgtccagttcaccttgggtttgtgagtcaaatttgacagattcagatagagacacactcttggttcttattagatgtatgcagtagttaaaactatgaaagcagatccatcccctatgttggaggggcacaaagaaaaggagcagcccaccaaggagctggagaatgagaatcggggtggaccaagagggagtcgtgtctcaggggctggggaaagtagaaaggttccagaatgagtgagtggtcaggaacttcagatgtagcaaaagaggtcttagaatgtaaagatggagtcacttggcagtgtcaagatacaaagactgaataagtttggcagcgtggagataccaggccgtgtgaagatccttaggacctttgtccaggcggttttaggagcttggtggttgtgggaaactaatttcaggtaaatgtttataatggcagtagagtgactatggagtactccttcaggaaacttagaaggaaagagagaaaagtgaaaaagaggccaagaaatttttttttttttttttttttaaagaatatgagagacttgagcatgttacagggcaagggaagaggttgttgataattaaagtagctgacattttggagggcttgctccatatcacctacatccaacagctgtatatcaaagagctcatcaaatccatccaacaagtctgaggtgttgggacaattactgttcccagtgttatgaatgagaaactgaggtacaaggatgtcaagtggctctgggtgacaccagcaataagagagcccagtttctcataacctgtgtagatgtcaccatttaccagagcactgagatgtttgctggttttgagggagaagttgaagatttagggtaaagaaggaataattcatagaaccaagttctagaagacactggaagagatgggctgaaagctttgtgaaatttgtttttttaaatgaagatgaaaagtttaatcataagggaaaaatagggacagtaaacagagttggatagagaaagctcctaaatattggagcctgtcctggctctgcctcctgcaagaacagtggttttggtttcttttctgcacaaggtggtccttttagtcacatttattgattgattggtttctttattatcacggtttgagctgtcattgagtatgtgacattctgttattttaacagtgttatattaagaatctactctatgtttgggttattttcagtccagtgacttaaatgatagcatgccctccattcttggtgacttgtgttgagaaatcttatgctggggacatattgaaattgttgcaatgtggtttaatattacatgttttaaaagctaagaagctcctattagtctctgaaatatacctggtttccaatttagtctacaaaggagatatcattcctgaccctgatttagtgggagagacagagatgcctatatattggatgatgtattattccatacacacctacatacacagctctgtaatgtttaggaggcttcaacaatgggcagatagaaacctgcagctcctattgcattatagctcctaaataaggtgttagcatgattatttatgaatttaccctgtgagctataattcaaatccttggccaatcaaagggaaaaataaatcactgggagtagtgttttacttaaaacccattaaagcaatttaagtgaaagtttttttcaggtatgaatacctagctccctgcaggagggcaaatgttgatgtagggatatctttattaatagtcttggtgaaactgaaggagaaggcatacaatacagtctttcacagaactcagcagtagccataaatccatttatgaacagttcaagtaatagagctttgaagcataacattagttttcaataatgatgttattcttttaaaaaatcagaggtttaaatgtaatgcatggggaaatggggcataataaatttgaataagtaagcattacttttcagtggatccagcagattccctttttattttatttattgttcaggttgttgaattttgtttattcaaatagtaaatgagacatagtccagggaagagccctttgcttatgctatatgatttaaggccagctgccgtttttcctgagctacatacgcttcatcatgttggaggaatcaacttcaaaagtcagctggctgttctgcagacaagcaccagacttgttattcaccctgaatcctcagccttagctccccaatctctgttgcacagaaaactacaattcctgggtgcctggaaagagagggacaaatattaatttgcatgacagtatcctgtgcaggacctcgtgctaggagaagcccaggaaatgtttgttggtagttttcactttgtcttgctagaaaagcctctacaggaaatctcctctgcttctaggaacgtcaaatttcaaataatcctggccaagtagctggttcctattcttgactccttcatgggggcggcggaggggaaagcttcctatgataatacattgcagcattacgctgcccaaagtgccaagggcggttgggtactattcttagtgtttatgtctttagttcttgttcttttacttacttatttttggcagattactgtttacaagcctcaggaagttagcagcaagcttgtcccttagtccttagcaataacgtttgagaattgctggaacctgtttgtcttgttagcaactacccaaatacgaagaagcaaggctgcaaggcaagcaccaaacttgttattcaccctgaatcttctgccttggctcctcagtctctgttccacacactcccatgctggctgctggaaaggatggtaggcctttttttttttttttttttttttttttgagacagcgtttcactctagtgcaggctggagtgcagtggcacgatctcggctcactgcaacctctgtctcctgggttcaagcatttctcctgcctcagcctcctgagtagctgagattacaggcgcacgccaccacgcccggctaatttttgtgtttttagtagagacggggtttcaccatgttggccaggctgatctcaaactcctgacctcaagtgatccactcacctcggcctcccaaagtgctgggattacaggtgtgagccactgcgcccggccaagagaggggtaggcctttttgatgggatggaaactgctcttcctgggatttcagcccgcccctatctctcccatcaggagagaaggcagagcacagtgattgtccatgggctggtctctgttcacttccccaaggtgccgacactgcgtgcactccacacgtgaggcaggtgtgggaatgaagctgcctgaaggccgtggggatttcacagctggtgaacctgctgtccctgaagtgccattacttaaacccagagttttctgctcacttctcattttattgaaaatggtgcattggcaaagtgatgttgaactggaactgacaaccagcattgtccctctgctttcctcagactaatccacgggctgtccactcccctgtgatgctctctggatcgggtccagcccttgctttccttggaaaacactacctatatttagtggtaccactagatcttctagcatccgttttctgttgctgcatattcattaataatagggagaaaaaaaaaaccaacccttgtgtaattgctatttgaatttcacagatagagtagacatttaaagatttagttggctttaaaatgtaaatttagaagttcctggtaggcaaagcatgtttctctaagggtttataatccaatcattcaatccctattcctttacacgtaaaattaatcctttccaataggtacaaatgcctgaatggagaagatggaaggttcttggcagatggctatctgtgctcttcattggcaattttttttttaacttgaaaaagtcaagcattttggtaggagaatatgctttgctggactctgccaagtttcttgtggctgtgttcctattagtgggcttcaggggcttcctgtggacaattattatggttggtgtggaggaaaaatggaatacattattttcatcttttcattaaaaaatgtggcttccttcccttttctccagccagctgtcagatttgaatgcctgccctagtttgctctgtcatcatcgagttagtgggttgagtgatgggagctggcagaagcccattagaatgattgccagtttccaaacacaccccgaatcccttgctacagatgtctaggaagacgggataacagaaatttgcctctgggtttcagtacattgatttcttgctcattttaattacaggtctcccattaaagaacggggtgggggagggaaagcagctttgaattaaaaatgtgacttatttatgggtttagttgctttactatgaagacttgctctaaaaagaaagtttcattggatgctcttaaagttctttataaaaagatccccattgtacagatgctgacaacattccatgaacaaaaggcttatctggatcacctaaaggtctgtctggaatccaaaataaaactggtgcccaggtggctaattatcactttctgtatcatgcctggaaaatacacagcctcctttgccaagagtctatggcagggcagaaaacgctgcccaggcagcttcatgtagcattgtagcttttccaggttttttttttttttttttttttttaaatgtcatagaaaagataccggtggatatgaatcctttgtgctgaagttggatggcagttagaacttaaaatttaaagaatgcattcgatcagttgggctaatccgtttgggtggttggagcctgataccaggtaggtaaaattacacagccatctactttcattcttttccacccatttgccatgccctgcactgtctgccaggtgagagagggatgtcagcttagtgcagagttttaccacacctggagaaaagagctcctgtctgcttctaagggactgcgaattgctggcaacttcttgatctgtagaggacacttcctttccaggaaatctaattttgagaaaacgattgcacttctaaagaggtctttcccgtgtgatctctagacactcttcgttgctttaaaatgaaagcctgggttttaatatttttacatcattgcatagattcagagcaactaatattttgcttgttcagtggacaccttgttgaagtatgagtaaatttgtgaattgtagtgtttagccaacctttttttttttcccattggttttatccgtcttaaaaaggtttggatctgtgccccacccaaatctcatgtggaactgtgatccgcagtgttggaggtggggcctggtgggaggtgatcagatcatgggggcggatcctttgtggatggtttagcaccatcaccttgggctgttactgtgatagtgagttctcggggatctggtggtttaaaagtgtgtagaatcttcccctgacacttgtgcctgcaagaaagcttgctccggctttgctttctgccatgattgtaagttttctgaggcctccccagaagccaagcggaagccactgtgcttcctggacagcctgcagtaccgtgagccagttaaacctcttttctttataaattacctagtcacaggtatttctttacagcagtgtgaaaatggactaatgcaccatctatgcattatttatttggacctaaatatatcccaggaattgtgctagactgaaaatatagtttgtatatgcacatttgaagttcatgtgattctgctactctgaaaaatgttttgcattttttgtttaaaaaaaaaaagtagatttccttttctttacagttaaattagcatattagtttaaaaaagtgttgtattttatggttcattaacagaattttacgattttctaacttgccaaggattatggtgtttattcttgaacattgcaagccccattgaaagtttggatgtaacataggtatagatttttatgtgtgtttcttagaaataacagataagcagtttaaaatcattgcttccataaaagctgaaattcgtctttttgaaataggttgggtaaggatttgagcatttatgtaatttgttgttggaaccacccatcctccatggaggttatgctcaattacgtattataaaaattggcattgacactaattcactttctgtatctcttttggatagatggatgatatacagcataagaaagatttactggaaaagatgctgtaatcaaaataggttgtccaaggcaactataggttgatagcgtgttatttgcagataaactgaaattttgaaagaaagaatatttggaaggaaaagaatttcaatccgattatccagtgtttttagaccttctggctatgagattgaattgactatatttcattgactgttaattaattagtacctttgtaatggtataatttagagaactgcattttagggcattactttagtctcaaggttgtcaaatattgtaacttgagctttgaaaactagtttgtaaaaatgagggaatacatttaatccatgtcaactaatttgaatcaatgacataaaatacagcttgggcattaaagcaccgtgtatatgtttgcgtgtgcttgtctaactgggactgtctatgtcaatcttctgttaccttatgcgttgtttggtttatctagctttttaaaaaattggttatagtcttacttcatgcatttttagcacaaatcttcatttcattttaccttcaccagtaataagagcagaaaaagaggtcagcaacaaataatttgctgctcattagttgagttgatgtgtgggaagtatagcacttttgattgaaatggtggttgtcggccgggcgcggtggcttgcacctgtaatcccaacactttgggaggccgaggtgggcggatcacaaggctaggagttcaagaccagcctggccaacacgatgaaaccctgtctctactaaaaatacaaaaattagccgggcgtggtggtgtgcgcctgtaatcccagctacttaggaggctgaggcaggagaatcgcttgaacccgggaggcggaggttgcagtgagctgagatcacgtcatcgcactccctccccagtctcaaaaaaaaaaaaaaaaaaaaaagaagaagaataaatagtggttgtcagttatcagaaaaccttaactttttggtaagtttttgagttacctcttgtaagtaaaggcttgagggagtttaggaagcactgtgacgtccactcatgaaagacagaatataccagggctgggatgggatggaggcagggggtgaataagacttaggggttcgttctccctttctcctcaggttcacttgttgaaagtcttggatgcttctgtgaggccttagggggtaccatgtctaacttgtgccttctctatttttgcatacaaggcaggtgacacctccttgtcttggactcctgtggaccatgtctgttccattgatgaattagcatttatgatagattatttttctagggatggaaaaacttaggaaagccaatgcctgttgcctgcattagtatacctgatagctctgtacaatatatgctgtcactctctcagatggattggaagtattagaaactatcaacctctcaaaattctgtatttgaaaatagtcttgtattttagatagataaaatcagaagtcttcaatattctgagagctccacatagaaatcagactcagggctgggcgcggtggctcacgcctgtaatcccagcactttgggaggccgaggtgggcggatcacaaggtcaggagatcgagaccatcctggttaacacggtgaaaccccgtctccactaaaaagtacaaaaaaattagccagacgtggtggcaggcgcctgtgtcccagctgagacaggagaatgtcatgaacctgggaggtggagcttgcagtgagccgagatcacgccactgcactccagcctgggcgacagagtgagactccgtctcaaagaataaataaataaataaaagagaagaaatcagactcagttagtagatcgtgctggtctgtcatcatctactttgttcactcgttcgtttgtgtgttcattcctttgttcaataaacaagtaccagctgttggcctcctagtgccaggtgctatgccaggcttggagtgaaggtgaggactggttcaatatctccccagtccctttcactaaactttatagcaaatatattaatggatttctaccttgggaatctctctttaattttataggtgataccaacagagattttttttttttgattaatgatttttttgtttgtgttttcattatttggggatgctttttcctatttatatgaggaatatttgtacatgatgaatactgtgaacactgcaaaaagatttcccatgaatgaactcacaaatggaaactcagacgtggctggtctgtgttgcttgtcactgaaaactggactaagtcattatagcttttccttgtttgagggatcttttgcagttgctgaaactgctaaataaacacttcaatataagaaaattacaccttagcttaaaaaatattgttatttttggtttctgagagcagttatataaatttccttccaattcattgacattgttaggtagttgaactttttgtttgtttgtttgtttgagacagagtctcactctgttactcaggctggagtgtggtggcgcgatctcggctcactgcaacctccacctcccaggttcaagcgattctcctgcctcagcctcccgagtagctgggactacaggcatataccaccacgcctggctaatttttgtatttttagtagagacagggttttaccatgttggccagactggtctcaaactcctgacctcaggcgatccgcccaccttggcctcccaaagtgctgggattacaggcgtgagccaccttgcccagccaggtagttgaacttttgaacttaaccagtaaattactttttcatgtgtgcgctctactctggacaggagtttgcttttgctttgccttagagatgcccttacccacccacagagcctgagtgagctgatctgtgcatagacttagtattttccatgtttgataattgtatatattctctgttaattctgtttttgttttgtttgttttgttttggggacagggtcttgccctgtcgcccaggctgaagtgcagtggtgcagtcatggctcactgcagcctcaacctcctgggctcaagcgatcctcctaccttagcctcctaagtagttgagagtatagttgtgcccctgtagcaccaacatctggcttttttttttttttttaagatagattctttctatgttatccaggctggtcttgaattcctggggtcaaaggatcctgccaaagtgctgggattacaggcatgagccactgcgcgcagccatgcttgcaaattcttaagtctttaaaaacagcagtctttggtcttttagacacacttagatgttttgagattatctgtgtacttattgttttgttaaaaaaacaaaaaaccatgaaaacccatcctgaagttttagtttgcctgccctctgggacagctattctcaaggcatggtctgtggactgccgggagtctacaagaccagagggtctttaaggccaaaccacttttcatggtagtacttagatgcttttgttgttttcactgttgacagttgcccgaatggtgcaaaagcagaggtggacgaaactgcttgtgtcttggtgtgagtcaaggcagtggcacagccactagcggccgtcctgatcttcccctcccaccaagtgcagtaataaaggaaaagagtcagtttcacttgagagtggccttgatgaagcagtattaatgtcattaaaccctgactgtgctgcagggattcttgtctgagcaatgggccgcctactttctggtaatttttgagaatattaaaaaaaccttactttttattactttttaaaaatattctttgtaataaaatgagaagtatggataaagtgcctctggacactgagagatcattatttttcaggaaaaaaaatcttttttttttttttttgagtaatgaatggaactagccactattttcatggaacatcacttttacttagtttaattaattaatttacttaagactgggtcttgttccatcacccaggctggagtgcagtggcacgatcactgctcactgcagccttgacttcctgagctcaggtgatcctcccacctcagcctcccaaggcacacaccaccacatccagttgatttttgtatttttgggagagacagtgtttctccatattggccaggctggtttcgaactcctgagctcaagtcgtccaccaggcttggccttctgaagtgctgggattacaagcgtgagccactgcacctggcctatttttaaaatttctatttatttatttacttttgcacttttacttaaaagagcgactgacaaatcagtttttcagacttgggcatttgtcagacgttttctttaaaatgaataaagttaaggtgtcacttcaagggaaataaccctgagtatttgtcctgagccccaggtttgtgaacatctgcccttggaaaatgggagagtccacactaggagctgcagggacccatttgccccacaaacttctgcaggggtttatgtctgagctatgtgccacctgctttctggtgtccttcctttgtgaatttcccaagcgcttttgacttactttagtagcgagatggctgtgttctgggtttgggttagtagtttcatgaagatacaccacccttcctcttcctctgatctgtaagagataggaaaaaaccaaagtgtttttcctattctaatccagatcacttcctccatggtctctaaaacgtgaggatttctccacaccagcagccaatccgttccccagcagataccagccattagagatgggaagaaccgaggcgttcttcctactctgatgcaccactcaacacaacacttcagataccagatatgtggagattctgcaccccccacaacacacacaccaagcaattctccagcagacaccagctgtgtagttcagttcagttctgacgctgcccacctggcagtagtgtcagatcccacaagttaagggctcagtcccaagagactactgcttctctcctcagatgccaacgtaaatcgccagattgtgacctgtgctcctgactgactgtctctaactttggcttcccatcaccccttctcaggctcagttcatctactagggcagctcacagaacttaggcaaatacttatatttgctgatttattataaaggatatttcaagggatacagatgaacagccagaaggaagagatgcacagtagggcatgtaggcaggggggtggagtatccatgccctttccagatgtgccagcctcctggcacctcagcaaccaggagcttgtctgttatgtagacatgattgattacatcattgaccattggtgatcaattcaacccgcagcctctctcccttccccagaggtcagagggtggggttgagagtttcagcctctaatcagatgattttcctggcaaccagccacctacgcatcaggagactattgaggagcccaccaagtgtcgcctcattagaacaaaagaagctcccattacccaacagattccaaaagattttgcagctctgtgtcagacactccggtctctcaggaaattacagagctcttatgagctctgtgttaggaactggggtcaaagattaagtatcagggctgggtgtggtggttcacgtcagtaatcccagcattttgggaggccaaggcaggcagatcactagaggtcaggagttcgaggtcagccttgccaacatggcaataccccgtctctactaaaaatacaaaaattagctgagcatggtggcaggcacctgtaatctcagctactggggaggctgaggcaggagaatcgcttgaaccaggaggcagaggttgcagtgagccaggattgcaccactgctctccagtctgggtgacagagtgagactgcatctcaaaaaaaaaaaaaaaagattaaatatgagaacgaaagatgcatataaatagatagggacgtaatttccctatctatttataagggtttcaggagctctacatcaggaactaaatgtataccagtgatatggtttggatctgcatccccacccacatctcataggaattgtgatccccagtgttggaggtggggtttggtgagaggtgattagatcatgggggtggatccttcaggaatggtttagccccatcaccttggtgctgtgagtgagttctcacgagatctggtcgtttaaaagtgtgtagcacctccctgctccctctttcttcctcctgcttctgccatggaaaatgcctccctcccgctttgccttctgccatgattgtaagttccctgaggcctccccagaaacgtgtcaccatgcttcctgtacggcctgtggaactgtgaagcaattaaacctcttttctgtataaattacccagtctcaggtatttccttatagcaatgagagaacagatgaatacaaccagaggccaaatacatatttcttattacacagcatcatactttgcttcacatgtgtataaccaaggatgtttttgcttgtcttatatggtatgaccagcttggcagtggatctaaccttttaggacttttgctactaactctgcttggtttctgtttgtgtgtgacaatgtgattcaagcagatgttatagtctggtgaacgccaggtgtactgtactggagaaaatagaaaaagtcaggggctggtttgatatcttgtggtcttcctgcatgtactatatgccaggagacttacttcatagtaagacatactatgaagccactagaaattgtttttaaagactagtttagtgacatgatgttaagaagagtggcaaggtacaaatgcctataaatagaccagaatgaaaatatacttaaatgtacctggagaaaaaggccagaaggaagtgcgccaacatgataacgtttatctctcggtgctcatagaatgagtagttttttttttctttatactcttccacattttccaaattttcacaaatgggcttggattacttttataatcagtaatttaaataaaccttttaaaagcacagcttgtctatatttcatagtaaagtctagataatctctgctgactttaaattcagcagtattatatacttaactatgattgagctaaaagatgctgtcattgaatttttaattttgatacgatgtccatttagaaaataagttagaacctcctttggactttttccctcagtgaacagcttatatcaaattagcatgaggttgattctgaattggctcacacttgaagtgaatgtcctttgtaattttcaaagtgatcagtgagggattagaagcttgctgtaaagtggcagtttacctacacttgctcagctgtaaattattaacttttggcccaaaggtagccctggaagtcctgagctattcattcaggagcacggtaggcagaggccaatgaccttaaaaccaaacggccagatttctaagcgcagtcttaaagcattcttctttgtttccacaaagatcaaagatatccttaaatcgatgttagagaaagcgttcaaagaagtgttcagcttcaaagaaaaaaaagtggtaagctttctagccctttccagctcgaagtgccctggggtctgttggtttctgggtaggttgggcgatagggactttgcctggttgccttttttgcgtctgcttcctcatctgtgaaatggggataacaacagtgcctgctcaaacttgttgggtggactgaatgaatccgtccatataaaatgcctggcacataagcactcatcagctgttgttataattaaggtcagtccttgaaaggcttaaagaaacctgggcaggaggctgctgtaagtgacaagccacccacactgtcaggctgcatgcattcccattcgttaggtgcctctttgggaattctggatactgactggcacacagtgggcattctgtaaatggtggttaaatggatgaatgaaccggtaagaccccctccctcactatgggtttctcttactcatctgtaactaattccaaagtctaccatcatgaaagagcctgcactgttgtcacctgcctctactgaggtggctgatagactagctgctgctggtgtctatcacacaggctacaggtcctggacccctgcaggatgggcaaccaccatcctgactggctgagagtggacacccaggaaaagatgggtgtgggccatgcagaaagctgcagcggaatggcattagtgcaactccacgtgtgtgcccgacgtgctggaacagggagagggaagcagaggcagcgtagtgtcagaagcgtacacaggcagaggtggctaggggagtggggagcatccatgtggccggcagctggggactgacaggcacagctggatcctctcccaccgtgtagccacctgcccaaactccactaagccttttcaaggactgaccttaattataacagctgatgaagcttattgtgtgctgggcattttacatagatgagttcagtcaatccacccaatagtctcaagcgggtgctgttgttatccctagtttagagatatcaaagaagttgaacaagccccatcacaggaaaaaggaggtgctgggatttgatccctggcagcctgactctgaagcctgtgtaaccttgtgcttcctcctcctgctggaaacatcctgttcctgtgtgtggactgcacaccccgggtgccagaaacctcactgtggattgtctgtctgagatctaccctgtccatgtgtcacagtattggaaaaggttctggaactctggcctttgtctcaaaaaaagttgggggtgggtgggcggtctcgctctgtcacctaggctggagtgcaatggcgcgatctcggctcactgcaacctccgcctcctgggttcaagtgattctcctgcctcagtctcctgagcagctgggactacaggtgccccctaccacgcccagctaatttttgtatttttggtagagatgggggttttgccatgttggccaggctggtctcaaactcctgagctcaagtgatccatttgcctcggcctcccaaagtgctggaattacaggtgtgagccaccgtgcccagcctggccttttttttttttaatacaataaaaagattaattgaaaattattaaatccatagcatagtttactgcagtttaccgtattgttcaatttaggtataattacagatacaggtgccctaataccacaaaactgtctggctagtgtgaactttggtccctaaagatctggtgaaatccctagccaggtgcagcagaggaatttgtctttgcctggattatcatctttggttcttactgtcctgtgttgcctctgtggcccatccattcctaggctgcaaggatggcttcaggccatttctgcttgtagagacttgcattctctctctggaattgctctaagcttagattttcagttgagcaaacactcatcacatgtacctgcagagagctcctgctgtctcttttctcagttgcataccaccccaggtaaggagggtccctctgcctccagtgtcactgcaaagcgacagctacctgttgcccattgcccaggctcacgtttggtcttttgtttggctgcctctcaggtagtggaaggtgaaacacaggacttttcctgatagagatagttattcctctgttgaaatccaatttaaatatcgttctcttcatggcaaaaaagagtcctagagttgctcaggccattctttggttcacagtccccaggatgcatgcaactgggatttttcttaaactacttacctcttttatttctatggtaactcccatgctaggaatacaaaacacaaatctgcacagcaatgttgcacactctctgttttattttccccaaattagccatgtttgagcgtggacctcttcatgggcagtgaggatcactcagcacacatttctgtaaactttttggtgcgcgtgggttttactgtcttctgttgaagctgtgtcccccatttggaaggacgtgcaggtgtgaaggaaggacagttcttgctgaaaaagatgggaatggcttgcagatgtctgtggattaagcagatctaaaagctatgagaaaactgcctacttgtgtgtgtgcgcgtatgtgtatagtaaatgtatatatgcatatattttatattgacattctgtagatatgtttgaatacagaaacttgtttttactccgactactgaatccagaagtaccaaataatatacagtaaacagtaaaaccaagatttaaggttgtgtcaaaaaggtacagtgattcagtcatatccatttgtcatttgttttagccttttttttttttttgagatggagtcttgctctgtcaccaggctggagtgcagtggcgcgatctcagctcactgcaacctctgcctcccgggctcaagcaattctcctgcctcagcctcctaagtagctgggacttacaggtgcatgtcaccacgcctggctaatttttgtatttttagtagagacggggtttcaccatattggccagggtggcctcgatctcctgacctcaagtgatcttccagccccagcctcctaaagtgcgggattataggcacgagccactgctcccagccggtttcagcgtttttctttgtttgtttgttttttaagagggagtctcactctgttgcccaggctggagtgcagtggcgcgatctcggctcactgcaagctccgccttctgtgttcacgccattctcctacctcagcctcctgtgtagctgggactacaggcgcccaccatcacgcccggctaatttttttttttttttgtatttttagtagagaaggggtttcaccgtgttagccagtatggtcttgatctcctgacctcgtgatcgcccacctcagcctcccaaagtgctgggattacaggcttgagccactgcacctggcctcagcattttttgagtgtttttctttctgcagttgatcagttggatcctccatatcttgcgtatatacatgggctcaattattatgttaggataatcaaataagaatactagttcaatgattagcactgagtggttgttaggcagtcatgtgctcaacactgatgtcacctctttctgtaagcatactgagtagagacattttttaggtttaaattgacttaaatgaaagtgaataaaaaggccttttcaaaagaatgggtttgaaaaacctcagtaccctttaatacatgtacatttctttcctttcttcatttaatataacatgtgtctgttgtaactgtgtttcttaaatgttattttaaggttatatgttctttaattatggtcaaatataatttggtcaccaaaaacgaaataatagtttaaaacaagtagctgttactaagggtgctaaaaatactcattttataattaatttttaaagttttcttagtatattataaattgtgccctggtcaagtacaaatgtacacatcaaaatgcccatattgtatctgtctttagtcacttgatgtgaattatatgtgaattttttttggttcaaagttttactaaccagaattaaacactccgcatgagaaaaacggcacaacacaatcttgaggtcccttctgaatcatcagattatattatgcttcatatgttaaagaaaaaagaaacctgcctactttattaaacttacaagtttaatagagtcttggagattgatgtcttggggcatgattgggaaagtctccaaggcataggtccatccatgtatttcttcatttattgacatcttgtgcccagcacttactgagccacagcaatgtgtagtaaacataatgcgtcctcagtcagtgtttgttgaaggggtaaacaaaccccattctgggttgtgttcttttttttttttttttttttttaaatatgagacggagtcttgctctgtcaccaggctggaatacagtggcgcaatctcggctcactgcagcctccgcctcctgagttcaagcgattcccctgcctcagcctcccaagtagctgggactgcagaagtatgccaccacgcccggctaattttgtatttttagtagagacggagtttcaccatgttggccaggatggtcttgatctcctgacctggtgatccacctgccttggcctcccaaagtgctaggatgacaggcgtgaaccaccacacctggccaggggacatgttcttaaagtttatgaagcatcagctttgtctaagctttagtcaagagtcagaactaatacagatggtcccaacttagcatggtttggcttaagatttttcaacttcatgacggtgtaaaagtgatagaaattcagtagaaattgtacttcaagtacctgtacgaccattctgtttttcatttttcagcacagcattcagtaaatacacaagatacttaacattttattatcaaataggctttgcatgagatgattttacccaactgtaggctcatgtaagtgttctgtggacggttaaggtaggctcggctacgatatggtgttaggtgtattaaatgcacgacaatactttcaatatatggtggtttttcgggatgtaacccattctaggttgaggagcatggagcatttgtagtcagagggaagaaaagacatttggaggattttgactggcgatttttatcattttgagaccagttttggactaagaagacagtcaaatcaatgttctcttttggcctgaagttttggaattcagtgatgtcgttgtcccctgcattcccctcctttgtggaatttcaaaacccccttcacataatgagagaaattaaccctgaagaaagaaaggactggaatttctactagcttgttgataatgcattattgttatgctgtcatgggaaacctgtcttcctaggttctaaattggtggatgactgtctggtgacggagtccaagcgtcattgcacaatgaagatgaaaaacgcatgttggatggctactccagtgaagttgaaaaatgcttgcctgataaaatgcttgcctgatggctactccagttgggcacatgcatactgccttctgcttttgctcaggaggaagataagtgaaactaaaggattttggttgagtaatttagagagagagtaaaaagattttggtgtttgtcatgggagttcacaggctcttctaatggaacagagaactgctttaggggccagtttcaggtttttgcctttctggaaggaaggggcagtcccttttccctttgaccacttacctctattgtcagtttgtgtaattatgtcagaactcagccacagcctctgttttttttttttttttttttatagctctatcaagtgattttcagctttatagggaaagatagctctgaaattttctttcttctttcttctcttctcttctcttctcttttctttctttttttgagacagagtcttactctattattcaggctggagtatagtggcaccatctcagctcactgcagcctccatctcccaggttcaagcaattctcctgcctcagcctcccaggtagctgggattacaggcacccgccaccaggcctggctaattttttttttttttttttcttttagtggagactgggtttcatcatgttggccaggcttgtctccaactcctggcctcaagtgatccacccgccttggcctcccaaagtgttgggattacaggtgtgaaccaccatgcctggccttgaaatttctttttctctactttttcctttttacccactgtttagtttgctagggctgctgtgacagagtaccacagactgggtagcttaaacagcagaagtttattttttcacaattctggtggctagatgtttaagatcaaggtgtcagcagggggttggttttgtctggagcttctctccttgcctcgtcgatgccatctcctccttgtatctttacgtggttttctctctgtccttgtttgtcataatctcttctcataaagatcccagtcctaccagattagggcccaccttaatgacctcatataaccctcttgcctttctaaaaggtcctatttccaaataaggtcacattctgagatactggggattgggactttaacatgagtgatttgaggggagactaacatgaatttttggggggtgaggttcagctcataacacccacttcactttttcgtagtacattggcagttctgtttcaagagctcagttaataattatttgatgtgtcatggattagaacatgaaacaggaattttgttttattcataaaactgtatccctagcacctagagcatagcgtaagccctcaataaatataggttggatattattggatgaatacatgtcatatctggaagaaggataaaggaatgccctgaagacatgttagtttcaaaatgttctaaaggcccagaagggcagtgaggattttcactggcttcagggctctgtgcaataatatagaaatagagaatctcacactgaagccagtcaacaggaccaacttcttttagccagtcctgtctttccagcagcatcatgcaatctaggacataagagagcccgtgtcaaaccatttttatataccgtgacactcttatttttaacacagtggttggattatttataagcaatcttggattcattcaataaccacaggtagatagtgctctcacctcattaaagcattattgcaggccgggcatggtggctcacacctgtaatcctagcgctttgggaggctgaggcaggtggatcgcctgaggtcaggagttcgagaccagcctggccaacatggtgaaaccccgtctctactaaaaatagaaaaattagctgagcatagtggcaggcacctgtaatcctagctactcgggaggctgaggcaggagaatcgcttgaaccagggaggtggaggttgcagtgagcccagatcacgccattgcactccagcctgggtgataaaagcgagaccttgtctcaaaaaaaaaaagtattattgcagagaaggaggtactcttagaactctggactctgttagcaaaagcgttggggattgatagtgatttaattttattcatgatgctgagagagtctcaccggaatgcagcgaggattttgcccctcatgtcatcaagctggtagtactttgttttatgcccggtttcttgtctgatgcaaccttttatgcaccatagtgaaaagttgtgcttaacatgtttatgatcccatatttggaaatcttgccttatttggattttgcaggtttgatagtttgataattcagagaggttggactcaaatttttatctataaacaagggatttactaacaatagtttggaatgatatgactaagaaagatgttcattacttacagatctctttagaagcatcatttacatacaataattacctgactcagaagaaagtcccctagggaagtcatctgacagtcctggtcactgtctgtgctttaaagctggctgttactgaagcctttaatgcatactgtttttcttcccaggtaatctgcaatagtaattatggtttagttgagtggcctcccccagttgagaaacacaatcataccatgcagtaaaaaatatttaaagcacacttatagttctagaactttgcatggataactctaattagtctgggagcgcttccctggagccgaatgtgtttaagaattcaatcttttaagtgccggtgatgtcagtttggagacagcagtatgtggctccattccaccgtgaatcctttgctagctgcagtgtactttagctaatagaatcaagtgcttgtcttcaagttttttaagagcataaaaaccctgtttattaaaacaattctctttggcactttgcagcattatgataatgctgtcttagcagaagtgtagagagctgtgaactcctagggggaggctctggaggaggaccattctttcccattgtatttcttcgggacaagcatcatttctttccttagtcaaaggctttgtctcagcttgcacttcacgttttgaatatctttctggagaaaagcaacagcaagtattctggatattacgcatgatgatggttttctttgatgcctatctaatataaactcccattctcctggaacctcacatattttaaaaaatattacttgaggctgggcccggtggctcacgcctgtaatcccagcactttgggaggccgaggctggtggatcacttgaggccaggagttcaagaccagcctgggcaacatgttgaaactctactaaaaataaaaaaatcagccaggcatgatggcggcatctgtaatcccagctacttgggaggctgaggcatgagaattgcttgaacccaggaggcagagattgcactgacctgagatggcaccactgcactatagccgaggcagcagagcacgaccctgtctcaaacacacacacacacacacacacacacacacatctttgaagtaagttactgatagggatggaagtcttccaaatctggaaaaatcaatgtatgaaagatccataaatattctgaatttgtcttaatgtgtctatgcacaatgtaaggaatgcattgataggtttctgtgctgttccccccacccccaccgccttttttttgtgacagagtcttgctgtgacacccaggctggaatgcagtggcatgatctgggctcattgcagcctcaaccacccgggctcaagcgattctcccgcctcagcctcccgagtagctgggactacagtcctgcaccaccgtgcctggctaatttttttttgtgtgtgtatttttttagtagagatggggttttactgtgttgcccaggctggtctcgaactcctgggctccagcgatccaccctccttggcctcccaatgtgttgggattacaggcatgatccaccgtgcccagcctgtatactgttgctatatagaagagtctagtaaagtctggctcatatttgaacattcaagaaatagtcgttggtcctgtcgctcccagaagctgcacaatttttgagtaaacgtagccaaagttttcagaatcactgaatgctgctagttcttttcttttcgtgattaattcagacaggccgcatccctgcgagacccttcttctcccacctccaccaacatccacagacctctccctccaaggctacaaccaccgagccctctgacagatttgatcgcactgctcaggcttactgtcctcactttgttctgtgtgtggtttggtatttttctgtcctgcccacccaggccaggccttccccacggtgctgtgatagagtattgttatttgttgcttattgtctggagaaaatctctcaattccatatcaaactgttgtttgaggccttttgttttcattgtcaaatgtgtcgggtggcagtctcatgaaaaaaatcacatttgaaggtatattcataatacctggtaggaagagaaaaataatggtgttcctgtgacctgtttacctgattctgaaactaaacagtgttgcatggaaagcgattttagcgatcttagaaaagaatgtgttgtgtcttttttttggaaacccagcgattcagttagcatattatttgtttgcgtgtatcttaccctttcaagaactctaaggtatgtgcgacatggtaaccccaatgcaaacggcattaaattgtggaagcaggaatggtgttaaaaggattcttagaggtggtgccggttaggaggaggaaggaagccgttgcatgccaggtatggtgtcaccacacatatttcgtcctggtagtgatcctgtgaattaccctccgtgaccatgctttgtggttgagcacagtgagtccctgtctgggcaagggatgatgtagcagcaaatggccgagctggctaggagtcacacccaggcctcctttgtctacgttggattactttttctgtgtctaccagcattagaaaatgagaaaagtgtcattatttgcaggaacatagggcatttcaggttaggaaggaagcaagagtgaaagtctaggatagaggtgaacatgaaccaggatattcggggaacgatgatcagacagtccagctggagtggggagtgctggtgtagggtggggaaggaaaggttggcaagaagtcacgcccttctgcccgactgaggaattggttttcatcatctataggaacttttgtaagtttttgaggagaaacactagtgagtgacaacttgggagtggtgtttgaccataaaggttaggcagcctgtgttgtgcaaagtgattatacaggagcaagatttcaggttgtgtcaatggtccagggaggcggagtaaacagacaggaagacaggaaggagtaagtgaaacgttaaaagatttgggtggttgcagaggggaggtggtttgaggaggaagattattgtagcaccatctgctggcaccagtactatctacaccagagccattcctcttcctgtgctgcaagaacccccgttttgttcaactgtccaacccttgcccttgtaacttgggtaaatcctgactgctttgagacagtcgtgggaatacccttcaagggtgggcatgtgattcctgttagtgagcaggtaacttctgagaaaggtttctttaccctaaaaagggacacaaagaagaggttgtttcagctgctgctggatgttgccatgcgtgcatgtatctcctggagcagtggcagccatcctgtgaccatgaggaaagctggcagaaggaaacaggaacttcgtaggtggttgagtggctaaattaattaaccctggggttttcctgcctcagacctttttgtaagattattaacctttattgtttaaggcaggggttggcaaactatggtccatgagacaccagccacttaaaaaaaaattttttttttaatttttaagagacgaggtcttgctctgtcttccaggagcatagtggtgcagtcttggctcactgcaacctccacctcccgggctcaagtgatcctcccacctcagcctcctaagtagctgggactacaggtgtgtgccaccatgtctggctaatttttgtatttctcgtagagacgaggttttgccatgttacccaggctggttttgaactcctaagctcaggcaatccacccgccttggcctcccaaagtgctgggatcataggcatgcaccaccatgcctggcctcacttgttttttgtaaataaagttttattggcatgcagcaatgtcatattgtctgtggctgcttttgcattgcagtggtggaattgagtagttatgaaagagagacagtatggttcacaaagccttaaatatttgctatctggtcttttagagaaaaagtttgttcacttctggtctaagccattttgagttaggttttctgtttatttgtagccaaagcctgtttaagatgctggccttgttttgtacctcttaactggagattgtcctgtaggcaagggctttctagagctgttgtgctgtcaggactgaagatgtgcatttgggattcactttcatatcacagaaagcagttaagaaagagtttctaagtatggggggatttataacatcaagtgcagatttgttgcaatttcaatgtggtggtgaaaagccaagatggcaggtgcttaaaaagggaatgagtgggaagatcaatttattggcataaattaaaagaaatgtttcagatatttcacctgagaacctaggatgcatcttgatggtcctagattatgaaagttaatgtttaatctgacttgctccaaacgaggacaaagttaggcaaaaatgcatcccatgtaacttgtttttgtggcctctgtgattcctcctcctgacctctgctgtgctggtactgagcaaagacttaaggtatatatgagaccctcatgtataatggtttgactgatagccccttacttgtatgatttttttctcatcgtaaatggtgcttttacacagtaattgcccgactcacgtgattcacttcgattccactctctgtggctgatgttgcatgaaggttgtaggcactgctgtgccagagtcaacagggataaagaaacctgatagattgatttgatggcagggatgtgtgattagagaaggtcgaatccataggcctttgcaggaagcagggattccagcaccgatatcgagctgtcttcaaaatactaatgaacaggtgagatgtcaaaggaagacagcatgaaccaaagatgatttatttgatcacttcagggggaataaaaccagttgaaatcacattagaattcaagggaaactgcacaagacatttcaagaaagttgaaaaagatagtccagaaaagttaagctgaaaaatttttctttctttttttttttttttgagatagaatctcgctctgtcacccaggctagagtgcagtggcacaatcttggctcactgcaaccttcacctcctgggtttaagcaattctcctgcttcagcctcccgagaagctgggactacagtcatgtatcaccatgcccagctaatttttatatttttggtagagatgggttttcactatgttgctcaggctggtctcgaactcctgacctcaagtgatccgcccactctggcctcccaaattgccgggattataggtgtgagccaccgcgcccagcctgaaaatcttgaaggagaaggctgctactccttgcctgctgcagatacttaattttgatgaaatagagagtaaaggatcattgaaggagtcactgtaaatttaaactcgtacttaagcatatactacctgaagacgtttaagagccattaatgtacatgaaagtattaggtaaagtttgagataaattgtcttatttttaaatgtagttggaagatctttgggggtgataaagaacaccttttttgtcagcaggagatttctttttgtggtagtttttcacgctcttccgccagatccaaacttcttgagagtgtggactgtgtctggttttgttcagctaaaatctgacatagtgcttggtatctagtagatgcttcataaatatgtgttaaataaatgtgctttactcctaattttataagacttgtgttaaggctgcttcagtagtcaagctccgcatagtagaaacatcttccaaaatgaagattgacaacttagctttaatatcgttgggtttcatgaacgtaatacatgtgtctgaatgcatacatggggttttactttcttttcatgatgggttttgatatatttaacgtttgaaattgatttttagaaacagaacctcagtctgtaccattacagctctgggaagtgagagttttctacttcactgtggtttgatttgtgattatcatttaataaccagttagtagtgaggggttgcatgtacattgcatggaatattagggctgggaagagatttagtgatagttgcatctagtccatttttttttccaaatgaggaaactgaggtaacttcctcacctaaggtccaactgctgattcttttcatagagggaagctaccgcctatctggttccttctctcctcactgccctatcctccctgcccccaatcctgcctgtacctccctgcaaaatttaggcaaaggtagagtccatcttcatgagagtatacattgggtaagagaattaatgtgacggataggaagaagttactataggaatgctgggagtggtggtttatgtagttctctgattgctttaagaccttttactgaagtgaaacctttattcttagcagatttgggttcatggatgtaagcatctgcttaggcttgtgaccagcatctctgtggtctgtgtgatagaatactgcttttctctgcacccttcaaggactcctgagctacacactctttatatgatagagaaaattatagatgtacttatctgttgggtggttctggatgaaagttccgttttctttgtctgcacagcccctgatgagctcttccctgctctgctgggaactggccctcatcctccttttccatcaaggttcctcttcaggctttgagcggatccatgcggagagagaacagtctcccgcctttccccatttcaagtccctggagcctctaggctctggggggcaacaccgaatacagggggcagagtgtggtgcccatccggcatcatcagcttttgcagcctcagcccccagctgactacagggacacctctgccatgcctcctttcccagggccatggctccggaagagccagtatctggagtcatggccctgggaccagaggcatgacagaggtctccctgtagtcaaaacctgtgcttgggttcgtggtaagccatctgaggcatctgctgtgttcctcccctattcttaaggggtggtctctctctctcagggttgaagcctaaatctggggcatgggtctgatgcaggtccttagggggccagccctgtggtgcactgagccacaaagaggttccagattgaaacccttacagatcttcctccattagtgcttgattttcattcatggtgcagagaacttgcaggacaaggttcatttgcccttctctaccattcctcctttgcctttgtccacatagatgaggagcaaggtggccttcaggagactttctggggcactaggaaatggccaagtgataggatgcagagttgaagacggctgttttaggccagggctcccagcactgtagcttgattactgctgattacttcagttcctccaaccaatcctttaccttccatgcagagaggaaaagtcccacttactgactggcagagggctttccaaggaaatcacaggccccaaggaaaagtggagtgttaatttgcttcatggggtgaaactgctttctgaaagcatggtttgggcctccagtttgtaataaaatcacagccagcccttattgttcacactggaaaatttattcttgtttgtgtaccactaatgactagctttcagaatgcttactttcttctcataattgtccactaatttactgtccttctgatgggaagaataacaatgtatttgaagttccttgggctactgggtttattgtttttgatacttttagatatttcaaacatggaccttttacgtgctttatgttgcgcaatattcatatttattagggctatttaatagcgatgcaaatgagttcagtgcagctgtgccggacaatagtcatggaaatgaattcatcttgttgcttttttcttttcttgggtcattctgatcttttcatacttttcttaatggaacaagcacgtttcttcaggaaaggtggcctcatgttttcatttgtctgcaggacaaataatttgagtttcatttcttcctgtggctcatgatccaaattggtcagaataaagttggttgcatcagaaatattgcagaagtttagtctctgctctccagaggttggctgagaaagcttcactctgggtagctgtcgcttcccctctgcgctccagcaaagtccatgctcatcagtgacacacatgcccttcccctccattgtattactcttaaattccttctgaaactaagaatttagcactaaatggaattgattcctgagttggacacattagtagttcaaccctggttgccagctctgtccctcttccgcacatcatttgcagcttttaatcttcactgaaagccaataattaagtatagcagaattatgtctgaagcaaggccaaattggcactgggtaaacctgaggacccgtcccatggaaaaccagtaataatttccccccgcatcctaattcttttttcatttcaaatcagcatttccaaagcactttcaagaccgttccctttttttatccttaggctgaaacatgccctgaaaggaaggggagaatgttttagtgactcatattcaagaaagagaacattgccaaaaatttgcaacaacaaggtaaatttattactcatgcaagtaagaagcagagctctcttcagtggcagctttcctcagcaaagctgggagccgatcttgtttaggatcttgggaagcgtgaagttcgaggctggtcaggctttgagaggtgggagtgagaggtcattagcagggtccttggatgagtgccttgttgatcagctgttgacaaaagcatggggatgtcagaagcccgtgtactggttctgagctgtcattgattcttaaactggtagtttcttgttaccatgactacagatcattcccccacctttacttcccccaagcacactcttcctccacatacgctttttgatgttttctcagacaaagcttcaggagagaccctcagggagaatcttccctgtggtgattaatcttcctccctgataatattttattttcagggggtctgattttcatttgcattaaatatgtgagaaaactacggcttagggaggtcatggggcttttctaagttcctgtatttggccagttggagaacctaggccttgtcacttcttgagatcttaagagtcttgatgccagggactgggccttattcttgtgagtttctttggtattttgcatgtagtaggtctgtagttgctgtttgttgattgaataagtgataccaccagtgcactgagcaggtcagattttgtttctaagtcagcacaggacccatcagtactgataaagccccaaaacccccacctttgcagtcagcctattgtgtatttggttggagcaaaagtaattgtggtttttgctatttttttaatgggaaaaactgcaattacttttgtaccaacctaagacctttcagtaagtgagagggcagcttgtgaagccaggctctttgtgaggtgtgagctactgaaggttaagtgtccaaaactagactctgatgtgtgcagttagccggggggaaggaggtagttcagaaaaccagaaggtggcagctagaattaataatccctgcctcctagtttggatataccctcactgcctttttttaaaagcaagaactctagagattaagtgttccaatagctgggatgcttttggaaggccgtgtatacctcagtgtatgtgttcccagtagtgtgtgccctggaggaaaccccagggcccagagcttccctgcagccccggccccagctctggccccggccctggccctggtcctggccctggaggcatcttctaatgaaattacctccactgaagtttcctataaacatagtcaagagcagcctctctccctgctgagctattgcagatccctcccacttcctcttctgctctcctttctctgaaacaccaagtgaggatgcgtgtttgcttgtttatggatggagtagctaaaggagcagggatggagcttgagttcctccagctcagaagttgatctgaggagtttttttcatttttgttttttatggagacagagtcttgctctgtcacccaggctggagtgcagtggtgttctctcagctcactgcaacctctgcctcccgggttcaagcaattctcaggccacagcctcccgagtagctgggactacaggcacccgtcaccacgccctgcccattttttatattttagtagagactgggtttcaccatgttgcccacgctggtctcgaactcctgagctcaaatcatccacccatcttggcctcccaaagtgttgggattataggtgtgagccactgcacccagtccacctgaggagtttctgaaacatctcactcaaacctccagcagtgaggcctgggcacctggttgttaactgagtttccctgaggaccctcagtcttcctcattagtaggccttgccctggtcaggcttcctcagtttgtggatggagcaggtagggcgcacggaggtgaatctcctgagccaggagcagcagagccaggatggaccctgacttctagcttccctcagcctgagctctttctctcctgccacactcttcttgggcctcttgctgtcaccctgggcttgtcaggtgccagcaggaactcttgggcaaatgggtcctatttctgcttgagtcttgaggtttggagcagcttaactgggagagaaggcagcatcctttaatgggggctggcagtttaatgccatcaaggggtaggatgggagtgtgaatggaagacagcccgtcttcattagactttacaatgtggcttatcaagtgcagtgtttgaagaccttgtgaagacatcatgagcctcacagtgctaagagggacctgaatgaaaggaaaacaatggctttcaatgatgatttgggaaacatggatgatgcactgatctgagcttatagatcctgtccttgggtgaacagggagaggtcagaaacaggaggatgcttaattcattccagccaccgctgctggagttgttttagcaaagctccccatttctgtagttggtgctggcattttgacgatttccccctttgctatggtgatctggaagcacagagccagatgtgtagctgcttctttgttcctaggcacacgccttttttccccgaatgtggccttggagtcagattgcccaggttcaaactttggttcctcggcttgttagctgcatggcctagacagcttgcttaacttctcttgcctgggttagaatgatagcaccccagcagtcctaataacaattcctgggctacagtatttactacctaccttgtggggttattatgaggaacaagtacaatcataacatcaagggctgagagccttcctagaacacagtaactatcccattaatgttcacagaactatcaccactcatgaaatcctagcttgaatatttacattagtcttgtttctcaaacttgactctttggtttgatcgacattttccctaatgctgattttcacctttatttctactttgctgtttgtattcttgggagtaacctttgatgtatgaatgaaataaataaattcaaatgccaggcttttaccatggggtctaatgtgcttgaaatcagaatgcaatagacgcttttgctaagcttgagggcaaagaggggctagtgctgcatccaggggtttcagcctggggactgcgtcctggccctctctgtccaatgccttcctgattctcccccacttaagttgctatcacagtaccttgctagaccaactaactagcacagtttgagacttttctttccttgctctgacttctttgtaagtgcagcttatgttgtcagaaagctcaaaatgttgtgacaataaggctgcagtcccgtgcagccggcgttttgtcgtgtgggtgtgatggtgcttgtgtgctgtgttcttattggcaatcgcgagacgcactcacggaatcacagatgccgcctacaaaaggtatctataaggtatctatgttccataaaagcaggtagcctgtttacttagccctggactaggcctctgggagggaggagggagaggtgggtgtgtgcaaatttggtggggagaaaaagtgttatataaaattgggaagatataaagcactgacaaaaagaaatgtgaaaagatgtgtttaaaacaatgcgcatgaagtgcgaagtctatggggcggttctgatgagcaagcatggaggactttttgggggaggggggtggtcttaagctgtgtcttaaagccaaaaaatgtgaagagaggtttccagatagagaggatgccatgagttaagtggatgcaggcatagcgctaagaataaaggagattgcgtgtttgacatgaccatcgtgaaggacccatgctctgttgaacctagtagtgaggttaggattggagaggccaagttacaggataaggaaagtagctttgtcatcatgggcaagaggaaaccactgcagcttctgagtggatccatggtgcaaatgggtggaaactggtgatggctggcaggggaaaaggggggtcccattttcaggcattatggagaaaagttaccaggatttgttcaataattggatggtaaagaaaaagagtgaagaaaaataattccaagtcttcagtgcttgagaatcaagaggttggatggcattgatgttgaatgaaaatcttgtgaaagctggagatgaatgacttagcagggggaagtcttagcactcttcaagagaggagaggcagtatgtccctgaagtttggattctggactctgcaatcatctgggtcaaaccccggttctaccagtcattagcttttgcaaccttgaccaaatgaacctctgtctgttttccccatttatgagggtgaaaatagcacctacctcagaaggtggtggcgaggattaagtgagagaacacacgtgaaatggttagaacagtgcctggcgtgtggtaagtacccactgaatgccagtgcttttattacggtgaatattcattgtattgaaagtcagacataggtgtggaaccagttatgggagtgaggataagtctagatttgggaatcagtcgcagagaggtggacgatgaaagtctgagaagaaaggatcttgctaatggagtgaactcagagcttgataaagggaggatgagtggaaatggagctcaacgctgtgccttgggaaatacctctgtggattggtgggagcacagtgagaaattcaagaaagacacagacaatggaataaccagagaattaggaggcaaatcgagagactgtgttgtcatgggaaccgaggaaggagaattttttttaaagatgtcgtataagtcagatacaatgagaattaagtgaaaattgaggctaacataatgtaccactgattaggcttgaatattattaaacatgctagagccgttcagctgtgggatgattgagaagccagagtttatgggatatgggaaccgtgatgggagattataggaaaaagatggagtggtgcttagaagaggcagcagagcaaacgaagccaggagttaagaatttaaaagctatacaaagagaactaatagagggcaagaaattagaaatacaaatgcaggcaggaatgcatgtgggagaccaggtagggagttggcagcatggggaacacagaggagaaaggccctgctgagcaggtggagaggaccttttttggcaaacaatggtgggcagatgtgtgcagtggtggagaaatctggatccaggggaaggcacaggctgagaacaggttttctccatcataataaatatctgcctgtgactggtataaatgtcgatgcttctcaaaccttaagaaacttccagcattttgttttgtttttcaaatgataagtttcttattcatactgcttctaagcattgggaaagaagtaactcagggagttttaaaaagcttttattttaaagaggtcttgtctcccaggaaacataacttttggaaacagtttacaaagaatttgctttttctcactgacagatagggtgtcttttggtgggagcagagccccagagccagaggacctgcctgcttgcttggcagtcccccgagcagacacaatttaggaacaggaaaccctagagaaacctgagtcaggatgctgtgggtcccagaagcaactgggtagttgtttcaagtttcctttttttttttgagcggggggtgggtggggcgggggcggcttcaaactggagattagcaaaaatgagttggatatttccttagacagttcaaaccctcataggtgaactcatctccgtctctgtttctgcttagttttctgcacatcctttctaagaactcacttatgtctataaataccttttaacaggttctcttcatatttggataccaggagtaaataagtgattttgcaagtatactcaaggattctggactaggtgctactgtgccctttatacagtctggtggggtttggggggtgggtgtgtgtggaaaagagaaactcccaaaccctcaaagaggatggggaacaatgtcctgaaagaacagggctcaggcagcagaagagctgaggggtctctgttctgaacgggtcccccttctccctgcccttcatcttgtgtgactgcggttgagaaagacctgcaggattaaaggatctggtgaccttgggaccccgcacttgcttggcagtgacagtcctgaggaactgtattctttcagttcctctatcagcaaagcagctcagtaggtaaagggcgaattccggcatttcagtgtctcttgccatgggtagctctcatatttccagttgatgatgtctggacacgtgcccttgtgaaatgagttgagtggtgtgagattgggagcccaaacctgtgaacacccaactgggctttttcctggccataaaaagctcgaataatggagagctttaggaaacaagttgtttgaaaactctgttgagttggctttgagcattcgtggaacattatttttaagaaccggttatttcatttaaaacagagtaaaaagagaagatgattgtattagtctgttctcatattgctgcaaagatactacctgagaccaggtactttataaaggaaagaggtttaattgattcatggttctgcatggctggggaggcctcaggaaactcacaatcatggtggaaggggaagcaaacatgtccttctttacagcgcagcaggaaggagaatgaacgagtgctcagtgaagggggaagccccttataaaaccatcagctcttgtgagaaactaactctcacgagaacaggatgggggatactgccccccatgattcaattatctctgcctagtccctcctacgacatgtggggattatgggaactacaattcaagatgaaatttgggtggggacacagccaaaccatatcagtgattgaggggagaacagggaatgaaacatcccctctcaacagtggtaggaataatggcctgtcatcattattgtcagcagtaactgacatttcttgaagacctcagtgcataaggcactgtactgagcgctttatattctgtgtcttgtttaatttcattcaaccctcccaacagcctgtactacattaaatactactgttacccacttttcttttctttcttttttttattgagacagagtcttgctttgttgtccaggctggagtgcagtggcacaatctcagctcactgcaacctccgcctcccaggttcaagtgactcttctgcctcagcctcccgagtagctgggactacaggtgtgcaccaccatacctggctaatttttgtattttttagtagagacagggtttcagcatattggccaggctggtctcgaactcctgaccttgtgatctgcctgccttgccctcccgaagtgctgggattacaggcatgagccatcgtgcccggccttttacccacattatacaggtgaaaaaaattatgttgctctaccatttccacaaatggcataggctggcctattactgtccttttccaaaatacgtgtctctcaaatagctctgcagctcttacagggctcctcgttgtcctctgtgctttacagtttgagatccttcacgttggaggtttgtagaggaccacagttgcaaaatagggtgcctggggtctctgcttatctgcattttgtcaaaggatactataggtcatggcgcatggtcttttgctgatgttcgttttggcaagaagcactatttttcatcatttgccaagaaaaccttttgtgcattttaccttaaggacctggatagcataagcagagaaagggaatcagcatttccatgttttgaaaagtaaaacaagactctttttggtctttgcgcccccatgccctagaaatcccataataagtgcaactgtctccttctgctgatggatttcctaagtcattcccagaaagaagttgggtgctttgtattgtattaatatattcatcctaaataagggtcttggggttttccccccttccaagatgtattaagaaggttgcttactgtaggctttgatttatttatttcctatgaaatgccagaaacaccaagtcctaaaatcctagatccaagtcattgacttctcagtgattatgaccacattgaattgattaaactcaagtgactgacaaggcgaataaaaatagcccaaaatgagtccagaccccatggttttaagagccccccaccagttccctaaagctacaggacggaaaggactcctgatcctttgtacctgaagagtgtggtgcctaacgtatagccaatgttcatttgtttcttctctctgtattttataaacataattactttgaatgaattgggttattcgggaagtcagcacatgtctccatctcctgctttctatttctagagtcctaagatagactttgctgacaagaagaggcccctgccccttcagagcttagagtgtagcagagagatgggtattcaggaaatcctcaaatagtgacagagccacagcggcagtgagtgacaggcaggagaactataggatgctggaagtgcatacaaccggggtgttacctagtctgggactggtggtcaagggggcttttttgaggcctggacaacccacagaccgagggtgggctagtgagagccagtgagggacactcttcaagatcccagcacttaaaagattggttgggcatgatgactcaggccgggaaccccagcactttgggaggctgagatgggaggattgcttgagcccaggagtttgagaccagccctggcaacaccgtaagaccccatctcaatgaaaagtaaattagtcagggccgggtatggtggctcatgcctgtaatcccagcattttgggaggctgaggcgggtggattgcctgagcttaggagtttgagatcagcctggcaacatggtgaaccctgtctctactaaaaatacaaaaaattagccgggcgtggtagcaggcacctgtaatcccagctactcaagaggctgaggcatgagaattccttggacccgggagacggatgttgcattgagcccagatcgcggcactgcactccagcctgggagacaaagcgaaactctgtctccaaaaaaaaaaaaaaaaaaaaaaaaaagtaaattagctaggcatgatggtacgtgcctgtggtgccaagctcctcaggaggctgaggcagaaggatggcctgaggccaggagttcgagattgcagtgagctgtgatcacacctctgcattccagcttggacgacagaacaacgccctgtttccaaaaaaaaaaaaagattggggtgctcttaagctcacagttctggccatctcctctttcctaagtggagggagatcgtggatccctgagggggaacctacttcccctttcacttcaaagtctgcttctgtttctaaaaatgaactgaaaccccatctgtttgctcatgtatttgaaaacccttgaaaatgtttatttttgtacatcttcatacgactctcgtctcagagctgcttctcctcttcaggtggtttctgggcacactggggacgtctgtgcacctcctctgagtggaagtcaatgcctgtgatcccctttctaaaggaggcacggatagctgctgtgcggttttttcaacctgtagccagttttcatgtttttgttctcaaaataatactttttttttcaggtgaagacaaggaacatttaatttacactgaaatgatttttcctcttagaccttctgaaagctatgacgtatgtatatttataccataatagatgctaatggtgtcctctctgggtgatggtcccagagatgtttataccacggcatttcactccactaataaatgtgggtggatggatggacgggcggacagatggaaatatcacacaggactgtgcccaggttccagacagtttggctttagggccccaactctgccaagggatattttttatatagcatcatgtttttcatcatgatgttagtctctctctcttttttttttctttgagatggagtctcgctctgttgccaggtgtgagtgcagtggcacgatcttaactgactgtgacctctgcctcctggattcaagcgattctcctgcctcagcctcccaagtagctggggctacaggtgcctgccatgcctggctgattttttttttttttagttgagacagggtttcatactggccaggctggtcttgaactcctgacctcaagtgatccacccacccaggcctcccaaagtgctgggattacaggcgtgagccactgcacctgcctgtaacatcatgatgttacagtcccccagctcctcacctggcctccctgtacccattcctggccccctccctccttcaatctcttttccacttcagagagtgatctttagcattcccagctccaccccacgctttctgcctgtaatcatttaaaggcttcccattgcttctaggatgaagtccaggatccttaaactggcctacaaggccctgtatcatcagctgccctgcgtctccagccgcctctcctcatcacccacactttttcttcatagcctccatcccagctgtaatgcagaattttgtttgataattatttaattcatgttcacctctcccattagactgcaagcttagcgaggccaggggctgttttgttgtttacccttgaaccccaacccatagcacatgtaagtactcatttgtcaggtgtttgtgtttcatatccattttttgccttttcttacatacatggacacacttttctctcttttgagataacttccagaattgagtggttatgagcaattcctggatccctgtttgcctcagagccggtaactgttctcaccttttgggaaccataaacgctgccattgttgacctgaacacgaggtgactctggcaggagccctggccatcgtcccttttttggttatcatctgacgtttgtgcagctacacacatcatatctcatttgatctcttggactcccgttggttagtagaaaccttattttatagacaaacagctgaagctcagaggtgttcagaaacttttgccccatttgctgcaagtggtccatgagggtctggaatcaagaccttctggttctggtttgatgctgggactgctctttctgaattgtttctatgcctgtctgttcaatgttataatgatgagggggccagtccctcaccagctgcattctaactggaggctagaaaataatgaatgggaagtaacttaggggaaaactatgatgaggttgttggcatttgttactcttggaaagaagtgtagccttggaaactagaggctaagaaataaagtgaggcttcttagatgtcgttgtgtattaaacaggaagcccgtttgctctggctgtagagtgtgcccatgagagtttatggaagaatgaacttgactcaataaataacccactcagtgcatgatacccttttcttcagctgcaggtaaatgtctgttatggtgagtgacatggtggcatgttgggctctatgaaactgagtccacacacagcctgctgtgctgcctgccctgaaacgggacaggcccttggtaaatgacttgctactgaatggtagtcctcacgatgacatgtgtggcccatttaatgagagaagtaaagaccgcagaggatggaggaaagggcagggggagaagttagctaatattaaattcctgaccacccacacctaatgaaaaagaatgttctctgcttgcagaggcagtgaattaggctggcaaggtaccaagggaggaggaaaagtgtgtgaatggatacccgctacatctgagcacagacttaacccagaaacgcaggcggtcaggaaatctaatgatggcttcggacctgggcagacttgagttgagacctgtgccctccgcctcacgagcctcagaaggctgttgagtctttttctgagtctcagtttctcattctgtaattgggggatgataaggataaaacctgacaagataattgtgactcaaatgccagttcctagtactggtgttagcacaaagctgagtaaatactcatggattcaaaggcgcgagatgtcataccatccaagttatcaggaatgtgtttgctgagggctccctgggtgctgacctggctctacaggttctgaataaagagttgaacagggtctagttcctgtagtcaaggcacttcagatagagagaaactggcttgccaccaactctcatggaatcccagatgtgtgtgctttcatagttcaacgttctggaatccagaggtgtcttacatgatggcctgtcatagtttaatgggccgccttttatttcttggaggtacatctatgatggctgggggtgtggattctcagagacctatcgtcagatagttccttggagcaattctcagagctaggctgcttaaggcatatgagggctcaggactcagagccctccttctttatgaccttccagggaacatcccttttcctggagtgtaaaatactgcatgttatcaggtttgcagtttccttgagttagggtgggggtgtcacaaggcttatctttgaggctgaggttcagtggatttggagaagtgtgttggcaatgaatttcggggagaatcttcccctcgttgtctgcctgtgtaagagttaattttagcagttgtgattgtgaattatttgtcaaaagatactcccacttctgaagcccttgtttgcacctggtggagacaataaagcttctaagagcaaaatataattttcttccctgcttgtttcttttcttagcattttagaaaatcccactcagtttctagagttaacacctttccccactaatcagaacacaacacacaacacacacacactctcacacatacagactccctcactgaccttatgggccctttgctctgctaaacacataggtactggatggagtttgtagcaacatgtccctgccccgaatttgtcatccagatgtcgcctttggatgtcatgtccttgacattgacccagggtgggacttctgcagtcaaatgctctacccctgagctatcccccctacggtgggacttctgaataaagcctgtgtcactgtctctctggttcccttcagcgggagctctctgtggtttaatggagtctccacttgaccaggagtgtttccagatgagaaacccagggagggctgcaagcaaatgagagtgaaaactgagctctgtcccactccaaatggcatccgggattcacataccaaggctggctgggaacagctgatccaggctgatcctgacactggagagtccaagcattggaggccagaggccattcagaagaattacctcggagtagaaggcttcctaatgagcaataaggaggaactcccccattcttagggcacaggcctaattgaaaccatcctgggaagagaacatctaattaagtctgactcctcagaggactcaaatagttatatatgaagaaatgctaatctcgtggccttacttgtggctagggaacctgaggtgatgctcaggacagcaataccagcccttacggccttgctgtgtgtcctgggctgtgaacagtgcagaagtccctgtctgttcccgtgattttgacagaggatgccagaggcagaagtgctgctctttggtggtgtccttggtggtgttttcatctgtctacattagggttgggttcactttttttttttttcttcttttttttcttgagacagggtctggctctggctcaggctctgtccaggctggagtgcagtggcatgatcttggctcactgcaacctctgcctcccaggctcaagccatcctcccacctcagccttccaggtagctgggactacaggtgcgtgccactacacctggctaatttttgtattttctgtagagacagggttttgccgtgttgcccaggctggtctcaaactcctgagctcaagtgatccgtgcacctcggcctccctaagtgctgggattacaggcttgattccagccaaagtgcctggctgactctttgaattagaagttaaggtgagttttagaactctggtcttttctgtgatttgaaatgttgcctctggggaaggtgctgttttctagttttatgaaatgatagactctcttcccaacacacacacacacacacactcacacattcacactcacactcccacctcttgagaagaccacaggagctgtggagacagttgtccttggtgtggccagcctggttgtgggacatgggccttaaggtgcagcacccccattcaccttctccaggatggaaacaattttcttcttcctcattggccttgctcaagaaatatgccaggcattttcaatgtcttctgtccagacccagaaggatactcagactacttctgtttaaatggggcttgtttttcataagcagttgcattgttgatgtggctaaatttagacagaaccccatctagattgtggtcaagggctatgaatgctgcctccactgagcaccaggtgggcttgtacattttggtgactcattgctgcttgtgatgagaggggcctgcacacttaaacccctccaaggcagcactgccctgttcagtcttacctatgactcaacgtcaggaagctgaggaccccggtagcctctagaactgaggtgtacccctgggctgcagtggaagaggatcttggggccctagtgatcccctagatctaaaaagcaaagagacagcttagaggaatagaggatttggtcagggtatgtgtgtgttggaggggtcagggcagttattttcttgcactgaattctgagcataaaaacttctagcttgctttgctttttgtcacccagcgatttctaaagacagtacacttgtgtgttcaaatcccttttcacacctggagaaattcactcttgactcccttccagtgtaagaagtagtttagcatagttccggaaacgcttcgatatcaagccatcaaaagacagactgcgaagtcactccgagtgtaagagctctctgtatgtagaggaccagctttctgagaatgttttggcagggacttgaaaatgtcagtcatgtgtagacagggaagtgtcataccattaagatgtatacgggatggtgacagagtgagagaggccttggggttttgaaagaagggagtgatttttgtagtcccaattcattgtcctctgagtagctcttccctcagcctcttgcatgcgactttggctggtcggggatgccaggcgagttctgagccggagactcatggggagtcctcttgtgcagctgacaccttctggagacaccttcctcactcccaaaggcacggggccttagtgctttctgagtagccaccttggaccatcggttcagtaatttgaatagtaaaatgtgggatggcgttttcttgctaaagtgcagcttaactgggggagtgagttgttaaaagagcagggtggtagcatagatgacaggcgttcataaagcactgaatttagagatctggacctggactgtgctgctgaatgtggaaacctagactcagtgtgaccatctctaagctcctttgagcttctaggagtctgtcatcaaaggtggtttccaacagcctccagggccccctggccctttgtgctccatccccacctccgctcattccagtttcacctggggctatgtggctacctcctcacgtctaggctctcctccttctgagatgctctttctctttcttgtttactggagggcttggctaagaccaaacttgggtaccctgggcagaactagggactcctgtgcctcctttccagagcatcgtgtgtggaccctttttgtcgtgtagttatttggttatttttctgcttctgtcgggcagtgggtatcgacaggtaagactgccttatttgccttggtatctaggagcactcaaaagtgaatagattgaatggaattaaatccttgaaattacagtagaaagcttaggttctttagaatagaatcgtggtgaaagatggcctttgtgttctgtgtattctgtgccctttttccgctaacaagttgatatcgtgctgttattttgttttgttgataacatagtgtggactttgtacttctaaaccttaggaaaacgtggatcattagtcatttttgtcacattgcagtctgccctaataaacatagtattggaaaaacgagatctgttaaagggaatgatgaattttgctgccttggagcttgttgatacctgaaaattggtttcggaaatcgagacgcctgatggaagtttgtgtgtcgttttggctgcgttaggctcttcttgagccctattaggctcgatgccattaaactgctatgcgtaatgagggtgacacgttgcagtgaactcccatcctccaaaggcttttaaactttagaaacctgtgtatatgctgtgcctaccctttatagtatatattaaaataaagtcacacaaaaatccaagtttagtgattaaaataacattagaagtgcataattcacgttataaggaaagtctctcctttcagaagaattcactgtggctttccctgactcttgacatatgatttgatttacaccaaaccaaaaaaaattcagcaacatcacacatccctttaagcaatcaatgaaaatgctcattcagttttacccctcaaaatgtgctttagataagtgagtctaatggtatcaaataatgcctctgtggacaggcataagtgagattctggcaaaaaaaaaaaaatctaaaagttttttaaacttattgaatctgtcagtcttgctcaacttttttttgtagtattcatagtattttgaagagagtaggtccagctttgaaaaactctaaacttaaaaaaaaaaaaaaaaaaaggtggccaggtgaggtggctcatgcctgtaatcctagcactttggaatgctgaggtgggaggattgcttgagcccacaatttccagatcagcctgggcaacatagtgagtccctgtctgtacaaaaaatgaattaaaaaaatagctgggtgtggtggcatgtgcctgtaggcctagctacttgggaggctgagctgggaggattgcttgagcccaggagatggaagtggtagtgagcagcgatagcaccactgcactccagcctgggcaacagcaagaccctatttcaaaaaaacaaaacaaaacaaaacaaaagcaaaaaaagcatgagctttaaagtgaatggataggtagagagattgaggaattttttggtaactccttagctatattgcctttaaaaaaaaaagtgtgtatattactttcagcaaaattatttcagcaaataagtataacactgctcttgtttatattctttcaattgaacctcgctgcccaaccagtagtacatcctcagccttttttcctctccccagatagctcatcttcacgatccctagcacagcactaaatgcaaacaaaatgtccttacatgtgagtcaagtacagtttagtctggagaaaaggcccctgtgtctgaagctgttccttctatgagccaaacatcaagtgttcaagtcagagggactacacagaccaggacagggggctggcttccagggctgaggttgttgctgtaattgtttttgggtgtgcacctgcagcgcctgtgtaaaggtggagacagtggtgggaggagtgaaatctcccaccgtggttggatgctggacgaacggcctcaggtgtaggcagcttttttgttgttgtttttttgtttgttttgttttgttctgccatgcgcttcagtttggaagcagcctatattgtacacgttgattactttgaagaagtgatttcttattttgcttcatgttcattttcaaggaggtataccttggggagtgggagtgttttttgtttttgttttttttttaagcattgtttatagccacaatagaatgtcattggaaagagtggaggctttggaattacatttttatcccatactaactgggtgacctttgacaagatcgttaactcatactgagtggagttcctgtttcatgctgggaatcatgctgggacctcaaagacctcctgttctggagagagagatgctcatcgggggccagcagagccaagttcacaggacagagcagggatgccccagccagtctgcaagaattggaacagcttggtggaagagagacacagtccctcttagtcacagtctccttgtctggaagtaggggcaatggtaccgcagaggggtggtactgagtgctaagtaaaacgagttagaaatgcctttcacagagtctgatgaatgaacgtgggtccccatctttggtacctgaagacggccatgtcccacaggtgtgtggtcagagggtgcacagttcacagaaggcctccacagtgaggtgggatgcaggtggaaagagaagtcccaggaaaagggaggcaggggaggaaacagaaagctgcggttggaagaagacctcagcacaggtgcactttttctcttgtggattagttattaccggatgactttcatccacacacttaacactctctttgcagggacagttttggggaagggtaggcgtctgctttcacagaaggtaattaccgcaaaagctggtaccagctcatgctgttctgatgttttggttacgcaatcatgggcccctgtactagtacatttgtcttcataagctgtgctgaattattttttaaaaccgctaactgatgcgattagtaaaacattttggtttttaacttttgatgaaaatagcactgtttggaactgtgatgcaggggtttactgctgagtgaagttctagaattttgctgaaagtaacatgacctgctctgtgggtctcactctgtctctctgttaagattgttgagtgaatggaagaaaaggaagacttggtgtgtttccagtgatctataaagaaatgatgaagtgaatatgttctgtggatctctgttctctctttgactctattaaccaagtaatatcttaatttaaaatgatgaaatttaggaaattagacattgctattcatcttagaagggaacaaagtatccatgctggtctagtgaagccacatattaaatcctcttaaaacttaaactgtgccttttttccagatttgatctacgtgtggatattctaatgattgaatataataggattccattctttaatttcaaaacttttagaatacggagttagaatttatttatttatttatttatttatttatttatttatttattacctaaaacaagttcagtggaagatgctttttgattattatcacattttgggcttttgtttttggtaacatgcaggccatatatgaatgaaattttgctctttcacagaatgatatgagcatctgtttcttctaattagaatacatctacaggagaagagggattttaattttcatgttgtagcgaatgtctaagggttgaccgggtattttggaggagtagttgtactttgatcatatttgtatttgcttttctggtcaggagcctggataaggaagcgccccctaacgggtgggtggagcagagggagtggggcgagagatggagaggaggggccggggcaaggaaggatccctaggtctgccttcctgtccacagcactgcccgccagccacagctcctgagtcaaaggctctgaagcaaagttgtatgatgaaccttggatttcctgtacaatttggctaactctagggtgatctctaataaagacaaaggccaggggacagaaatatctttcttttgctcctggcaaatcccattttgattctatctcaatctaactgtccagaaaattggattgaaagcaggacaccgccgggaggtaaatcagattagggcttcctctaccacagcctccagcagacatttcattttgcagtgtgcgtccctcatttatatgaagccgtgtatggcccctccatgcagcagggtgcgtccaagctgacccagcgaaccaagacatcaggtgaccctccaatttgattcactgaaaatactgccggtggcttcattttctccagagaactgtctgcacctctgttcctttctttttatttgggtgcctatgatgacctcattgaagtcttcatctttttcttagccaatgtagcgtttgctaaggagccagacctcagataggaatggagagccccagaatccaggtgcagcacaggtgcttccagaaccttctatgtggtcccttcgggaaaggatcatctgtttttgtgaggcttaacaggaagacagaactagggaagaagcagggtgaggagggagaagtgcagctgtgtatagcgagaataaggatctgccgaaatttatcttggggtttttatttcctcttgaaatgttgtgcgttctgagaacctcgaggagtgtttttgttgcctgataggaactggcccggcttgttcctattgcactgaagccttcaggaatgcggcctctgcacctgtgatgaaaacaacatccaagaaacccaccagtgggttccagaacttcctttctacagtgactgtttgggtcacaaaacataactagacaaaaaattagctgggcgtggtggcgggtgcctgtagtcccagctactcaggaggctgaggcaggagaatggcatgaacctgggaggcggagcatgcagtgagccgagatggcaccactgcactccagcctggatgacagagcgagactccgtctcaaaaacaaacaaacaaaaaaacaaacaaaacacataactagaaattatgaggtttataagggctggtgtcttaaccgcaagtgcctgtttgaacccccattgagcttgtagcatcgagatgtgctgtgtgtcacattcagccacatttgtacagttggtggcatttaggagtcctgcctggaaggccaagaatatttttccccacagtggcttaggaaatggaactggagccctcattcccctcacttcccactggctaggtggtcacggatgtggaaatatcccaagcttgaaaccactgaagatggagctcctgacttggaacagaggctctggggtaaggcaggcattggggacttgagggaatcccaggaaaagactgggaactagaacccatgtgccctcgtacagatccacagtccccttgccttgggtcccgtgatcctttttttctttttttttttctttttttgagatagagtcttgctttgtcacccagactggagcgcagtggcttgatctcagctcactgcaacctccacctcctgggttcaagcgattctcctgcctcagcctcctaagtagctgagattacaggcgcccgccaccatgcccagctaattttttgtgttttcagtagaaacgtgtttcgccatgttgaccaggctggtctcgaactcctgacctcaggtgatccgcccacctcagcctcccaaagtgctgggattatagacgtgagccactgcgcccagcccccctgatctttagaactgccctgcttgcctccctttgcgccgccctcgtctgctgtaggtcgaattggtttaagagctgggcatccactggggagaaaaatcagagtagggcttcctgggactcttctgggttgttctgactaacattgggttttactcaaattttctctccctgatgtaaacacgcagatattttttaaggttttaagtgtgaccatttagcttacatgcaagtcagaatactttgggttttttcagatccaatagcaggagcatccaggcttttaaagctgtgggatatgatttctgtgtatttgggctaaattaatttgtttattgataacctcagttgttatcatgctaaactgtcagaattggatgtgaagccagtgcttatgtagactttatttatgtctggcttctttctgaaaacaattcctcctcatgccctagtttcatgttgtgattttagcagaattaatctgaaatgactcaaaattatacaattaattgcattcagcttcaattacagtctgctggatgaaccaagcccactgccctctctgggcagtcacttgcatgtggcagctttgtaggtgctaaggccctgtggactccctggtcagtgtgctggcttcctggggaaagcattttggggttgacagtcccaggggcctaatgcctcagttgcagacaaatgcaggctggacctggggctgcaaaaatgccaggtaacagcaaagaccatggaggtgagtgtcatggaatttgggataaatgataaaacattcttttcttttttagtagaaaacccagatttgggtgtttagggttggagaaggcaggatctgggtaggtgtattagtctgttttcatgctactgataaagacatacccgaaactgggcaatttacaaaagaaagaggtttaatggactcacagttccatgtgtctggggaggcctcacaatcatggcggaaggtgaaaggcacatccacatggcagcagacaagagtaagagccaagcgaaacaagtttccctttctaaaaccatcagatctcatgagacttcttcactactacgagaacagtccaccatgattcaattaataactcccactggctccctcccccaatgtgtaggaatttacgggaggtacaattcgagatgagatttgggtggagacacagctaaaccgtatcagtaggtttaaggtttggaaggtggccagccccagggcagagaagcttctactggagattccttcctttctcctttttactctgtgcaattgtgggccctggggtgagccaggtgagggcaggtgcctgaccacaggatggaagggccggcagatggcggacccaggcagcagtggagggaaggtgggggttgaggggatgcagagggctgagagaaactggggatggagggaactgtggtcgacgcagctataggtctggacttatttttcccagatgaggaatatctttaagtccacataagtgagtcagggactgcttgtattcaacttgtgctcctttgaaatgttcttattctccccacgaactgactttcattcacaccgtctatttggcaatacatgaccgaatttggagcctagttctttttggcaagaaaagttcattaattttagtcggctccccacacacttcacaaatgtgcttgaaaaaataaagggcctcttatcgccacacagctgccacgaaattgccaggagtgctgagtgctcacatatagaagacggccatttatgttgatgctgtgagaagaaaaggtcccccgaagcactttgaactggagctgccaggaaaatgatggtaaatgcagaagcatcagcgaagccataggctttatgatcatttatcattccaaatttctaaggattatcttcatctcttttattctgtaaacactgattaacttttaaaggtgatggaagtctggctgagtcaaacttactcatccatcaacttagtggacttggagaaaaggccctgctgtgacattttgattaactgggatcttacctgtgtggggttttctttccacttaatatctaagaacacaagggtgggaagaaacttcagtgcctgcctgccttctgctcttttcctcatctgtaaatgaacatctgagaagggagtgagacgttcatatcagcctgtgcagtaggcctagctacactcatttatttgctctctcttttctgatttctctctgtactgggctgaacaatgttccctcaaaattcatgctcgtccagaacctcacaatgtcaccttatttgcaaatagggtctctgcagatgtaaatagttaaggtggtggtagattagggtagacactaaatccattgactgttgttctcgtaagaaggccaggtgaagacacagagacacacaggaggaaggccacgagatactggaggcagagattggaacgatgcatctacaaaccgaggaatgccaagatttgccaggagccaccaggaactaggagtgaaagatgaggaacagattctttctcagagcttccagaaggaaccagccccatcaatgccttgattccagacttttgtcctccagtagcaattctgagaatagattcctgttctgagttacccagcttgtggtactttgctggggcaaccctaggaaatgaataaactcattgtacttctgaggtgtctttgttctctttttaataccaggtatatactgctgctcattctaaatttcctcttgtccaacccaagtttaagagccgtaagtggcctattctaagttttcttcccatccaaggctctataagaggccattgccccaaaccaagggtttggaatagtcaaagatcctgcccagatgtgatgcccaggtgttctcagccgtgggtttggggatgatagatctctaaaactctcgaacatctagactttaaaattgtcatcccctgtgctggcttccaaccacaggttctgtgctgcttccagctcccttctctgctgttggagattatttggggactgactgcgaggcaagtgaatgaaatagatggcagaaaagacaaaggccaaaaaatccgctgcacctactggcttcccagatggtgtccaagggatgaaatagcttgagccctgggccacaccatatttctgtcctgactgtagctgttttgctaaggagcccgtactagccttggaggaacagctttcgatgctgcaaggaaagcacagagtggggatagctgatgggagttgtttcagtggtttaggctgacttggtgattctaggtatgccttaggccagtggctgctgcttcttctgtacatgaatgtcatgaatgtctgagtagggagtgagaggttcatgtaaaccttttatgttgtaggcccagctgtgtggccatgggagggtgcttggcatgattaggatggaaaacttttttgcctacactgatcatgccagagcgatttaatatttcaataagaatttaagggatagactcatcttggagtcgtcgtcttggcctgttttctcaccagtgttttgggtgtttgtccaagagaacttaagagttcttaactgagtattttgggcctgtgggggtcaggagaacagcatgttttacctctactgaaggtaggagctaccttggcatttggggtgaagagatgtgtggggtttcttagtgtaggggatggtcgtggagcctgggagacctagatggctcagttcttctaatttgttgagccttggtgcatccctctcttggggtgatgataatggtgccacctcagagggctgttgaagatgtgagatgcatatagaacacagcatctggctcgctgtgagctctctggagaggttagccattgagatggtttggctgtgtccccacccaaatctcatcttgaactgtagttcccataatccccatgtggaagggacctggtgggaggtagttgaatcatgggggtagttacctccatgctgttctcgtgatagtgagttctcatgagatttgatggttctataaggggcctttcccaccctttgctctgcacttctccttgctgccagcatgtgaagaaggacatgtttgcttctccttccatcatgattgtaagtttcctgaggcctcctcagccctgcggaactgtgagtcaattaaacctcttcttttataaatgacccagtcttaggtatgtcttttttagcagcatgagaacggactactacagccatgatcactagctgagtgtgctgctggggtcacctgctgtactcctgcagacctcaatctttacagagtagaaaaatgaagcctgatatcctcatgggctctttttgtatatcagaatctccgtcatctcccacccaccaaattggtttggagcaagcaacctgacataaggagtatgaccttcacaaagtcatgttgtgtaagtagcagtttcccaaactaggcagtgtaagtgagagctctaaaccacttagtggatgagggtatactgattttaatttttaaaagttgagttattattggaacatgaaagaaagcctatttcgcagaatcagccagtgaggcattccttcttttgtcaggatcttgtagttgctatgtcaattaatctgctttctatttaggccattgaaataaagttatatctaaaaccttgaagtaaggtacaaaaagtctacagcttcctggaacacagcctagacgctggagttaaacaaaaatggacacaggggtcttaagaccccccagtagaatatgcaacactgctagggtgccttgaagatcctttcaggtttgtcttcttttttatctctttattttcctttttttttttgagacggggtttctattctgtcgcccaggctggagtgtagtggtgcactctcagctcactacaacctccacttcctgggctcaagcaatcctcttgcttcagcctcccaagtagctgagactacaggcatgcaccaccacgcccagctaatttttgtatttttagtagaggtggggtttcaccatgttggccaggttggtctcaaactcctgagctcaggtggtccgcccacctcagcctcctaaactgctgggattacaggcgtgagccaccgtgccctgcccctttcagaatcttctgagaattgtcttactgtaatattccttacacatttggttaccgaccttcccagtacgtcattggagaaagcaaaggcaaaagggggaaggagagaagtaacatttgttaaatgctaactgtgtgccaaccacttgacatggtgcatgttatccccattttacagatgggaacgtagaggctgagggaggtaaagtaacttgattaagtttaccctgctatgaagtaatggagttgggatttgaaccactaaggaacacactcaggtattgttaagtaaaaaaaaaagggataatgattgagcacactggcttacgcctgtaatcctaacactttgggagattgaggtgggtggattgcttcagcccaggagttcaagtccagcctgggccatctggcaaatccctgtctcaaaaaaaaaaaaaaaaatacaaaaattagctggaggtggtggtacacacctgtagtcccagctactcaggaggctgaggcaggaggatcaattgagcctgggaagttgaggctgcacggagccatgatcatgttattgcactccagcctggatgacggaactacgataacaacaacaaaacaaaacacatgatgaatacgcactgaaagatcaaattagattctctacctccgttgaagaaggtaaaaaagtatatagtagaatccctcagaaatatgaatggttagaattatttttaaagttttgtaaatgtggggcaaatttctattttctggaaaattcttctggtggaacaccttgctctctaaaagtgccagataaatgagattccgcttgatttgagagctaagttctatgtccagttcttccttgctgttattaagcagcaaagagagacccatggttgcacactgggaggcttttctctttatcgttactgtgtttatagacccgactccatcgggggtgcttttaagtaagtaattattttggggcattgttgctctttttcgttcagtgcgtaagtatcactctctactgctttctgatctttttacttttatttttatttttattttttagtacttccaagtgagaagggatgtggcctcccagctggtgtttgtcagggttacatggtacatgtgcaggaagggccacatcagcaggccttgagtaatccatccgcagtctcgaaggatgaatcattcatgaaagcagttttccatcccgctcactggatgcaagcctttcttgcaaagttgatttcttttgcaaaattaacctttgctttctgctccttgcccacacagcttttgaaataggaagcccacagagttgtgttgtttttttctaagtaagtctaacggactgggcatttgtaacttcaattattacgcaaggtattgaattccgcctatgaaatctatgaaggtcattgcccgtggacttagaagtgcctagcagagttgaatggtatgtgggctgtgtgtgtatgatccatatggctgaagtcgtggttcttactattactatatgattatgtatattttaaaaatagctccttcagattttaactagttttaaaactcaaagtatgtgaaagggtttgcatttgatagaggggggaaaaggcatacttaatatccagggttgataagcgaaggcgtgccacctcctgtaagtccacccctttcatcctttacccccatttctcacactacttttttggtgttttgtgcgtttttattttttccgaattgcagcagtgcagacagggagaagaactaaaatcactctatagctggcctctgctgctcattacgttttagtgggataaaaccttgtcttgccctcctagttggagaaccagctgaattgcacctttgaatgttgctgggttttgtgccaacctgccagctgatggggcagaccagcagcttagtgtctcctttgctgtggaagcagaactgcgtccccattatttgacaggcaggaaacggtaaggctagcaaagcggggactgaagacttcaggtgtcccagctcctaccccagaggttggtcgcagacacaggtttataaaacatcagtatgtggagccaccttctctgaggttgtcttgttgtgtctgtttcttccttagaaaagcacatcccagatgggcatgatggctcacgcctgtaatcccagcactttgggaggttgaggcgggtggatcatttgagcccaggagttggagaccagcctgggcgacaaggcaaaaccccatctctacaaaaaatacaaagattagccgggtgtgatagtacacgcctgtagttccagctactcaggggaatgaggcaggagaattgcttgagcccaggaattcgaggctgcggtacgctatgttcacgtcactgcactccaggctgggtgaaaaaatgagaccccatctcaaaaaaaaaaaaaaaaaagaaaagaaaatcacatcccaatcctaatacttttaaaagttcatgtgccaaatttaatattcaagttgctaacatgttatctgtatgtaaaaaaacctgttcttctaaccagacttcttccagacttgttttgatcagtctcaaccagcatatgtcattggcacatttaagcacaggtatgtaatttttagcaatagtgagatgttctatagtggagtgcccgtgtcacctgagttgtggtgaacagtttcaaatatccttcattttccagtattcaaaaatgaggaaatgacctcagatttcagtgctatgataattcccctagttatctcctaattctgtgcttattttgtgttgcagcaagtgaagctcagagagctcgcgtgctaggtaggcactaagtggtaaaaatgatgtaacattttctggggaaatgtatccaaagatcaatttgtaatagaaaaacagtattcactgggcacttaggtttatattatgatagcagatacttgagaaccttcttggcatagaggcattctgtgggtttcatggtggcccatgagttaattggcagctggagtgtgaagtaattgaaataattgacccctgagataatgggtgtataggcactggggttcctaactatcgaggaggagactggggttcctaactaccgaggaggagactggggttcctaactaccgaggaggagactggggttcctaactaccgagcatgcttctatgggatgtcattgaggtgtttcctgtttccgtgaacagtgtctagttttttcttttttgaccctctattttcatcacttctaagatgagaccttggttgtgggcagagggtgtgtgatatattcttttaaacgtcgggtctgcttccctctgtttgaactcaagttggacagacaaatcccttcatggatggaagctggctggtgctctgcggtttctgagatcagtgcacaaggccaaacccagtttgtcaataacagcttcttcctcattgttttatgtttctaatgaaacagctcctattttgtagtacacaaaggggaaatgtgaggctggaaagcaacataggattcttcattccagacagcagccagtgggcccgctcatgaaaagttgatggttgtgcttaatgagagaagaaaaaaggcatctaatagctaaagtttgccttaacataataattacttcccatgtagcagttccatttttctaatacttgaatgtcttattgtataagaaagcaaggtacttatttatttttacaaccttacatctagtttctgtgaacgttttcattgtataaatttgtttctttctcaaaatagataaaagacaccaaccatcttttttaatctactgaagcacatgaatagtgcttatgtccattttaggatacttttttgtaagccatgatataggtcttccccaccaatggtggcagcttctttagaggcaatttacaaaaacacgaacacccctacctcccacctatggtttttgctttctataaaaatgttgaatatgtcatagctaagaggaatgaaatgtcctcctgcagagaataagaatctcttattaaaagtagcccagaagtttactgttggtgcttagaaaataattgaaggatgtggaagaagaattacaaagacatgcacacacatgcacgtgcacacatgcaaacacacacacacacacacacacacacacacacacacacacatttatgagtcactgactggcaatcataataaattatttccccagaatcaattgtaagcctgcagactccagagaggttggcttacccggcctggagcagtgctgggtggagttgtttactctcctgtggcagccttagggctcttgaggtatatgtgcgctcttagtcctctgttatcttctgtcaccgggagacaggcaacatgtgcaccagaaactgctgccatgcctgtcgccctgtataatgtgcagtttttgctgacttttctctgaaaccgtaagaaaagatctagtgactagctgagtcacttgaactatgtgagttaagtcacttgaactacacgagttaactgagcaaacttgcagctacccaggaatttgattttgtatggtgaaattcttagccttgattctgtgtttttttttttttaaatttttttatttttttgagacgaagttttgctctgtcgcccaagctggagtgcagtggcatgatctcggctcactgcaacctccgcctcccaagctcaagcgattctcctgcctcagcctcccaagtagctgagattacaggcatgtgccaccatgcccagctaattttttgtatttttagtagagatggggtttcaccatgttagccaggttggtctcgatctcctgacctcatgatctgcctgccttggcctcccaaagtgctgggattgcaggcatgagccactgtgcccagctagtttgtttgttttgtttttttaatttattttttagagcagttttaggttcccagcaaaactgagcagaagatacagagatttcccatgtacctcatttctctgtgcctgcacagcatccccactgtcatcatccctcaccagagtggtccattcattgcagttgattaagctgcattgacattattatcacccaaagtccacagtttatggaagagttcattcttggtgtatcttctgtgagttgtgacaaatgtatcatcatatacagctactattctagtatcatgcaaggtatattttcactgccctaaagatcttctatgctccaccaatagaagatccctttttcttccaacccttagcatccattgatccttctattgtctccatggttttgcctttttcaggatgtcatgtatttggaatcctgcagcatgtaaccttttcagattggcttcttacacttagcaatatgcatttatgttttttctatgtcttttcgtggctggatggctcatttctgtttagtgctaaataagattctatcatctggatgcaccgcagtttatccattcacctactgaagggcgtctgggttgctttcaagtttggggcaattatgaagaaggctgccataaacatccgtgtgcaggttttcatacattttaaactcatttgggtaaatatatgacccactgcaattgtggggtaaaatggaaagaatatgtttagttttttaagaaactgccaaactgtcttccaaagtggctgtaccattttgcttgccctccagcaatgaatgagagatctcattggtccacatccttgtcagcgtttggtgttgtcagtgttttggattttggccattctaataggtgtgtagtggtatctcattgctttaatttgcagatccctaatgacatattatattgagcatcttttcacatgcatatttgccatctgtacatcttctttggtgagatatctggtcttgtgcccatttttaattgggctgtttgttttcctattgctgaattttaagagttatttgtatattttgtataatacttctttatcagatttattttttgcaatattttctcccagcctataatatcttctgattcttttgacagtgtcttttgcagagcagaagtttttaattataatgaaatccagcttaccaattattttttcatggattgctcctttggcctttggtattgtatctaaaacgttattgccaaacccaaggtcatctagatctttctcctttgttattttgtagagttttacaattttgtgttttggtttttttaattaaatacaaagggattggtggtttttgtttcttggtagaaacatagtttgtttctttaccagtgacataagcaataacttaagtaaataaatgaatgactaggaaactctttgactaggccaacccccatagccttaataaccacaacttaacatttgcagaataggaaggactaatcctttaatttatcttttatgtctatccagaactttagtcctatgagctgttttgtaaacgagatttgttttgtgggaaagggaattttgtttcaagacttccctaagaaactgatagcatcgggtaattcttaaatttgacttatcataatggtatatctggaaggaatttgtcaactgatatgttataattattttttaattttttttaatttttgagataggtcttactctcttgcccagactggagtgcagtggtgtgatcatggttcacagcagcctcaaactcctgggctcaagagatcctcccacctcagtctcctgagtagctgggactaaaggcatgtgccaccatgcctggctagttaatttttttttttttttaagtagagatgaagtcttgctgtgttgtccaagctggtctcacactcctgagcttgagcagtcctcccaccttggcccctcaaaagtgttgagattacagaggggagccactgtgcctggcctgatatgttttaattctaacagtagatctgcatagagagaaaagttggtattatgaacaaaggtagctttaattcgaagagacaaccatccccattccacaacctctttccacccaagcaaggaaatttattgaggccagtaacattttaaatgctttttggagttgtttatttgcatgtactttctttcttattgtgtaagatttgacttttttttttaaaggagtttcttcacatggataactcagtttgtatagcctaatgtaatctcagcaataagtcaaaagctgttcttctgtagggctatatagttctctgacataggaaatcattcttagttccattatattgagaagaaacagagaagcattttacatccaagtgcaccagcagctgttttgttacatagctgctgtgtgcagagcccaatactgagaattttaagaagtcactgaaatatgtcgaagcacgaggatgggtctggatctcctcactctagacgcctgtaccttttttctgtagtcggtgaatgaaattttggaacatgaactgcacgtgtggaaagaatttgtgtgtgggtggaggaagcatctaatgggaactgagctgggggaagtagagcttggtcccaggtgtcccagctggaagagtttgaagccagacccagggagccctgcgtttgaggccacctgcactgctcacaagccacgggccttgggaagccctttctgggaacttgcttgtggagctgagatgggggtcagaattattctgcaaagtggttcccactgagcaacaagtgactttctcttcctccacgttttcttctccttacctcaaaatggaagaaacttcttggcaaaataccatttaacataatttggccacactgaacatttaaaaataatcaaagatggagtctgtgctgttaagaattgataagtattccacataaaatctaaacatcgttcttttctttattaaatttttggtgtaatgcacaaaaacttgaaacttcagcttttaataaaattgactttatttctaaagagaagtgggaataacagtggtgctaagattagcagtaaaagcctttaacctgcgaattccttcacgctggggtcaaagaagggaagtccacgtggatgtttgacttgtgacctcttccttcatttaaaaaaaaaaaagacttaaattactcatgccctcagtttaaatttgtgactggcatttgaaactatggaatgattcacttttccttgtagcaagaaaatttgaaaatgaaagcaaaatgatgctcatattcaaactgaacctactatgaaaagatgtttgctgatggcttcgttgccctgcaaacacacacgacagagatggctgttgttcaacacattattttcctcttcctctgagcatcttagagagggatgactgtgcatgttgcctcatgcgcaggaggtggtgtgcaaagatcttttggtttgtatcgtggcttacaggctctcatttaggccatggcatggtacattccaataccatgagtggttaaatctcaggaattccaaagtgtatgaacggagtgatgtcagctgtactctcatttcatgctatgtagccagatgtcgtgtagctaacctcagcagttactatacataatgtgctataactggctgatttaaggtaaactgcctcagtttcctcatctgtaaatgatggcttttgactaaataatagcttagttttcattgtgaacaaaatgcttgtttagctgggcaaacacatttttttttgcagaaaaacagccctatcaccaatagtacctgctctagtgcttttaaaaattagaatgaaattttgtttgtacatttttgtttgtttttgacagtctcactgtgtcacccaggctggagtgcagtggcaccatcttggctcaccacagcctcaaactcctgggctcaagcgatcctcctgcttcaacctcctgagtagctgggaccacaggtgcatgctagtatgcctagctaattttttaattttttgtggagatggggtctcactatgttgctcaggcttgtcttgaacttctgggctcaagcgatccccacgccttggccttccaaagtgctaggattacaggtatgagccactgcgtctggccttggttgtacttaaaaaacaaaaacaaaaaattaaaaaaaaaaacaacagaaaacttttcatggctcccaggagcatttatatgactaacaagttatctttccttgctgatagttccactttcctcgtgtttgacagaaatgactcttagtttaggaactcctcattagctgtttccaggagcagtggggtatcattttgatgcttctttatttcttctatgcaactaaaatacaaagtgaagatacgatgtctctgaaatgataaagctacatttgtcaaaaagcacatattttccattcgacattttggcttaaagaaatgaaaactacagaatgactttttcctttatctgggtctgtgctgtgtatttacctatttaaaaagatatacaggtgaaaaatattttttgaaatgaacttgtctgaatcaagatgcacactcttgcagcaacatcacagggtgtctctgtcactgaggactctgtcctcatttgtgtgggctgactgggtcgctggctgtgggaggcacacatttgctatcttggtgcagcagtttgtagtcagctgactgacttgttcctgcacatgcattttttttcctggcaagtcataattcatgtttttcctaaggtccaaccctattataactgacagatcctatctggctgagaaacatgggcacccttctgtttttgcctcttgttcccaacatatttgtatgcttttcaataggaagctgacctggagtaaatgcccagggttgtctgaggtctctaaatggaaggtgtggtctgaaaccagctaactatggcagcattagggcaagagcgcacaggtaaaggacttctgaaggagggtggagggtgggaaagtgggaggggcgagagctaacatgaatgaaactgaagagaaacagaagttgtggctggcatgcaggagaaacccagattcccattcaccacttcctctcacctccagaaattacccatcattcctctctattttgcaatcctctctatttcccctgaaggttctgctttgaatgctgtcttcccagcagaaatgttgaagggaagtagctcagcccagttcccttctgggccaccactttcaactgtagactttctagtcagagccaagaaggccatggactctgagaatggcatttaaagtctctgccgggctccacttagttccccttcccctacagatgccttattccctcgaaatgcaaacgaggctccatggccacagtttccttcctctttctgtccacattccagtcgttcaccatctcgagaacactggggcaccctcctctacccccagccagagctgtcatttagttgtgatccacaaatctgctaaagagaaaggtgccctgctatcattttgcaaaggcttgcttggaacacattcctgccattcttttttgctgctctgtagcctgagtgattatttgtttagtgtaggagtaaatatgaggggtgctgtgtttcttaaaaacaaaacaaaacaaaacttttagtgacatatgctcattgggggaaataagatagaaataaataatattgaaaacaaacacccgtcaatcacgtgacaaccacaatatagcactttggtgaaaatggtcttaatttaaaaaagaaagtccatctttctaggtatctgagcaattcattactattctatgtaatttttgtgggtttataattaattttgtagattgggatttactagcatgtgataccttgtaaaggacattttacattaaattatcttcctccctagcacattgcctaattctgtcacttgtattattgaggaaacatttgcaagtaggacaaaaagctgtctgcaaatacttaagctttgagttgtttttttctgaagtgcgaacacaatcaattgggttaagtctcccagcccctaagtgggggtatttatgttttttttaggagagaaactttggaagtaaatcagaagtacccagggccaatggccagagtcttagaggaaacataaacctctaggatccagtgagtatccacaaacttagagcactgcgaaggaaacagttgggttagcgttttattaggaaggtcagagatgatttagaaagttaacccttccaaggggtaattacccccaatatgtgtccgttgtggcatgctgtgtacattcactacttttttttttagtgggaaaataacaacatgacttggctgcatgtcccaggaagaggccacagaaatgaaacctcagggtcacatgaaggagattcccctgacatatttcagagctgatgcttaatggacctgaaccagtttgcttttttttttttttttttttttaaaagacagagttttgctctttggcccaggctggagtcaagtggcacaatctcggttcactgtaacctctgccaccccccctccccaacccccacccccgccaacctggttcaagcgattctcctgcctcagcctctcacgtagctgggattacaggcaccccccgccaccatgcccgtctatttttgtatttttagtagaaacggggtttcaccatgttggccaggctggtctcgaactcctgacctcaggtgatccacccgcctcggcctcccaaagtgctgggattacaggcttgagtcaccgcgcccggccccagtttgcattttttacagggcagagactgaagggcacttagagctacctggcccggcctggctttagggacctgatctgtgcagatatggtaattccccacgtgtcaatgcagttcagacttaaagggcacagtcagcccttcgtttcaataccaagaattgcccttttgaaagggtcttgaaggacttgacattctaggatttaattattagggggacgagcagaggcaatgagatgcaactctgaaacaaatgtttaaccacttgagtcaaagaggaaacagagtgaattaaaacttgaaaagtgatcttcaaatcggcttccgcccttgtaggctgattagacgacaactagcatctccaactaagagtgtgtataattagaaagccctctaggttatatctcaagtgagaaaagaaatatgcccttttcttagcctttccttatttttggcctgtatttgggaacttttttttttttttagtttagttttttttttaattgtacttctacaaagtgctctgcaagttgcatgagaatacatacaagagctttagcttcatttaggacatattctctcattcctgaaacttcagattaatttagcatttgatgacctaatattgcatttcctcaattttgttctataagtagcattcatcagagcaaagtttattttatgttggtggcattcagtaagtgatacatcacaaagaaagattggatactcttgcatatcaaatatactttgaactgtgttctctggcaatgccatagattttaactgcaactgacaacttgtacttctaagagagcatttatcattgttggatgtgcgttgtgtctgtctgctaattagcttgtgaagtccctcaggttattcatctcatagaggccagtgtctggcacagaataggtaaccactgaaggtatcctgagtggaattgagttgcaacagtgtgttatagacagtatagtccacaaggaaaagtagtcatcactgagcagaactgcattttgcagccctccatgattttaggggagagcaaatgtaaaacacattttcaaacaggtgagtctgactaatttggaaaattgaatggactgttttctaattttttttttttttttttgcatctgggatataaagcaacagtgaaagttactttttaaaaatgggctgaagagtgagaaatgaatctgacttatcaaatccgcagagggttacctttattactgtgctgcccttcatcccatgcctgcctgctttcatgacaagttgcagtgaagtcgtatttggctgtgagaagtgacttgccttcagggtcactgtgaaccatgtgggtggggccgggcaaatgcatatttaagtactataaaatatttagaagcagaagattcaaaatttgaccaatcagtttgatcaagtttaatttctttttgtttttaaggacatggtttcgctgtgttgcccgggcaggaatgcagtggctccatcatagatcactgcagcctggaactcctgggctcaagcagtcctttcctgcctcagccttcagagtagctaggattacaggcttgcaccactgcacctggctaattttttaaatttctgcaaagatgaagtcttgctatgttgcccaggagtggtcctctggcttcagcctcccaaagtgctgggattacaggcgtggaccatcacacatagcctaagttttactataaccaatgaggcaacctccatggagaccaagaagagggagtggtaccttctagacatcttgacctttgtcttctggttccaggagctgctatcgctaggaaaaggaagtcctgtctgctcacagcccacccgcctctgcacaggtgtccctgggttggctcgttgatggtagtggtggaaattgtctcagtcattacttacagcctgtgaatcctattagcatttctccaattttctctgtttttatcaagggaacagaaatccatcatcaggtatttccacaaaattgacctcatagttccttcctgggtttaatgctcagttgccaaaatagaagtgaagagtcagcagagttgatgtgaagtcacttggagtgaatatcttcaaattaacaagacgtaacatccctttcctgcctttagcccacaaatgcccacctctgctgagccaccttcttgcaaaggaggcttttggaaaagatcttttgggattatgtgaggatcccacatataaagtagcaggagaatctcgagttccatgggaaatgactataggtcatttttccattttcagagaaatcagtgcctttgaaagagaccatagctttttttgcctccgaccgaacttgcctaatttgtggaggtgaatgaggcagcctttgttctctgccagactttagtcagagcccttaagcatggcttgttgtccagagcatggtagagaaatttagagcatcatcgtaactgtagcaccaccaaaaataataaccacaggagctaccattatggaggaattgccccatgccctgcagccacctctcctcctccactcccccactcccccattcccccattcctccttcttctcctgctccagtattgcatatttttacctgactctgcagcgggctgcctcccccggtagctcactcctttgacctagactttgggtctttgtagctctggtgcttgtacctgctccctctgccctgggccaggattctcagtctctgggattggcctcaatctctgtgtttccccagtaccttgcttaccccttcacatgcatgtggattgcacggactcgccctggcttgctcacatgaaacactctcctacccatctcttcctttcagctggagccgctgtgcccatttcagactctgccttcacacctggactccagcccttcccttgtaacagcctcccttcaggaagagggtgtcttgcagcctagaccctcagttaccagagtccctcagaacagcctttcccattctactgttgttcaagtgtgttggtagagaaaatgagagcatcatgataactgcggcaccatccaaaatgataactgcagtagctactattaaggagtatagtgtctagcagctagtgttttggtagaaactcaagccaacacccctgtaatcccagcactttgggaggccgaggtgggtgaatcacctgaggtcaggagttcaagaccagcctgaccaacatggtgaaaccccgtctctactaaaaatacaaaatcagctgggcatggtggcacatgcctgtaatcctagctactcgggaggctgaggcaggagaatcgcttgaaccaggaaggcagaggttgcggtgagccgagatcacgccattgcactccagtctggttctgggcaacaagagtgaaactccatctcaaaaaaaaacaaaaaagctcaagccagaccgtcaggattcaagctcagtctcacacatatgaactgtgtgactttgcaatttactacttcttgccacatcactctttctcatccttaataaataaaatcatttatgaagaagattattaataccatcagtattatgaagactattactcttatcgttgatccttattttctcatgggacctatcaagttcaagtgacctaacattatacaatttaacctattcttctgcagcaacacacccagatggggaggaacccaataacaccgatggtgctattgacatgctcagaactttccagtgacattgtctctgttttcttgtatatgtgcatgcatgaacaagagctttaaaaattgatggggaccctgggctgctggctaaggagctctcctgcctgatgcccagacaatgttgtatctatatacatttgctgggaagaggagtcagcctagctggaaggctgctattgttatgcaaattggaaaagcacacttttaagctacactcttgcaaaatggctgagggtggcagtgtgcttagggctccagaagagtttaatcattgtaatgaatccaatggaaaaggaccaagtttgctgcttcaagatccatattccaccttcagctgtaaaatgtgctgcagatattgcacttgcctgaaataaagcgctctctgtcttttcttcttctgaagaatcctttggctgtgttttattataccggaagcccatttcctcaacttaaagtaattattaacaacaactaaagctttttctcaatgtggttgaattcggtagttttaggattcaggatggatgtagaaaaaggtttgtgtgttgcgcgtaacctcggtcgtgtagagtatgtggatgctttcaccagtattcacatggagcagttatgcaggatctgcagcagcaacagctctggtgaccactcagtcctctcttctccatttccaggtagaccttacatctttctctctgaaagtgagctgaaatctgataccctgtaacctccaccctttgtttctgcaggatttccatccttcagggacaaacagaacaagcttaatccttctggcaaatatcaggtcttcaggtatttgcagacagctaagttgcaagctgtcttccctttcaggtgaatcccctactcctcttaggaagtggtttccagtttcattctcttgttggaaaacttatgccagagagaggctgcaaccacaacagtgagggcttggaaccctgaaccgtgtctcaggaggagtgaataaagatttgttgtatggaactctcacctcctccatcctagataatatacctctgttaatgcagtctcttctcctagtagctcttttggcagccatggcacctcattaatgtgtttgttaaaatgcctcagtcttttcatctgtggtgctgtcgatctgcatttctgtagttttgaagctaggtatggggattttcgaatgatccttattactcagtggagtcttgatcgctattagcttggtccagttttggattttcctgttggtttctaatttagccatgcaggatgtgtactgtctttcccagcttcccatttcccatttgagacatttgccttgtgtgagttcggcatcgaggtatggaaaatgaagcctcatagcagcctgttacctctcctaaaccaatccccctgtcagctcacatttaatgcggataccttttatcttgggtacttgtcagaaggtcttcttgatacctgtgtcttacagatacagctaattgcacattgtaggaactgattaatgcccaggggactgagtgccatcacacataattgtggaacgagagattttgattgcagtcaatgaagattttcctccctaattgtgaggggtcctttttaaatactattatacctgattttcttcttattttttagtttttattttttgagatggagtcttgctctgtcgcccaggctggaacacagtggtgcgatctctgctcacttgcaacctctgcctcccaggttcaagtgattctcatgcttcagcctcccaagtagttgggattacacgtgcctgccaccaggcctggctaatttttttgtatttttagtagaggcagagttttgctatgttggctaggctggtcttgaactcctgacctcaagtgattcgcctgcctcggcctcccacagtgctgggattacaggtgtgagtcaccatgcccagccaattttcttctactcttggactggaaggggctctggtttctgctaccttttctacctttagatgtacgtggtcacactttgagggccttcagttggtgttgaagaggagatggcgggcccaagctctgcaagcctggtgcttgggggcatgttgcctccctgctgcacagcacttcctgccactgtcctggtcaagctgggtttcccgatttacggaagagcttgggctcagagggaggccgtgaggagccccgagagaatgccagccaaggccctgtctggtctaatcctgccagagcctggcctttgggtggaactgggagggccggggaagaaggttatgagaggcacaagctctggttctctgccattacctctcagcctagaagtggccattggatttctttgtatgttttctctttatagtaaataaagaggaaacttctcccctcactggcctgtgtaggctacagttgcctgaggctcaggcttgcctgttcttctaatcattgaccttcttgttagttggattctctttttcttcatttaaaaatacgccacatttcctttccctcagtcttgttgcaagttcccaataattttggagtcctgttaaaagacctgtactttttataaatttgctttcccttcaatctggagaaagagaagaggaattacttgtagagtgggtactgtgtctcagagctaggctgaagcttcacgtacatcatcctgtctgtccttaacaatcctgcaaggctggtgatgctaatttccattttagagtcggaaacagttgagaatgagagcttcacatacccaaggtcatgcagctggagaataggggtgtgcagatgaggacacagggcactgtcccacccaccctaccaggacgaggggcttcatgctaaactctggcccattagaaaccacttgggaaacataaatgcccacggatacagccatttcaaagatccatgcttagaccagaacatttagcacaaagcgaaacccacagaaacttcaaaaggaataaaaatatcatgttaatgttaagaaaaattatttaaaatttggaaataaggcataaacgtaacagcagcatgtagttcttcaaatgttagccaggggcgttgcttaacaagcctacccaagggttatttgtttagggtgtcatacctggctttgtttttaacttttaaaaaataacaactttgtggccgagcgcggtggctcatacctgtaatcccagcactttgggagactgaggcgggcggaccacctgaagtcaggagtttgagacaagcctggccaacacggtgaaaccccgtctctactaaaaatacaaaaattagccgagcgtggtggcgggcacctgtagtcctagctacttgggaggctgaggcaggagaattgcttgaacctgggagacggaggttgtggtgagctgagattgcaccactgcactccagcctgggcaacagagtgagactccgtctcaaaacaaaaaacaaacacagctttgtaatataattcacgtaatgtacaattcacccatttaaagtgtacacttcaggggtttctagtaatttcagagttgtgtaaccatcggcacagtcctttttagaacattctcattgccccagaaagaaacctgttagcagttactccccattctctaactgggcagacttctttcggatgtatttattggtggactctaattcttgtttgacctagctttaccaacttagttgttccctctctaaaccaaaaagtacccgaaacgtgtctcaatcaatttagaagtttattttgccaaggttaaggacgtgcgcccaggagacaggtctgtgcttttcgccaaagatgattttgagtgcttcaatgtttaaaggggaaggaggaagaaattgtaaaaggtgttggtagataagaggcagagagttgcattcttttcagtttttcatcagctgttcacatgtgagagggagtagaggaatagtcacttgtgcattcctctagctccgtgaatctgctttttttgtttgtttattttattttatttttttgagatggagtttcactcttgttgcccagactggagtgcagtggcacaatcgcagctcaccgcaatctccgccttctgggttcaagtgattctcctgcctcagcctcccgagttgctgagattacagccatgtgccaccacacctggctaattttgtatttttagtagagacggggtttcaccatgttggtcaggctggtcttgaactcctgacctcaggtgatccacccaccttggccttctgaagtgttgggattacaggcatggaccaccgcgcccagcccatattcaacttattttttaaatgataattcataaaacactttaggatcttgcattgcaatagcattgttatgaacattgctctaaagttaagatttttagtttcttaagtaatacattaatggttgaaaaaattagagaatatagatgaacaaaaataaaagtaaaattaaattttcccaaacactgccctagagacagccccgtatcacgttggtctgtgtccttatagactttttctcttgcaacaacttacagtatttttaaaacagtaaatagccccacatcatgattattgttaaatataagttttttgaagcactgtgtataagtgtagattaaaaaccattttggtttactgtaaaaactctggaagacaacctaggcaacaccattgaggacataggcatgggcaaagatttcatgacgaagacgccaaaagcaattgcgacaaaagcaaaaattgacaaatggcatctaattaaacttaacagcttcttcacagcaaaagaaactatcaaccgagtaaacaacctacagaatgggagaaaatttttgcaagctatgcattcagcaaagatctaatatccaacatctataaggaacttaaatttacaagaaaaaaacaaccccccaaaaaagtgggcaaagacatgaaaagacacttttcaaaagaagatatacatacaaccaacaatcatgaaaaaacactcaacatcactgatcattagagaaatgcaaatcaaacaaaataccatctcacaccagtcagaatagctattactaaaaagtcaaaaaatattagatgctggtgaggttgtggagaaaaaggaacacttttacacttatggtggaaatgtaaattagttcaaccattgtgcaagacagtatggccattcttcaaagagctaaaagcagaactgccatttgacccagcaatcccatggctaggtatatacccaaaggaatataaattgttctgttataaagacacatgcacacatatgttcattgcaacactattcacaataggaaagacatggaattaacctaaattcccatcaatgatagactggataaagaaaatgtggtacatatacaccatggaatactatgcagccataaaaaggaacgagatcatgtcctttgcagggaaatggatggagctggaggcaattatccttaccaaactaacacaggaacagaaaaccaaatactgcacgttctcacttataagtgacagctaaacaatgagaacacatggacacacagaggggaacaacacacagtgaggcctgtcagaaggtggagggtgagaagagggagaggatcaggaaaaataactcaagggtacatggcttcatatctgggtgttgaaacaatctgtacagcaaacccccatgacacaagtttacccatataacctgcatagatacccctgaacttaaaaaaaaaaaaaaacattttggttttagaattctgaataacaattcatcatatttatttttaaattcattttgtcttatattttctggcatgcagtttggaaaggtaatatatttgttttgtaagatttttctttagtttttaaaatttgtgggtgcttctatgccttcatatccttctttgtatggagactttcctagttcctttgtctcgtgtttttccccagttgctctccactgttacccatgggcattagaatcccttggacgccttcagatttcctttttggaggctcctggccccattcctttgtaattatgtggtgttccacgtccctgatgttttattagttcccaacatacttgatataagagaggtaattagtgtattatggcttctttttgaattgttccccaagataagcagagggaaatgttacatgggtaaaaatttacataataatgtgaccaggctttgtcgcaaaagctcactgtaatcatgagaaaatgaaagcattttatttatggaaagtttccgcatgtatttgtctctaagaattaaaaattgccactgcattatggtggcctcagatttcagaagaaacattgtactgtgtttacttgtaccgtgccctgcctttctaaccaaacttgaataccctcttttctgttctgagactgttctatggccattccaccattgattgaaaccaaagccaaaccagaacattaaatatgaaatgctttttccctcacccacaggagctttgtaattatatggcttaaaaaaaaaaaagcactgaattcttaaatgagagtgtttagtaaaatatttggaacagcttcagcttcctactttccttcagtgaaccatggctgaaggtaacgttttcttggtcaatgtgaattgcgttccttcccccggtgcttgattttcctttgacctactccgtctccatagtttgcatgaggtggcccaagcctctttccataattttacataggtgttaccgcagaacgctgccagatggctgcctgtcttggtggggagaagtccctggatctgctgtcctttttcattctcagcactagcgtcatttctgccacaagtcttccctgaactcaaggctgggctgagggctattccccaggcactcacaccttacattggcaagaccttcctccacttgtatgatcctgaaatgttctcttagtgactcttttccaaactaaaagctccaggggggcccctgagcgaagttgatctttacaaccaccagggcccagcaccatatctgggatgtagctattgctcgataaatatttgttgaccagaaggtaagtgaaccgagtactccctatccactgtgtgtctacattcctgccaacccctgtatatatatgacaacgactcttcagtcccaggcctaatagacttgccccagtcagctccttcctgatttcatgtaagagtgacacgattgaatacttcctccttcctgaaacgtttccccctgttggatgtcggggctcctgctctctgctcgcctctctcctaggcctgtctctgaggtttggccaactcctcttgtcacccctccagcactatgagcaaggaattctggttctccccacaccatcttttttgaaattgcattcgaggtctccagcatctcttctaggcagatacctgaagggactgggcttcatgtagtcctcccaggcctgccagactttctggccttcaactaggagcttcatgcgtgtctgtggaaggagtgaccaatggacaaacatacaactctattttgaaagtgggttggggctgggtgtggtggctcatgcctataatcccagcactttgggaggcagaggtgggtggatcacaaggtcgggagttcaagactagcctggccaacatggtgaaaccccatctctactaaaaatacaaaaattagctgggtgcggtggtgggcacctgtaatcccagctgtgtgggaggctgaggcaggagaatcacttgaacctgggaggcggaggttgcagtgagccaaaatcgcgccattgtactccagcctgggcgacagagcaagactgtctcaaaaaaaaaaaaaaaaaaagaaaaaaagaaaaaaaagaaagtggatcgagtatgaattatgaaattgcaaagactagaaggatacatgtgggtcttgcaaggccttgcccttgagtttgcaatcaactggcttgtttaataaacaaatatgtgctaaggatgatggctcctcatggaacttagggcatgcaatcattgacttcagaataaaactgtagcttaggacccaaagagaagaacagaggtaaggaagaatcatgagctcactcgctgctcaccccttccagtgcccacctagagtccttcagggatcatagcttcaaaacccttccagtggattctttctgaagttcattctcagactctcagtgatctttactaccttttaaattaggaatgttcttcacaaaaaggaatgctacaggttacttcactgagtacgaggtgaagattccaagtgttcattttctgtgtggctgtatattatttgtgtgggaacccacattcttatctcaccactaaagatcaagaaagtactttcaccagccagcaagcatcacttgtatgtggtcattgtatgattacaacggcaggtaccagcaggtgtattaagcagaacacacacatacaaaggcaatgattttaaattggactttggattaaagtaatatatttaacccctcaagagttctgactgtgttaaactcatttataatcatgagcaaatgagtctatactaatgcctcagatgtttttgaatttggcaacttctatttcctaattgtgatttaggtttaaataactttttcacttatgctcacctgtaatctttgtatgcctttatttctccccgtggaagtattcacaggaccctaattcattagtttggtaatagctctttactgctttggacttaaaggtaccctcggtatttttaacagacacagatgtgctgtcccgtagagctgtcggggaagaatgccttgaatcccgaaccacttgctcttgttcatagtacttaattttcacttactgaatcatttgctttccaaaaaccaccttgttgcatgtattagtttgttagggctgtcataacaaattaccacaaaccgggcagcttaaacaacgaaagtgtgttgcctcagttccaaaggctggatgctggcagggtgggttccctcagagagctgcaagagagaatctgttccatgactccccctggcttctggtggtttcccggcaatctttggcattccttggcttgcagaagcagaagcatcaccccagtctttctccatcttcacatgagttctcccagggtgtgtttatgtccaaatttccccttgcctttatttttattttattttattttattttattttttcgagacagagtctctgtcgcccaggctgtggagtgtggtggtgcagtctcagctccctgcaagctccacctcccagttaacaccattctcctgcctcagcctcccaaatagctgggactacaggtgctcaccacctctcccagctaatttttgtatttttagtagagacagggtttcactgtgttatccaggatgttctcaatctcctgacctcgtgatccacccgccttggcctccaaagtgctgggattacaggagtgagccaccgcacccagcccaaatttcccttttttgtaaggatgccagtcatattggattagaggccttaccttatgccagtgtgaccccatcttctctaattatatctgcagcagccctttttccaagtcagatcacattctgaggtactagaagctagaacatcaacatgaattttatggggatagtttgtattagtccgttttcatgctgctgataaagagatacccgagactaggtaatttattaagaaaaaaaaagtttaatgggctcacagttagttctgcatggctggggaggcctcacaatcatggcagaaggtgaaagtctcgccttacatggtgtcaggcaagaaagagaaggagagccaagcgaaaggggaaaccccttgtaaaactgttgaatctcgtgagacttactcactacgacgagaacagtatgggggaaagcactcccatgattcagttgtctcccactgggcccctcccacaacacgtgggaattatttgagctacaattcaagatgagatttgggtggagacacagccaaaccatatcacagttcaacccctaagagtgtagctaatacctgaaataatcagatgacatttttatttgccaattctgtgtaggagagatgggtagaaataatagtaaattgcattgagtgtatgatcagagactattgagaaaggtgattgttgtcagatcctaaattatatgaaataatttgggggattgtttttgacatatgtcatataaaagtaacttatttcccaggtttcttattttttctgaccagctctttgtccatactgattcaataatttcccaatgttcttcagctaatggagaaaaagagtttgaccacatttgtaaaatccaatctaactaatgtatttatgttttagctttttattatgtacattttcatatatctggaaaagcagagagaatagtataataaaaaccatatactcttcttgcaactttaataattgtcaactattaccaatcttgtttcatccatcttctctccacatatttttcttgctggagtcttattaaggaattgcagatatcctgttatttcacttgtataattttttttaagttagagaaatgtaatgtcatactttctcactgttgaaattgaggagaaaggtaaaactacttaatgataagtattaggacatacaccttggcttttacattgtaatgaatttaaagaaggaaaagcaggagataaaggaggagtggggagggtggggttgggaagagagaggatgtgagagacaccagctcctttacatgtttccctccctaccacgtttccctccctaactaaactctgagctccttgagggcagaaactgtgtcttggtcccccagttaccttcataccttatagggaattggtgtatagtaagtgtacatcagtaaacatttgctgaataattgaatgaataaaagaatgaacgatgctcccccaaaaccttgcatagaaagatacagagacatgctcagaaaaatacaccacatttagctctagaggtaagacaaaagaaataaaaagatcctgaaaggtacattgcttctcgcagttttcaggatattttctctcacatttagatcccgtgtagcatttctgcaaccctgccaagaagcaggactgtcctaacgtgctgagtgcttatgcccttagcgagggagagaggtttcatccatgctgtgagagctcattcttcatttgcattacgtgagaatcgaagcctgagttctgagtattttgactaccttccatcctctcagaattctggagccacactttgttttgcctgccatttgggagaagattggggttgctgtgaagcttaaagtgctacacattttgctgaagaaagagattgcagtctcagatgtccatactgccggcagacctacatgcttatagatgtgagtgacattgaagcaggggaaacaagtcctgttccactacactgaggaggccttggactgaaggcaagagagaggagagaaggcagagcatacagtcccaaagccgagtccagcctccttagctccttgcaactcacactcaaaccccagtttaagtaattccagactgaaaaataaaaaccttaaaaatattgcagagagaagtttggtattagagtcatgataaacccttgtatagaacgtgttgcaatgattattttttagggtcaaaatgaggaaacctgacatgcacactgggttttggatgttcagacatgaagcttgtactgccaagtgaggaaggctttatgcccttaagagattaaaggaaagttggactcatcagttgattctgaaatcaacccccaaacactgcttgatctgagttttcaaaagctaacctttgggtttctctttaaatatttttgcgtgatttgtcatatacttatctttaagagttttgttgttgttgttgtttacataaagcagttaccatttaatgctacaggtactcaagatttcattcatgcatattcttagtcaatatgagaaaaatctatttcattgtagttctgagttgaatatgggaataagttgaaataataaaagaaggagactgtttatctgttggcaaacgtgtcgctgtcatcatctgcatccttctaagtgtgtggcttctgggccatcatgggcgagtaatgaccacatcccattcttatcttttctccttggctctggaaggagtcttttatactggtgattgccggactgttcttgagatttttcttccctcaaccctctccagcccccaggctctcttctgactcttcccacccctcagacagcctcgtcctttctaccatcaaccacaacacttgggtgtttccaggactcgccttgcagttctccctcaccatgaagacatctctcatggcttggtccacagtcccccgttgtcttttggcctctaaccttgaatctccacctgcttgtctgacacatctatctgggtggcctaacagtatattatacttttctcaaattgagacccctgtttattgtttcattatgttttattgatatataatagttgtacatattttgggggtacatctgatattttgatgcagatatcaaaataccatccaaagagttctttggcagcgtgtgcacaggtatcagaatatcagatgcacccccaaaatatgtacaactattatgtatctacatacaatgtgtaatgataaaatcagggcaactgaaatattcatcatctcaaacatttatcttttgtgttgggaacattacagatcttttcttctagctattttgaaatatacagtaagttattaactataatttccctgctgtgctatcgattactagaacttattccttctgtctaactgcatttttgagcctgttaactaactggtcttcatccctttctcctcttttttcttcccagcctctactcgttacctctgtgagatctacttttttagctcccacatatgagtgagagcatatgatgtttgtcttcctgtgcctggcttatgtcatgtcacataatgacctccagttcttttcatgttgctgcaaatgataggatttcattcttttttatggttgaataatactccattttgtagacatactacgtcttccttatccattcatctgttgatgggcattaggttgattctgtatcttggttattgtgagtggtgctgcagtgaatatgggattacagatgtctcatcggtagactgatttcccttctttctgatgtatacgcagcagtgggattggcggatcttatggtagctctgtgtttagttgtttgggagagtccatagtgctttctgtagtggctctaccactttacattcccaccagcagcatccctgccttcccttttctctgcatccccaccagtatctgttcttttttgtccttttgataatagccattctaactgtggtgggatgttactgtgattttcgtttgcatttccttcataattagtggtgatgaacattttttctcctacctgttggccatttgtttgtcatcttttgagaaatgtctattcaggtcttttgcccattttaaaattgttgagtgaagagtttgagaatattttttccaattctgtaggttgtttcttcactttgtttcctttgctgcacagaagcttcttagcttgatataatcccatttgtctgtttttgcttttgttgtctgtgcttttgaggtcttaccccaaaattttgtccagaccataatgccctgtagcataaaacccctgtttaaacaacatgaagagtagtttctcctctttgagctcgtataatactcagattgcaagtccccaagtccaagttaattcttaacttgccccttggtcttctctgttcattttctacaacctgccaatttaccctttagtatttagaattctttctgtggaaagtacagaaaactcattcaaactggcgtgaacaataaaagcgtgtatgatatgactttgtggattcaagtgtattaaattatatggtatgtaaatgaagaaaatgacatttttaaagggtatttaatggttcgtgtgactgaacagtctgaaggtgatagccttgctgacgccaagatctggtttctttctttctcctctgagtcttctgtactctcagtttcatcataaggctcacctcttggttgcagagtgctaacaccatttactcagttgctctggccgggagcttggggccgttcttgactcgcctttccttcacatcccacattcaatctcagccctgtcttcaaagtatatctcaggtccaaccaggaaggaatgcacaaaagatgctcagtagtctttgttgaaattagagaaaaagaaggcaagggaagaattaaagatgaatctcctaaagaagggggaaagaggcttgcctgcttagaattgggaatactggatttttgaaagagttcattgggagcacgtgcacagatgctgaaaggaagaatcaaggtgctgtctgaagaatgacattctttataatatgtgatagagtgcatttatttgatttgttttcatacaacttttaatgtgtatcccaggagaagactgttttcattgttacaaatctgaaaccaataattttcttttaacatgcagatataatataagctcactttttcattactttccctacaaagctgaaagcggttgacttgccttagagattttcctttcattatattctgctgtgacgttgcctttcattaatcccttccagctaagcaaaatttaattagaaccatatcacgtgatggcaaccatttttgtatttaaaaaaaagaattcaaggaagctcagctaccagtcttctcttctaagcaaagtctattatatttagtaggttctttccagaattcagaatatgttacataatggctttttcttcattaattttggataatagggaatttctatgcctgtgttccgttttacatgactgtgacctgaatttaaaatgacatggacttgagggtgaaaggaaaggaaattattttttaaaggagaaatggaaaatgacccttagcagtgcatatatatatatatatatatatatatatatatatatatatatatttcccccctcaatgaatatagcaatccgtgttagatgtaaatagggatgaacccattttgcatatagattaagtgaccaaatatctcagtagtttggcaggaaagccaagcctgcagcctgaggggcctcacttccaccatcattattgacaactatgtgctcaagcgagcagggagggtgcaaggaacacgtctccaatccttaaagattatatgagtcctttgctctcaaatctgaattttccctttgtctccactttatgccagcactgattttatttagaattttatagaatggaagcaaattcattctttctttcatcctttcttttctttctttcttttccttccttcctttccctttccctttaattcctttctttccttttttttttctttcttgagacagggtctcactctgtcacccaggctggggtacagtggcgtgatctcagctcactgcaacctccacctcctgagttcaagccgtcctcctgcctcagccacccaagtagctgggattacaggcatgcaacaccacacccagctaatttttgtaattttagtagagacagggtttcaccatgttggccaggctggtctcaaactcttgacctcaagtgatctgcctgtcttggcctcccaaagtgctaggattacaggtgtgagcaaccacacccagcccaaatactctttcttgatgtcataatgaactcaattatgaacacaagtaatcataaaaagtctatataagcaaggttcttactgcctcttcctattcctcttatttataatttcataaatattgctctaggttgataagttaaaaatttttatagtaggttatgtataagatttaccattttaaccattttaaatgtacatgtcagtggcattaagtaccttcccagtgttagacgaccatcactaccatccatttccagaactctttttttttttttttgagatggagttttgctcttgctacccatgctggagtgcaatggcaggatctcagctcactgcaacctccgcctcctgggttcaagcgatttttctgcctcagcctcccaagtagttgggattacaggtgcccaccaccatgcccggctaattttttgtattttttagtagagacggggtttcaccgtgttagccaggatgatctcgatctcctgttttctttttgttttttttgagacggagtcttgctctgtcacccaggctggactggagtgcagtggtgtgatctcagctcactgcaacctctgcctcccagattcaagcaattctcctgcctcagcctcccaggtagctgggattacaggcacaagccactatgccttgctaatttttgtatttttagtagagacgtggttttgccatattggccagggtggttttgaactcctgacctcaagtgatctgcccacctcagactcccaaagtgcagggattacaggtgtgacccaccgctcctggctgtatgaattcttgagccaaacacaggtgactgttatttgttctgtttctgaaatatactttcgacaagtggtgaaaactctccttaatttccatctagtttacttccataagcaagattagcaaggaatatggatcacaagattgggtgttctcagttttaaagccaggcaatgtcaagatttgttatttggccaagtctgtggtctttattatttttttgtcccaccatgtcatttgctcagtgtgatttgtgcatttccagtgtcgtccgtcactgctggggagcagacaaatatcacatagaggattagagaaagtgattttgtgcttagaaaataattgaatgaagatttactttgtgactggaagctgcaggatagcatcctgttttaaaacctctcattgggttatataaccagaggtgaccaaagtctttgaagatgaggcaccatctctgagtgagtttttgttggatagcctatgcttgcttgagcaaagacttgtttaagggccaaggggggcccccacgacaatcatcagatggaatcttccatgacacgtctccacttccttccagctgagtggctgttgtctttaagttgccttccttctaccaaggtcaggcagatgtttgttgaaggtttgctatgtaacaggtaccaccttattacctctttactccaatttcctttgcttcatataccatggtgagatgaattcctttagagccccaaattaaaaaaagacaaaaaacaatagctcctgatttttagccaggggaaaccctatgatgtccatctccaggcaaacctaatgcatccttttgttttattgagccagtcttttcctctttcaacaatgctagcaagacttctcaaatgtcttcattagattatcttacaaaatatgcattacccaatttagtttggaacttggacccaaagatcaaggccagccatctctgatttttggaacctctggctgttgctcagttttctggggcagcctttcccaggcacatgctgcatgcagccagcgtcggccaacctccaagctcctctttcctgttcccctcacggtaagtgggggtgttggggaggagagggggcatctacactttttctccttagtcacccaggattgggcacattctgtttcttcttcctttggagatcatccattctgaatttcgaatcttcaagtaggcttagagggctctttatccctcagataacgtgtctatgagtggctgtctggaaacacatggcctttctgtctgcctctcatagggtgaatccagtccttcaaatgggaagctttcgtgtaaggtaggtggggagggggtagttaaggcaggttgggaggaaattattttgggataggtaaagctttttgctgcctctgcaaattgtgctggataatgagggcccgggtcttcttaggataacattcggcatgagtttttttgaggtgtgcaatagaaatacttccagctgtagatacataattgcattgacctgcaaatcatagacagaaagaacaggtacaaaaagcaaactattcttccatgggatttgataagtgtgagttttcttaacagtgttcactgaatgtggagatggttttttttaaaaagagatgaaaggcccaaatgtttgaacgattaagtagggaataggaatgcttattttccaaccaaaacactacatctgtaataaaccgtgatgaggaagtaatgcccctgtaacctttttcctttggtaatttatctttcttattccagtggatgaaagatgactgtgtgcctggggagagagagcagatcagattaatttgtgccatcacagcacggctttattatccgtccttcgagagttttgcaatcaagatgcttttagcagaaacacagtggagaaaggccacttctctcagggcttgtaggagctaagcactgccctttgagtgtctctgtgctgcctgggcagccaagagggctgttttcttcgattcacactcacctcctcctgcccctgactgtgcagggcagacaggtgtggccagcgtgctgggcagccagcaggatccctcacccagggcacctccccctctaaagggatgcttgctttaagagctctccacttgtcacctttctgtggatggttcctgtttggttatctggctctttgtctgctcaatgccaggcatgcattttcttttttaaaatgtatatttttacagtgacatggtatcatgagtacctttaaaatgtgtatttttacaatcacattatattatgattaccttaaaagaaaaccctttaaaaagaattatccatgattctatttccctaatatactgtatcttcatcctctgagttgtatatatgtgtatatgtgtatgtctatgtaggtatatttgtgtgtgtgtgtgtgtgtgtgtgtgtgtatgtctattttgtcatatacccattttcctgttacccatgtaaaaaatcttggcatcagctctttaccctttctgctctggaaatcctgccagtgcatatgacatgatgaaaggacggggggctgtggtgtccagcaactcttagcatgaatcctgattccatcacatggtgactcagccttgggaaagaccatcctttgtttgttggttcattcatctatccatctgtctgtcctccctgcctcccttcctgtctcccgttcacaagcattcactgtacagcatgctagatttgggggatctgggcagcattttcccatccataaaatatagatattgcagcatattaaggagcattgttaggaggattcaatttgctaataatgcatgtgaagggacccagtacaacaacagcaacagcctggcacgtgataagatgctcagtaaatggtgctgtgtggtcagtcagcaagtctcatcgttcttgtgtaatttccctggcctctgttacttccatttcttagcagcctgcatgatgatggccaattactttcatacctagactatgcaagaggcttctaatgaggcattataggcctcaatctattctattaaattcttcctattaccaccatttgcacttctaaagcattgtttttgtctgtgttactctttgttcagaacctttcagtgatttcctaggctattctgaatttcttactggccactcacagccctctcagtactctgggctcctcttgggatttcagctctgagccatcctgccaccctcttccacctacggaaatgactcaccctctttggtcttctgtatctactgccatatgtgcagggaactgtattatcattggtgagaggagaaaatagcgtatgagccacacatttgggaaactctaaccttccttgtgcagagtcttagttcatttttgctgctataacagaatacctgagactaggtaatttgtaaagaacataaatttgttttcttacagttctagaggccaggaagtcgaagatcaaggtgccagcattgagcaagggcctgtttactgcatgctcccagggggaggaagaccttgtcctcgtgtggcagaaggcagaagggcaaagagacaaaagggggctctactcacctttttgtaatgacattaattctacccctgagggcaaagccctcatggtggagtgaccccccaagggtcccatctcccaaaactgccaccatggcaaccaaatttcaacatgggtttcacagctgacatgaaatcaaaccacagcatgcagtaaagacttatgactaacctagtattcctgagggtatactgttttttaacatgttgttattattcaacaaatgataagagtagtagatgatgcctttttggagctagacttcaagctttcaaggagagactaggtcatttattttttgcgtcctctatcttattaccatcaatacaaacctttcagggggacatgtgcagtagctcaacgcctacaatcccagcactttgggaagccaaggtggacagattgcttgagcttaggagttcgagactagcctggccaacatggtgaaaccgtgtctctacaaaaatgtaaaaatgagcagggtgtggtggcacttgcctgtattcccagctacttgggagtctgaggcaggaggatttcttgaacccaggaggttgaggctgcagtgagccaagatcaccccactgcactccagcctcggtgacaaagtgagacccggtctcaaaaaaaaaaaaaaaactcttaggggattactttctataacagttattttgttgattcatccttaggactatttatcataaccatgttaagctttgaaaatatttactgggtagtagattttgctgaatttgcaggaactctcccaactggtgacagaatctgtagcaaaaagacagatataggaaggtgttaaggtgtttgctaagattgttttgattcatttcaaaggtctgttttctgtagattgcatttgtgtctgaatgagtttattaagttgctgaggaagtcctgcaacccacatttagggatactcacattatttataatcagttattctctttatattttatttcaaccacggaatacaatgtttatatacatttatatgtgtgtgttagtgtgttgctataggatggtgcaaagtattttattttattttattttattttattttattttattttttgagacggagtttcactcttgttgcccagtctggagtgcagtggcatggatcttggctcactgcaacctccacctcccacgttcaagcgattatcctgcctcaacctcctgagtagctgggattacaggcgcccatcactatggccagctaatttgtgtatgtgtgtgtgtgtgtatttttagtagagatggggttttaccatgttggccaggctgctcttgaactcctgacatcaagtgatctacctgcctcggcctcccaaagtgcttggattacaggcatgaaccgctgtgcccggctaggatggtgcaaaatgttctaaattttgtttcccggtttctactttgggaaactgtcttacaatctgattctcctctccctcaacttcagagagtaagagccacagtttgtggccctgtcagtgctggcattttgggactctgttatctatgagtctaatcaataccaaatgttgctgattctagaatgaaatgccttctgattgctgtttataagattctgtctgtagtgaaattaaattgacttctaacagcaagtatctctgtttggaaaataaagctcgtatgttaaatcatgtctattctaattttagtttcctttttctctaccagtttgctgttttgtggtccacaagaggtgccatgaatttgttactttttcttgtccgggtgcggataagggacccgacactgatgtaagtagtcctgaaatcatgatttgatgtcaatgtggatttctgagctttaatttttttaacgcctgtgcaactgttagttttggcacttactgttaatgggaagactcaattctcatagagcgttggcttgtagtaatgagcagatttatagcccatatgagctctggactacatcttagagaatttctcagaggagaatttcttggtagcatgtactgttccactttgggcagctgcattgactaaatccaccaaatttattgtaatagctttcacaaacacaatgcagttgttgacagattttacaatgaacatttatcacccttcagtttatttccgttccctcccctcccctccccacccctcccgtcctcttcgatggagtctcactctgttgcccaggctggagtgcagtggcacgatctcagctcactgcaacctccgccttccaggttcaagcgattttcctgcctcagcctcctgagtagctggcactatagatgtgcaccaccacgcacagctaatttttgtatttttagtagagatggggtttcatcatgttggcaggctgttcttgaactcctgacctcaagcaatccactcgtcttggcctcccaaagtgctgggattacaggtgtgagccactgggccctgccacccttcagtttacttctaagctgaaataaaccaataggagcatcattgctttgggccaatgtaacaaactgctcctggtttactccaggggattcttgctgccttttcggtgtatgttaaaaatgctgctgctgattgaaataatttagcatctgtttcactgaacagtgatctctgaagttgcccatgtgtgaacacataatttcctctctttgtggacaattctgatggtctctgttgcatctcttgtgtacttaaaaatgggatccacaggccgggcacggtggctcacgcctgtaatcccagcactttggaaggctgaggcgggcggatcacctgaggtcgagagttcaagaccagcctgaccaacatggagaaaccctgtctctactaaaaatacaaaattagctgggcgtggtggcgcatcctgagatcctagctcctcaggaggctaaggcaggagactcatttgaacccgcgaggcagaggttgtggtgagctgatatcgcaccactgcactccaacctgggcaacaagagcaaaactccgtctcaaaaaaaaaaaaaggatccacaaaggagtcacggaaaataccaatgtctaaaatatgttggatagagagaaacttcagctgttatatgaaaagtaatattttaactgaataaaaaaaattgtcaggcaggcttagaagggtagacatttctgttctgaattgcttttgcttgatcagtttagtcactcaaattgtgtgcttgaagcgattcccatctttaatgcctgttcccatcaggaaactttaatttgaaagtggctatctcagtgcaggcaagactaaattcttccctttgcgaaagatgacatttttgcagtgtgctctgagggattccgatttgcgttgttgtaacacaagtaagaaggaagttactgtttggtgttcagtgcacgggaacatgcacaatggggttagggtgcttgtggaggcaagatagagtgcctgttgtgggctctgagcccacatacacatacacacgggttccacaaaggctcacaggacatgggagccagaggaagctcaggcgtcaccttgttttataacttcatggacaaggaagcccaagtccatgaacgttgagtgacttgcctgcatacaaacaaaactagttagtgtcattcccctgccctcccccctgctccccgcctcctgccccctgccccggccactttccatacttctcttctggcatattctggaatattgtcttcctttggggcattttagagataaaaatagctggaacgtaaagtactaacttttccaaaaagccaagtcccattgcacttgtttggagttgtctaaaacctcatgtcatagcctttcacttccttgctcatcattcccatctttatcttgctgtatttttctttcctctcttctcttctctctcctcccatttctgccccatcaagaatgggaagggaggatgggcaggcttcaggatgtgagtagtttgtctgactcccttctcttcctttttcttccccctcctactttttcattcttttggttgagtattctttattgagaacccataatgggccaaagtctgtgcttagtcctggggtataacactaagtacagagatatgctccttgccttcctggacattctgctgtgggaaggcagacattaaaatatcactaattcaaataggatacaggtacactgagcaggtttctctaagggacatactgcatttaaactgagcttgacgaatgggtaggagataggcagacaaaaggaagggtgtgtgtgtgcgtgcgtacgcgcatgtgtgcacacatgcatgctgggctgtatggggccctggaaaaggctgtttcagacaaagggaagagcaagtgagaatgccaagatatgggaaggagtttaatcaataacaaacagaaagctgggagttgggtgtctggcaaggattttgggcacaggcttaggagcattgggggcccaggaaagagtttaaccttaagggctcatctcttaatacagtcacattggcggttaagtttcagcatatgaattttcaggacatggaccattagcagacacattcagtgtgagatgcctgacgctgggagtcagttgagtatggaggcaggtgtggcagtcagaagtggggtatgtcctaaagataaagattcctatgatttttttttaatgccttggatgtggatcatttttgcctagggagagggtatagagtggggagagaagggattaggtctcaggagagagctctaaggaactccaacatgttgcatgggagaggaagatcagggtagggaaaccaagaaggggcagccagaaaagtaggaagaaaaccaggggagtgtgatgctgattgaatgatttcctaaggggctataggccaatactgtgatcgtatctctgtgtttgttatgaattctctacgttgctgaaactgcgtataagtaggtaacatacagtttgtaaaggacaatcttatttacatgggaaagtctttgtttatgcccaccatggatcaattgatgcctgttaattatttttggtaactcatttcatgctcagattttttatcttgtttggctgatcattatggggtcatcctactcatagggcctggagccaggtaaaaagctttagaaaagatatgcttggtgcgaaatataacggaaacacacccgtgagctgatgcccagccatgtcctgctcctaatcttgtgttgactttctgtagatgctgagtcttacacttaaaatatccttgaaagtaatgatgattagatgaattttttttaatgtgaaagagaaagaggtatattagatattcaatgcagtcctgcctgcctggttcacaaaagatcatgcattcacccaaaagatcatgcattcacacctgcatccatactcaactgactcccagtgtcagacatctcatgccgaatgtgtctgctaatggtccatgtccccgaaaattcatatgctgaaacttaactgccaacgtgattgtattaagaggtgggccctttaggaggtgattcagccatgaggtggagccttcctgaatgggaccagctcccttattagagaggtacaagggagctgttacctccatttccccttttagcccttctgtcatgtgagtacacagcaaaaaggcaccatccaggaagcagagcccagctggtgccagatacagaatctgctggcaccttgatcttggaagagaaaggagaaaatttgatttttggtctttggagcaagagacctatgactagggctttctgcagccaaggcctgagaagtgttgactggctgtatgcaggatgattttacttactgtgcaaatctgcaagcaaatcttatgaaggtacaaggtggccaaactgtgctgcaccagggagatagttggaaaatcatgaaggcattgggaggtagaactgagctgagatgctagaattttcttattttatccttttctgaataccatttttctgcaaatcccagaagtattgagccagaaggggtgttaaggatttatctgggttaaccttactttgtggatgaggagacaactaaggcaaaaatgatctggggtactgtcatatgttatctcttgagtatccagtgggcttgtggttgattctttcaaggcaattggccatgaagagaaacaagatgttggtggcttgactggattgtgctgccagtggagcacattgacagctattccttggtgcatttgttgaaaattctggtcaggtgtttggaaaactagcagacttattttaccatcttgagaattaacttatcctccagtccttttcagtgtcttagaaatcaatccaataaaaaatgcctgctggcaggctcagtgaggaagaccagtgaaaagaatgggaagtatcagaatttaagagaaaaaaaactgccctaagcatttttcccctgaaaaatttaaaaattttaaattaggattttttttttcgtaccatggagaatggttaagatgtcctgttcatgtgctgcttaatagtaccttcgttgagcttggcagactctaacacattcacagacggggaaaaagaaggtacaatccttgtgaaatcctcaaatattgtacctgctctgccatcttcaagatgaaaggatgggaaaagtactgagaaataaaatagcggtacccaggttacagtagccagatgggaagacattacaaagttcttttgaacagagatgctcttcaagactcaaggagcagtcgtagttgagagtatgcattagtgcagggaatcttggcagagaaaaggctcctgggttcacagaaggaccctccctggagatcctcaggccaatttctcaagggtcctctgccccttctggatgagatggcattctgtaccagcaaatctagagcaaaaagctgagcaattcctagactttaagtccgtccccatacacgctgagtagagaaggaatgaaagcagaagacttaagagaaccaacgttagcggtgagctcattccctggtactgcctgtgtttgcacccggggctcaggcttggatgctgaagtatgtggctcatggaatgagcagcagctgtcttcttacctggtgttgggaaggcactttgaattggtgcaggatttatgtttccaggtgtgtggccctagaatgcagcttggggctctgcccagtaccccattccagcatccgaggtttcatcagacaacataaaataagacaaaagtgctctgtgtttagaaatggcttctcccccttctccaccaaattaagatgcagactcggacatgggcaggtagaagtcgagagtagagccgtggtttttggggcagtgggagtagtgagcctggctttgctctgctgaagggcagcaagtgcccatgcttctttggctgccattgattgcctgcctccgtgggctgctctggccatgatggggtggggcagattcaggaagggctagtggtgtggggtctgcagggctggctctttccagacttcttcctctcacttcttaaaaccttagctcaccagtgtcttcttgatcagtgcggagctccctgttcttagaagagtttctattcattttcgattatgtctgttcatgaagcccaccctgctatgaagaggaagaatggggtctgggggcctcccattatgcatctgtgcatggatgtattgatatgtatttgtgtgtgtatgtttattagcacattaagccctttttaattttttttttttcttgagacagagtctcgctctgtttcccaggctggagtgcagtggcgcgatcttggctcactgcagcctccacctcccggattcaagcgattctcttgtctcagtctcctgagtagctgggactacgggcatgcaccaccacactcggctaatttttgtatttttagtagagacggagtttcaccgtgttggccaggctggtctcgaactcctgaccttaggtgatccactcacctaggcctcccaaagtgctgggattacaggtgtgagccactgtgtctggccctttttaaaattcattttctctgtgtgtcttaagtgagaaagctacaaagcagcactttgacagaataataccaagctcagtcctgctcttagggccacaatgtacaactccccctgccctgcagctttctttttttttgagacgagtctcgctctgttgcccaggttggagtgcagtggtgcgatctcggctcactgcaagctccgcctcctgggttcacgccattctcctgccttagcctcccaagtagctgggattacagttgcattccaccacacctggctaatttttttttttgtatttttagtagagacagggtttcaccatgttagccaggatggcctcgatctctggacctcgtgatccgcctgccttggcctcccaaagtgctgggattacaggcatgagccaccgcgcccagcgtgccccccagctttctcgtcaaaagttgtaagaagagaagctgtttttatgtgtcatccataaaataacacacatgctaagcaactgtttacacataatctttagagtgtttactctgtgcattggatatgtggacatttgagaaagtaaggggtggtgggggagagagtgggagagggatttgttaaaaggcttcaagcgtctggaggtagtaagctttcctcgcgtttttgttgagccattatgtttttatttgccccatgtgtttttaccagtgactctggcttctctggggagaaacttttcccacagtattttgcacgttttatgtttgaaccgtcccgttgaacagaattcaggtgacttcgcaggttattgctctatctcacctggcagacaaccaacatgtataccggtgacgtcacaggttcactgaagcctgccagaatgtttggaaggggaccaaatgaatacattaattaacttgttaaaagatagggaggcttgcttcagacctgggtacaccttcaagtcagtgaagatcataaaactgatctatttgaagaagctgagcgcactgactgtaaacatttaaagctaaaaacggaacctattgcacaaattgctacaaaccaaaagtgatatcccctgtgagactggactccgtggaggactatatgtctagaaagcaaaattgctttcttttctttactacaatcttgagaattctctctttctccagtccttttcagtgtcttagaaaccgatcagataaaaaaggctgctgaaatgttgaaaattcagcatttcaaagattcatttataataaaatttaaagcatttaaaataaacctagaaataaatttaacagtgaatcttctgttttttcgaagtgtacttttaaacattgaatttagaaaaagatgattttgtgagcaaagccagttctacccccaaaacatttttatattcctgaactgacacggtaaagttagatttgcatgaggtacagaagctaaaaagttgcatttaaaattcagcagagtatatcgtgcagagagtcctggagtgggaattgggagtcctgccaggccacattactgaagccctttctagacctttgttttcttacgtataaatatggaggttgaatttagagatctttaaagttgccttcagccccaagtttcattatagtccctctgttattaaacattgattgatagccctgtactgtgaaggttacaaaggtaaagagagttcctgccctcccaaggcagggattatcctctaattgcaagggtaaaccaattaggcaaagagttgtactataagattgcacagggtgggccactagcagtggcccacgcctgtaatcccagcactttgggaggccgaggcaggtggatcacctgaggtcaggagctcaagaccagccaggctgaccaacatggtgaaaccccatctctactaaaaatacaaaattatctggacgtggtggcacacacctgtaatcccagctacttgggagactgaggcaggagaattgcctgaacctgggaggcagaggttgcagtgagccaagattgcaccattgcactccagcctgggcaacaagagtgaaactctgcctcaaaaaagaaaaaaaaaaaaagattgcacagggtaggtgccataagtggggaagaaataaaatgctgctgagtttagcagggagagagccagcctgcatctaatgggagaatgcaggaagagcttcataaagatggtgacatttcaagatgtatttcaattcttttcatcattttcctttgaaaataagtccatcagtgtttttctgttgctcatgttggcccatgggagttacgtctcttgcctaatgctgccatccagcagtgcctacactcaggtgacatatttgccagtggacctgtcataagagtgcaaggagggaagcctgtaatgttctgcatgtcctgtcgggacccccctcccatgagcctctgaggaagcccgagtccatttctgaaaccaccctcggcacttgcccgcagatacccttcttcacttgctgtgatgccacaggaaaccttaaaaagaagttatttcggggaaacacacccaacaaaaaaactccagtgctaattctgctcttcagtgggtggattattttatgtaccagattcacagtaacagaagtatttcctacaagggaagggactcctgctgcacttggaccaaattaatttagccgggagttaaaaatagcctccgagacttctatcctcatccgtagttctgatgagcaaaaggagacagtgggggagtgggtggcatggccattctcttgacccaccaacctctggccacagggaagagggagggatgagtatttgccccgttgtctgcacctgattagctgggaaaaaatgcgcgacgtaattacaaagaaaatgctcccattttcaccagtgtttggaaggcatgttttcaagggagtcacctgggggcttgtcagctgaatccctaggttgtagttcctacctcccatctttggaactccacttttgaatggcctggacgggcagtagtacatccttttcaaaatccttacccttgccgagttgtcagcctctgagagggtggtgagattgtctcgggaggcagacaacaggccagtggaacccagtcagaataagggagccttttgaggtgggtagaattgtttttggtcaaaaaagaggtgagatgatcaattagagtgattttgttgtgaaacttataaaatgcctctgacatcaagtctgggaacagatctttgtgtattaaccatagagagtgtgtttgaatcattgtataatgtctccggggcacttttatttaatatgcttatttatttatttacttattttgaattttagaggtgagacttgctatgttgcccaggctggacttgaactcctggacataagtgatcctcctgcgtagctggggagacaggcgtgagcagcttcacctggggcatgtttggttttttaaaaattatttacttggaggccaggcgctgtggctcatgcctataatcccagcactttgggaggtcaaggcaggtggatcacctgaggtcaggggtttgagaccagcctggccaacatggtgaaactccatctctactaaaattacaaaatttagccaggcatggtggtgtgtgcctgttctcccggttacttgggaggctgaggcaggagaattgctcaaaccctggaggcggaggttgcagtgagccgacatcgtgccactgcattgcagtctgggcgacacggtgagaccccgtctaaaaaaaaaaaaaattatttacttgggatctggcctaggcaacatagcgagaccctatttcttaaattaaaaaaaaaggtcatattacttaatgatcatatttacacagtgaattctttgtgagagggtcctgtgtgttttctctttgaaagccgagtgcctgatacagggcctggcacaaattagatactcaaaaagtattcgttgaaccaaagagaatgagttggtgaaggtctgataacctaacttgatcaccagtcgtatttatccggtcttgaattacttgaatatttacagctgtgcgtgagacttttactgaactcccttaatacccaagagtagccgtctcatcagcatcattattacggctgatgctgggggtgtgggggaacacacctgatgggcttttctgtttttcccagtaactgtttcaaagtgtagtcttcactatttggaatttagtttaagaagtagtgggtgaggcaatagcttttgactggttgggatcaacaattggtatgatggattccttgtttattttttctgaccgatccaagtgactcagtgatactagacatttcgtgatgtacaaacagccaaattacctgaccctgagaactgttgttggaaatggtgtctggagagcctgctgtaggagtgcaaattctcggaagcccagagttggaagatccacggcacaggatgtgacatctttgtgataccatgtatttagcgtctcttatgtgtctggtgtttttcttgcatttattcattgtatgtaaacattaaatgtttcttgagcatttattgtgtgtgaggtattatgggaggcaaaggttaaaaaacacagttcttgtcttcaaacaacttatccttagtgggaagtcatgtatatgaataaatattactattcaaatagtcacttcagcggataacatacataaatgcactaggtatgcattattgttcccattgtacagatgtgcaaattgaggcttgaggtagttaagtgattctcccgagtgcagtagtaagtggagcactaagctttgaactggacctctcaacttccaaacctgttctttttccacagtaccacgtgactgaacagcaaagctaacttaggggcagttttctgtcagtgaaggttccatttttgtgggtggagtctggggtcattgtgactatgagaaatcttaaaatggtaaaagaaatttggaatcatacaatcctgagacattaacagtaaaaaccttcacaaggcagattagcaacgtgaactagtaaagacaggagcatgtagggctgatgggaccgggtgggagctggcagcagtttggagacttggtttaggtccttctgaagagggtacagagtgggacttttcaggacattgggtttctggaaagatccgtttcaagtgtctacaccctaagctgaaagccagcccagagagctttttggctcatgctggggcttattcctggattctgatgagtcatgttttttagaagctgaacttctaaacttctaagccgagtcccattcagttagctggtaccttcctcaccttggctttgttttctgtttttgctgcttaatacatttccagcaggagatttaggaagggtctgtggacagagaagtagatttcccaggatctaagaaaagaaggttggtttactgtgggtattctagctgtcattataactgtgttattttatttatttacaaagggatcatgagccagaaccaatcataacaatcaaatgaacccactcactgtttcagcctctgatggtggctaagagaaaacagcaagtggggagcaccccccctcacagtcgcctctattatgttgtaccagaagctgggatccagcaccctcaaacgtagaggcttgtactagcaagagtcacatggacagtgggaaggtccattctaattattttgttagtaattcagtctgttctatttattcttataatctagcacattccaaaacatatttgttttgagaatgataaaccaaggggaaaagtcaggttttaagaagaatgtcatggccacgaagataacactgccgttgggcgttgccgtggttctgactgggtgaaggtttcccagtgaccatctttgtgtggaaagagcactctgctcctgatgttggggatgtcatgccacccacgtacatcactgtcctcagcattccagcactcttgcctattctccgtgcatctcttccaccctgcaagccattgcttatgtcaccctgattgatcatggtgtaacacccagctgtcctctgcacacaggatcccaagccagaagtctcaggattttcttggttgtctccatcttttttttgtttcacgcacctaataggtttccaagtgctacgagttctgctttcaactctctttcctctccatctccatagccactgtctttgtgaaggccttgttgtgtgctgtgagttggtcttactgactctggactgtttctcctctatgaactgtctttcatattgccaccccgtggtactccagttgttgttgtttttgttttttaatgtgattatgcactctcttgcttatcatcttccaaggttggtacagagtcactcacagcggcctcactggctgttagctgtggctgctggccagggagtcctaaggtctgccccacattagcttgggagggtagtgcaggttttttacaagggagtggcagttttccaagaaggaacacctcagtgtacacacacttaataggcttcccctggcgctgtgtttcccagtgtttcattggccaaagcccagagtcactgtgaaggtttatgaatcagggttctccagagaaaaggaacgtgtgtgtgtgtgtatgtgtgtgtgtgtgtgtgtgtgtgtgtgtgtaaagagatttaatataagatgttgactcaatgcaattatggaggccggcaagtcccaagatttgcagggtgagctggcaagttggagacccaggagagccaatgggatagcaccagtctgattctgaaggtctgggagccaggagagctgatgatgtaagttccagtccaagctcaaaggcaggcaagcttaagacatcagctctgaagtaagagctgatgttttagattgagtccaagagcaagaaaaagctggtgaccaaatctcaaggccttcaggcaagaagaatcctctcttacttggagggagaggcagtctttttgttccattcaggccttcaacagattggatgagatccacctgcactaggaaggacagtctgctttgctcaacctcccgatctaaatgttagtatcatacaaaaacaccattgtgtaaacacccagaataacgtatgaccaaatgtctgggcacctggggcccagtcaagtcggcacataaaattaactatcacagaagggtgtggaacctgggggtatgagtcactggggccgttagtgtaaccatttgccacaggcagacttgtttgggttataattctttcctgtaaatcttattcatctctgtatccccaatgcctagtatgatctctgacttatagtaggtgatcattaatgtttgttgaaagagcgaatgaatggaaaaaaaaaatgaagtctttgattccctaaagaaaatgaaaataatttcatagacttgagtcaagcttgtccaacccaccttattttgttgtcgtggtggttctgttttgttttgtttgagacttttggcaacctgaagccatgttttttagtttctatctctagtgataagcagaaaagagggatgaggaaggggctttactggcccaacaagaaacagaaactaagaacccatgactgtattctctcccttggacactcctaggagtggaatatctgtgaaatgtttcctgcgattctctcagaatcaataccagccacttcctgattacaagttaccatctttagaaagagaattttgttttcggggggaaaaggttttttgtgttgagggactcttcagtgcttgaagtttaagcctaacgaaattatgcaagatgcccactgaactgtgcctgctgtgtgaccagaatctcttaacctcatgagcattttttggttaaatgttggtaggaaaaactgcttattgaaaggcaaaacttgttttgtcacctgcgtattttagggtgatcatccttgaagtgatggcttatcatgtagagaggtttgtaaccaattgcaattcaaaagggagaaatggagagagctaacagcttaaggaatcaatagcctttgatttctttcccatttgatcactgcctttctgggtatattcctgactttacatagcctgcctttgccaggacagagactgtcttcagaaatcttagagtttactattcttgttcatgagaaattgttatgagattgctgtaggaaagtatgtattttactaattttattatttttttttgagatggggtctcactctgtcgcccaagctggagtgcagtggcccaatcatggctcactgcaacatcaacctccctgggctcaggtaattctcctacctcagcttccctagtagctgggactacaggcgtgcaccaccatgcccggctaattttcgtgttttttgtagagacgggattttgccttgttgcccaggctggtctcgaactccggtactccggtgatctgcccacccctgctccccaaataacgtattttaaaacatacagattataactgctttacaataggtgaggcattttttttcgtgtcataaaacatgcctgtgatgaatgcctttaggaaagcagtacgcctattgctagctttctgcacttccaagtcccaagcctattcctcctcatccctttttcaaggcaggaagctttgtagaatgagcatgggatatcagtgtttaaaacataagaatttcatactcgaaaatgatcttctctgtggaggtgggtgattttaggtttctagatattaagcttgtattatgactcatttgttcttaaacaggttgttctccagttactaaaattaatcacaaaagaccaaggaagcttgaaaaagaaggggagttcatacagcaggtcttaaaattagaaaggcagggctgctctcttttgcatttgctcagtttgaatgatgcaccaggatttaggtaattcatcgtaatcgttgttttttccccattaagaattggtaactgggaataacttaatgtgtaaaactagacggggaagaaaaatggtaggctgaatatttaagaaggaatcacattcctaggtattaaaggggcttgggcttgcggatttgctgctcgctgtcagtttggacacgtgtgctcaaatcaggtcattctctcatatagtgaactttttttttttttttgagatggagtctcgctctgtcacccaggctggagtgcagtggtgtgatcttggctcactgcaacctctgcctcccaggctcaagaaattctcctgcctcagcctcctgagtagctgggattacaggtgcacaccaccacactcggcttatttttgtatttttagtggagacagggtttcaccatattggccagggtggtcttgaactcctgatctcgggtgttctacccccctcagccttccaaagtgctgggattacaggcatgagctactgtacccagctgtcagatagtgaacttctgtccatccggcagccagacaatgagagagtccagcacagtagcgcctctgaagaaatacactgcttgccaaatagcttcctagcttggctcctggtttccattcccatcccctacagtttaccctccacagtagctagtctgatgttttgcaagtgttaatatcaggcagatcaaatcattgtgtcactccatctgaacccttcagtgccctcctcttaaccactggaataaaaaatatgtatacccagcctggccaacatggtgaaaccccgtctctactaaaaatataaaaattaactgggcttgttggcagccacctgtaatctcagctactcaggtggctgaggcaggagaattgcttgaacctgggaggcggatgttgcagtgagccaagatcacaccactgcactcagccttgatgacagagtgagaccctgtctccaacaacaacaaaaaaagtgtgtgtgtgtgtgtgtgtgtgtgtgtgtgtgtatttctttctttcccttggtccacaaggcccatcatgattgtgatctggctcctgcacacctcactgaccagaacatcccaagctcattggcaccccagggctgctgccctgggcggttcctctttgtagaactaatcttcatgatgctcattcgtacgatttcagactccgctgaaatactgcctccttcgagagcctttttagatcataccccccttgttattattatttttgagctggcccaggctggagtgcagtgtcatgaacttggctcactgcaacttccacctcccaggttcgagcaattctcctgcctcagcctcttgagtggctgggattataggcgtgcaccaccatgcccggctaatttttgtatttttagtacagacagggtttcaccatgttggccaggctgatctagaactcctggcctcagttgacctgcctgcctctgcctcccaaagttctgggattgcaggcgtgagccgccgcacctggtccccctcattattttctattactttatgcacttcaaaccccctgtcatcatctaaaaccatacaatttatttgttacttgattattgggtatctttccaccaacttgaaagcaccgtgagagcaggatgttatcttactcttctgtttaacctaaaatggtgcctgatgtgtggtaggtgctcagtgaatatttgttggctggatgagtgaatgcattttagttgcacaagggagatgaaagatcttatagggttttttgtttccttctaacaataaaactaaagggaaatgtcctaagatcaatagagactttttcctttctatgactgtgatgccatgccagtgaagcctgagacctgccgtgtgatcggacatcttccaaataaaaggtgtgttcttcttaatcttaatgtttagaatatgcagcctataaaattaattttaaaataaaatgcatacagtcaatcttatttaactagaatacttaaccacttgattctgaatgttgcccattctggataagtgaagtagatgttgaatttaaaaccttgagaataatttgtatctaataggatcctaaccttgaatattatggctgcatatcgacttgggatcagtgtcctctcttagattgtcctctgcagtcattaatttttttctgctaatattcttggtgagcagtagggtgttgttaagtaaattgatgcatcagtgtgataaaatacatgcagccattaagaatgatgcttataaagacatagaaaaatgcttatatgatgctaggtgcaaaagcttaatataaagttattgccatgattgtcactacagcagagttagtgtaggggaacaggaagtagaagggaacctaaaagatggaaatcatttaattgatttttaaggtgatttgacatagggagattttctttttggatttaatcttgttagaacaatacaattttcaacagttataaaattctgtttacagtagtccccacttatgtgtggtttcagttacttttagtatagtacactaagatattttgagagaccacattcacataacttttattacatacagtatattagtataattgttctattttacaattagttattgttattaatctcttactgtgcctgatttataaattaatctttaacatgggtatgtacatataggaaaaacatagtatatatagggtttggtactagccacggtttcaggcatttactggggtttcttgggatgtaggccctacagataaaagggcgactgtacttgtacctttctctagtctaagccatgtaattctcttgaaatatgacagagcactgtcacctcccagaatgctacatgaatgaaacatacccacccatctgagaactctccttcgcccaacagtgtgatgagaaagttgtctgttgcagatatctacactgctgcatgctaagtgtgtcatcctgggattcaaacgtgagtaatagaaaacctgactaagcagcgacttgaactgaataggaggctcgctctcctcatttaacaaaatgtccagaacagggcagtccaaagctgatacagcagctccatgtttctgtgcgggacccggcctcctccagcgtttagtttagctgtcttgtcttgtaggcttctttctttcattctcatctttgttacccggtaggtgtgagatgcctgcttcattagcatcctacccgtgctccaagcaggaggtgagccaaaggtgaactcaaatcacagatgcttgttaaggccgttcccattcaaagaactcctccagaaacaattccattccagcagtttccatttacatcatcttggccagaaccatatcatgtagccactccgatttggaaaatgttaggtttctggtttatctggatggttttgtttgcttgcttttgttgagcatgtttctacctggaacaaagttaacttagttttgtgataaagaagggatgtggccgggtgcggtggctcacatgcataatcccagcactttgggaggccgaggcgagtggatcactaggtcaggagatcaagaccatcctggctaacatggtgaaaccccatctctactaaaaatgcaaaaaaattagctgggcatggtggcctgcgcctctagtcccagctactcgggaggctgaagcaggagaatcacttgaacctgggaggcggaggttgcagtgagccgaggttgcagtgagccaagattgcgccgctgcactccagcctaggtgacagagcaagactctgtctcaaaaaaaaaaaaaaaaaagaagggaatgaatgttggataggtaactaacagtgaactctgtcgtaaagttgctgaggattgccttaccatgtgtgcacacgtgtgtgtaagtcttttcaatgctcctattgctgtgacttcatctctagtacaggaaggattctgtcacatgacgtcatgacaggttttgagatacagtggaattaactgagtttcttgatctgctgatgacagaaaaaggagacaaggatgaggaagtcttgtgtgagtttttctttttttgcggggggtagggtgtctcactccttttgcccaggcttgagtgcagtggggtggtcacagctcactgcggcctcaattctctgggctcaggtgatcctccccccatcagtctcccaagtagctgggactgcaggagtgcatcaccatacccagctaattttttatatttttagtagagatggggcctcgctatgttgccctggctggtcttgaactcctgggctgaagcaatccgcccacctcggctttgcagagtgttgggattacaggtgtgagtcaccatgcccagcaatgagtttttgtttttgttttttgtttttcttaaacaaggcttttcttttatctttaaacactttgttggttctctctgtttggtagttgtactatgtctaagttgtttattttgttaggagcattttgttgtaatcatgaaatattttgagattcaatacttgtgtttattcagtcataatattcttattatataatacttcctgatagtagatattaggattgattgaagcaaagcatgtgtattaataaactcagtattcattaaagcagcttgggttgcctgtagaaacggcagagcatccccaaggctgagggaggcggggctcctctgtgggtagcagacttcatctgcaggacaatgtgcagcacaggctgcgggtattaaaggagggatcaagaaactggtattaccaggggcacttgggaggataggggatcaggtaagccatagcatagagacccagaaaatgagccaggaatgttcagtgtgaaaaaaagaataaggctgggcgtggtggctcacccctgcaatcccagcactttggaaagccgaggcgggtgaatcacttgaggtcaggggttcgagacgagcctggccagcatggtgagaccccgtctctactaaaaatacaaaaattagccaggcgtgatggtgggtgcctgtaatcccagctacttgggaggttgaggctgcagaatcacttgaacctgggaggcagaggttgcagtgagctgagatcataccactgcactccagcctgggcaacagagcaagactctgtctaaaaaaaaaaagaataagttgcaggacttgatatgagagctgcctttctaggaagaagggtggactcaccttgggaactccatgtgctgacccagaccactgacaaggcgttatcaggggacagcattttatacaaccctgagaacaacctccagtgagtagatgtttccagcaacagaacaaggactgcagaacagggaggctgaggtggcttaacaagaaatgctagctctgatctgggccgaagcagcagtgatggttcccctaggccggaatttgatgcgaggctaggatggatattgggttttctctctggaatagctcagctcctcctgtgccacctggctaatttgtactctttcttcaagaatcggaattggccggtggttcacgcctgtaatcccagcactttgggaagccgaggcgggcggatcacgaggtcaagaaatcgagaccatcctggccaacatggtgaaaccctgtctctgctaaaaatacaaaaattagctgggcgtggtggtgcgcacctgtagtcccagctacttgggaggctgaggcaggagaatcacttgaacctgggaggtagaggttgcagtgagctgagattgggccactacactccagcctggcgacagagtgagagtccatctcaaaaaataaaaaattttcagaattagtatctcaggagattttcctgactactccctgtcccccaatggactcctttcttcccctcctcgcccccaattcagttgtttctcttccacctcctgcgtgcctctttgaagactttcataccacttgttgtaattgttcctctgtgtctgcccatgcactgtggcccttgagggcaaaacctatctttcatctccccgtccctgtcctcagtgcttacacagaatctggcatgtatctggctctcaacaaatatttattgaattagcaagtaaatgaatagagatcagattctgcttgagttaaccttgacgttagacagaatttctgttctaacttttttcacgccaaaaccattcttacaggtttttctgagccaatctgttgtggcctcttagcataatggatagttactgagaaaaaagaattaacaccaagttcttggcgcaagtgccatccagttgaggtgtgcaacttccatgcttgtgacaaggttgaaaattactcatcaagctgtttttgcaaagcagtttctgcttatcagtttacgcatgaaaagtccactctgtgtctgtgttgatgaccataacgtggaccatctaacagctaggatatttaggatggttgtgagtacggctgcaggttcccttttgcttattgaaatagaataaccagagaagaacaaggcaagttttaaaaataacttggtacacatgtaggtgaaataaccttacctcccagtagctgagagaaaaaaaaaagatctcaatgctggctgttgttccaggatatttttagtaagatggccctgtcgtctttgatggtcaatgaaggaataatggcagaaaaaaatattaggcgaggagaaggctacgggcattgtttggtgtttcatttaatttccacctcatccaccagagaaaagcaaacataagcagaggttgatgatgagcacagtagaaaggaaaatgtgatgtgtcttttccttgtagttggttgataatatgtgatttgcttataccacattctgatgggaggtattttcagtctgtggctttgtaagttgaagggcctcctaagaaactcctgtttcgtaagatattctctgtcttaacttttttcaggaaaaaatatgattttttggagttgcttaatagtttttagcttttaaataagtatagtttatttaccacagcatttgaactgtcaggattttactgtgaatgctaccagaaaggtttgttctatttttacgagaatcttcttagggaaattgatgaacctggtaacctaattttagacctcctgaaatttgacagatggatggtatttatagtgttctgaatcggtccctattagacatttaaaaatagtcacatcattagagaatacattcaaaaaagaaaagatttttaacccaaaatctaatgcccagaaaatttttagtctcctaaactgggtgtgcattttggtaacagtttctaaaaagcctttttgtactctcctcattctctttcctgtgtgatgctgctgttgtcatggaaacagatcttggagttgctttgttaataccgtgtaagggactccctgaaatggagagttactgcaggtcattatcatcaacacagagctttaatatcaagtgttgtgctatgatgcgtacactacaaagcacagaaatctgtgtttggaggttacactaaagacatttaaccttgacacccataaacactacacaaacatcagggtcttcagtcatagaacctggaaaagtggaggcaatgggctcatgctatttctattgcagatagtgagctatgtcctggtttggggccgtccgttgttaggtgctccattagggctggcttattgagaaaggaggatttggaagattgttgagtgaatccaggaaaggagcaagccgaaagttcacagggattgttggaaatttccaacaacagtttagatggaaattggctcctgggatgaaaaatggctgtgcatattgtgtttgagtgcttggaggcctctagctagaatgtttttattagcaagtttatagcttgtaagatggtccagtcagatattcatgcaaggcattttatgatgtacgtgattttgttgactggggccttaaggtgggaaacagttggaaggtatagtggactcttgctgccctgggactatctcttgcctccccacttatcagcaaattccataaccttcctggccctcggtttcctcacctttcaattggtgattcttttacaagttatactgggaattaaatggggtggatgatgatacaggatcttgaagcgcctggtgcttggtaagcactaattcctccagcccacactttctttaacatttcctatgccagcagttctcaaaggggcttgccagacctcagcatcagtatcacctgggagctcattagcagatattcacacaccacagatcttctgaagcagcaaggcagcggctggggcctggcattctgcatttcccaagctctccaagtaatgcctatgtttgagaatcacaaccctagactatgtttctggggccaagattaccttggatatggttgagtgcagttctccttaccatgtaagattcctggcaattcccagagctcatacacttcactgttaaaataaggtattggagaaggtggcttttggattcctaagctattggaaggccaggataactggtttgttttgtttgtttgtttgtttgtctgttttggctgaaatgcagtgatctgatcatagctcattatagcctcaggtacatgccatccacactaataattttttttttttttttttttagacagagtcttgctctgtcacccaggctggagtgcaatagtgtgatctcagctcgccgcaacctcctgggttcaagcaattctcctgcctcagtcttccaagtagctgggattacgggtgcctaccaccatgcccggctaatttttgtacttttagtagagatgaggtttcgccatgttggccaggctggtctcaaactcctgacctcaggtgatccacccgcctcggcctcccaaagtgctgtgattacaggtgtgagccaccatgcccagcccaccgtgctaatttttaaatcttttatagagtcagggtcttgctatgttgcccaggctggtctcaaaactcctggcctcaagcaatcctgcctcagcctcccagagtgctgggattacaggtgtgagccacttcaaagaacagaataactttgaatgcacagtttgtatttgtcttgctatcaaaaggcacgttaagttcaacttatcaaaggtaatgcagttagcaaccatttttcccctaaatttcaggtatccagatttattatttagaattatactttctccttgggctaaggaaacagttggccacacttttctactctatattcttcattcctattccaatgtgactgctgatttctgacttttaaaacctaaaagatttcttcctaaacttatcaggaaaagtaaaatgactccagtaccacttgccactgctattttagagacagtgaaattctctgaggtctgtcattcctgattttattgctttataaaagcctgctatagaatgttttttaaaaatacaatgatttaaaagtctccatgccagggcagcactggcaaatgaggaggcaggaggtcttcatgtaggagatgcttcggggacagtgtggcttgtggcagcctcaggactctgggcatctgtccactcagtacaaaccaaactgcagctccaactaattttgatttggaaattgcccccttaaaaaaaaaaagtactaaaaatgtttgacatttaccagatttctgcagcagtctgcagtttctcttgcaagtatattcacagacagtgaaaggaagtatttggcaattgctaactcatgtttttatatagtgtagaagtccaaagatggtaataatgtcatattatagtgatggcgatctatagtgtaaagtataatgaccataaaagagttctcatttttatagtttttaaacatgatttcagcatccagaggcaaactcctatgtaaggataatggtcgtgcatggccacagagattttttttctttaattctcaattgcttttcacgcttaactttttctaataagtactatctcccaagattccagaagatggtacaaatgagaaaataaggtttatcttttctctaagaaagactaaactgtgactttttttttcctttctggctaattaggacaacaaaagtaaacatccaattatgcagtgatgaatcaagtcatctggctggagctggattctttagtgtgttaagttacagtaaatattgaaaagaaggactttatgcagtaggactgttttcaagaaaaagaagaccagtctcagccaaattcaaatatcttgtagagaataaatgcctcttgggtttatggatttatgccatatgtgtgagaagagaaaatacggtcaagaattgttgtatttcttgactccttgaaaggcaagaacactggcttgggaaatagggacacctggtttctagtgttagataaatcttcagaatacagaatgctctttgaaataacaaaatacttgagtgaaggaaagaattgaggaatgaacttaaatttagctctgaaagaattctttcttcagtctgtggttcccttagctactattcaatctctcatttccatcttagccatattttagcttccaccctgtatgacagagacaggggtctttctcttggtttggagcacacatccctcaacatgtccagtagggagctcctgggcgacgggtcctgcaggtggatgtggaccaggagccccgtgggaggaacgtgcccctggggagagctggtggataccccgaatggcaggccacctggggcaaagccagtggaacctgactatggcaggatgagaacaccagtgttttataatgcccacttttttttcacttcttgcagtttctatgtttatttcctgttagcatttagtagtatctttatgagtttatctcagttatgctaggcagaaaggagctcttgtcagttggcaggaccgaaaggagagaataggcagggggaagaggggacagtaatcgaagtaggagcaccttgagcgaagtgaaatgtgggatggaaatggaagctcctgtttgtgatctcccagagaggctcagtccagcgccaggtgccgtgtgcttgtggaataaagagaccgaattccttctgtactgggggttcatgctgaaccccacctttgttgaaggggaggaaccagctgcccaaggcaaactagaagcatgcttgcaggagggaaggttaagacacacagtttatgtgcatagcagtgaaaaccatagtgtctgttctgaagtttgggaaaatagtgtgagactgtctagctgggtctgtcattggctgatgtgtagtatgtgtgggtcgctcactaaaaaaaaaaaaaagaagaagccaggccccaaaggaagagggcattattcataatgaaacctactatgaatccagtggggtcttgatttctgcttcttcctgggctgtgccaccaggacttccttgatagacctttggtgtcatcatgaattctgttactgatcccggaataaagatttggtgccctccggtttccaacagtatccagagatggccagggaggatttggatgggaaggattaaagtttgtatacaggagagaagacagtactctctgaagtgtgtgtggcctgagtcacctggtagaggtgggcttgggtcaggttctggtcacactgtcattctggctgcagaagaagaagcaagatgagtcaatcagtgtaggatttcagagtgtggggcactgacttcccaaatttggctgcacatctgaatcacctgggatactttccaaaatgcattcccccagttcctccccgaaattcaggcaggtcattcttaggaaaaactgggagttaaaaagcacaaactttggagtcaaatagcacttgggttgaatctcagcatcaacatcttttattggttgtatgaccttgagcagggcatttaacctctccagaccacagtttgtctgtgggcagaagacaaacaatcctacttatttatagagttttgggatgaattagatgaaataatgcatttaaaatgcctagctctttgcccagcatatagtaatcattcagtaaatattagcttatgtttaaccaaaatgtgtatgtcagatccctgcttagtactgtgggaacatgcaaaagaattagaaaaatcatgctcccttccctgaatatggctgagaaaaagcgaatgcacctgactatttggtgagttccggcaggaggaggggacattgtaatgaagctcagattgccggaagatgctggaaggatgcactttggacctaaggcaggtccagggtggtgcctggtggacatgaagaaggcagcaactttcagagcgagcgtcagaggggcttgtaatgaacagaattgccttctgatgatgtcaacatatctaatacaagactctgactaattactatttatagttgcttatattcaaaagcttgtttatgctgcaagtaaggctgaaaactgtcagcagggtgtagtggaaagagctcagagctgagtctgaactcctcaatttttatcccatctgtgctgctgactagctgggtgacatcagacaagcctcgcaactcccaggcctcagcctctgcaacatatacagggtgtgtgtgagtgggaggagatgggggattagacaactgctagggtcttctggctccaacattcaacaaaaacatttactgcacttctttcccaaaacttactgtgtgccctgattttcaattcctgatactctgtaaggggcattgttcagtggaagactgtgtgttttgctaatttgttgcttgcgattcagattcctttaaagttagcaaagagcatttttgttacattggaacaatataggaagtatccttcattatgctttcatttgtttttgagtcacaagaaactgttactgttgttttgggagactgatgtgggaatgtcttagcacatcatttctctactctaattttaaatacgggtagtccctgacttataaacagttgacttgagatgacccatatgtacagttagtactatcttagatgtgagaatccagttctcatctcctactgcagagctcttctgtaatttttcaatcagaacacctaggagatgtctattcttctcatttcacagatcttcactgcttgccttttatgggccaggttctcttctgtgccctgggtatccagcagtgaactaagcagacaaatctctgtgctcacagagcttaggttacagtgccattggcctggaaggtacgcttgcctattgccccaggtgaggaggagtctgtgacaggtatctgggtctgtcttcctctatccaagatcacttcccccacctcttccctgcaaggagactaaatcataaaaccacaatgcctttttatgtagaaacaatagaatatgtgactgctaggtatatgtagtatattgcaaagaatagccacagatcctcccatcctggttacatgttctcttataacgtgtctttgccatgctttcagtcagatgtctatttctctactcctgtgagtcaagtggctttgtgacttcctttgaccagcagaatgcagtgcagttgacatcatgggagttctgagctgaggtattaagagacctcacatatcccactcctgcttcttcactcagaacttctgcagccacagaagttctgattaccctcctggaggatgagagaccacgtggagcagaaatgagtgtaaaacaaaccagcaccattgagttaggccatcaggcacctgcagctgcatgagctttcaccagcttaaagtctcaagatgctcaccatcagcatcatatttttttgttactaataattgaaagatgtaaatatttatgaacttaatatagatattaatatatttcctatttgtcatgaatgaaataggccctggaaggttggcattggaaaatgcctttcacattttggaccatccacttagagacacatttttggaaaagaaccacttgaaatctggtgcccagctgtacacgtgttttgtggagagagacagattagcgctggcacgtgtgagacagtggttagtgaagggtggaagatcgccagggctcatggacctgcttcagatggatgtaaatagttggagtgtactggaaaggtatgggactaacatgaccctgaccagagtttggacaagtgtggtttcattctgggggactgacacttatttctttcctagaagtgttgatgaaagtcatgactcagtaatatcagaagtgtgggaccaaagtggaaaataaactcctgacttcatgaattaaacagaaacatgtcagggccactccatactcttcttcctgtcttccaaaagtctctttttttttcaattcagaagaaggtctgggaacattctgtgcacataattattttataaacaatattttatttaatgcccttgctaataatacttcctataaataaacaataagagtcgtcatggttccagattgcctttatgataatgatataccatatgtttaaagaaatggtctaaaagacatactgctgtgattgaaacatttttggaaattgtgtatgctaactgtatattgctctacagaaatctgttttgatcagtggataaaagcagctacacataactatgaggaaatcttgagaacatttattagtaattaaatatatagctgaaatatgtgcctatatgtatatccgaaaattattataggagatggttttcagtgaagatgattgggtggctttgaaataaataagtggtttggtttatgattaatggatttattaatttgctatggtcacctaacaatccaccccacaagttggtggctttacaacaacaatcatgttatcgcttccagtcatgttatcacttgcagacataatctgcatgtcacctgagggttggctgatttcacctgtgctcagctaggcatctcggcctctcattgtgaggctgtgaatggactctgcgccgtacctcttctccaattctgacctggggcagctagcttgggtgtgctcttcccagggctaagggggcaaggcaaacccaggaggatgggcagaaacactaagtctggttcattctaggcttggtaggggcatgtcgttacttctgtctcattatgttggccaaagtgagtcacatggctaagctcaaagttaggaagcagggaaatagactgtatctttaggggaggaatttcaaagtcatatgaaaaaaaaggtatggatactacagccagggatgaacatttggagccagtaatgatattcacccctgtgtctgtgtgactcctaagaagagccaagacttgttaaagatgagcagagaggtaaattagtttggagatggtgaagaagcagtttggggatactttggtctgcgtataacattgaagacacctgtctttccttgtataccaggggttgcaaactatagcttattgggccacatcctgcccaaggcttgttttattggaacacagccatgtccagtggtttgtgtgtgtcttgtgtgcagctgctcagccctgccacagacagttgaatacttgaggcagagactgagtggcctgcagagttgaaaacattgactaccgggttctttgcaggtaaagttagctgactcctgtttgatatgatgcaactggatagaatccatttggctataatctccgcctctctacctgcccaccccatacccgccccagttccttttaggattttcctactgtgctttgcattctcattattctgtgtttttataaaataggtaaaataggaggtaaagttatcctggtgcctggctgttggcactgatgaccaatgcaatttgcatccacaggtcataatccttaaagtttataaggcgacaaattgcagattagaggacatacaaatgagggagccagttgctacttttgcctttattattaatgttttgtggctctgcgggtcattcatgatgttagacaatagggtgattatttctgttctgctgaaagacaatctgattgtgttttgtgtagaatgaggcactgatccgctctgcctgcctcccatgagaaatgccgcagacctttgtctgctcaaacctcctcccgtcagctctggtattgtgatggaagtaattgaccaggcctcatgggtcagcatatatctgtactgctgtttattcttctttctactttttaaggactaaaatcactttcttgtaaaatattacaaagacattttaaaagaaaagactgtccattgtatttttccacccccttaaaatatattcataatgatctttttaactgggtgggacttgatttggtttaaaaacaataatcttggtgactgtatggaaatacggaaaatgtttaatacagtattccattaaaaacatgatacaggttgggcgcggtagctcacgcctgaaatcccagcactttgggaggtcaaggcgggcggatcacttgaggtctggagttcgagactagcctggccaacatggtgagatggtgagaccccgtctctactaaaaatacaagaattagccaggcgtggtggctactgtaagcccaggcatctgtaagcccagctactcaggaggctgaggcaggagaattgcttgaacccgggaggcagaggttgcagtgagctgacatggcaccactgcactccagcctgggtgacagagcaaacgaaactctgtctcaaaaaaaaaaaaaaaaaaaaaaagatgcataattgctgcaggtatgtgattgtaaccatagaataagtaggtatgtacatgtggtagatagaatgatgtgccttccccctgaagatatccatgtcctaatatccagaccctgtgagtgtttttcctacatggaaaagagcataatgcagatgtgattaagttaagggtctcgtgagagattaccctgggttatctgggtaggcccagtgtaatcacaaaggaccttctaagagtgagggatgaactcacaaaaggatgcagaagcagagttgggagggttgcccttcaaacatggaggaaggggccatgaaccaaggaatacaggtgacctcttaatactggaaaaggcaaggaagcaggggcccccggaactctgcgagcacctccattgtagccttatgagactcattttggaagtctgaccccaaaactgtgagataataaatttgtgttgctttaagtcactaagtttgtggtattatgttacagcagcaatgaaaaactaatatggcacataagactggaagggaagatattttaaaatgatagttggaagtacagtgtattttagtttgtgtattttgattgggtgcttgtgagtttactttggttggttaagactaagaggcaacagatgacttttaaatgttagaggagggaaaaatggtagagtttcaagttcacattcaagtacaaatgatgaataagcccagccaaattgttctccagtttgggttttgatgtattgggttcaaatggttccagccttaatggagaagccagtttcttttttcttgttgttttattgtttttaagcctctctctggttttcagtagagtttgaccttaaatatcatctttgattactattggtgtccttgtagttaaggtctttgcaaaagtttgagtgcaagttttaagctaaaaacacgtttttaaactttcacaaattttgtaagatgacaatagcattctgtaacatagacattatggtaatagtgattttctctccatccctattttgtccagcgatttccaagttataagacgtgaataagactaaccgctcacttccaccagcagctgacctggtgggcttttgagttcaaagagtcatttcttcatcttacctccagcactgcagggccgtgtgaccttgcagagccttgtttctcattgatgaaaggagctcatgcctcatgaagccactggtaagggccatggagctcacgggccatcaagcttccttcccatcacttgtgggtggaattgacattacccgatgagctcttcctggggtcacctgggagggagtggcccatgggtggtatgacaaaatctcatagtcagtctttgcagttttctccacaggtaaaatgagattttggaaaattttcatttgtttgtatttgtcccaaggtgagtcttacatattttgagcaacaaaacgaagatcattatgaaaatgtccttatggaagcactctagggccattgctcatttttatgagtcctcgtgctaagtccctgagtactgtggctcatgtcttagctggctaaatcacagtcaaaattctcttcttaagcctcaaaataagctgctgattatactgcctgttggccagactaatcaaatacatttgatgtttcagctgactccagatacttttccttcctcctccttggttctttaactgtcatcccagatctgcgacatgcaataaggaaaactgagtcagggaggaagtaggattccttttgctgctaggaaccacgttagctttggattgtccatagaatgcacccttaacagttcttggaaaatggatgatatttggttcctgccccatgttcagtgttctttggcagctgcaaagcatatcctagctagaatccttatcgtcttgaagttcatcaaagattttgaacagtcatggtggagatacaacctaagtacattcatgcccattgagacaatcctttggtttgagcgacggaaggaggaataaacacatgaatgtattttattgaatcccagagaccctgaaacaccaagactcattaatatatgcatacatggatggcagaataataaacctcacctgacctgtcagtgtactctcagtttttaaggttctcccaaaacagggaaactgaaaaatacttgggcagaaagaaaatatcatcaaataacacctatttcttttcagctatagagatggctggatatcaaaagcaccacgggagctttgcaatttgctgcctcttttcagccctcagcttgactctcagttttcaagagggagaaaatgaatgtttcccagcattctctgtcctttgctccaaagaagagagcaggtgttggcttccaaaccttccgtattttcttattgctgttagggggatcaactgcatgtttcctgagggaaaagggtggctcactgacctacttgaaggcattctctcagtggaagctgggcaagagaatccagggatttcttttgcaggtttctgcgcagtgcccctgccatcaagctgcctaaaatgtgaatattgcttccctgcgtttcagaggtggtaatattggggcaagtggtggaggatctaaaaaaaaaatcatctttgtgctccctaccttgcccctggtatggattaaacagccaccaccctccttctcttataccctgggggcctcctgacaatacttccaattgctccattgattacttagattttttgggacacaagggcccacgttgtgtcttcctgacaacacttttagttgctctattgattacttagatttttgttggcaattaggagcttttcagtaacattctttgctccatcggtagtctctgctggctcttgttcactcaggaaacacctgagcacagggcttcaggaaagccttctattaaatgggcagaggccccagcaggactcctgcatgttcatctgcacagccagagacagctggagggcaggaggagccgcgttcacatagggttctgcagccttggagccgccgtttcttccaagtactcttcagatcagtggttcttagccctgcctgaactgcagagtcctccgaggagctttcaaatgaagcatggcagcctgggcaggttgcaggtccattaaatccacatctccggggtgggagccggtggcatccttgctttgccagaactcccccattgaccctaatgtgaaacctgggctgagaggccctgcctaaagctcgattattttcacctgtggatgtaggcgatcgcttccttttgtggctgttgtcaggaggcagaaaatcccctgggttgttggctccctggagtcttatttttacagagtgccctgtttcaggtgcagcaacctgactgatgtttttacaaatcaccttttggtggcctcctgtcactgctgtctcccttcaagggttaaataagcctctctcacccattccttttcacacctgtgtcgtgtattattggcaggcctcagtcctcagggtgtcaaatggaactgatggatgccagacattgtggatatctgcaagtcctggttggtgaccagggacttgaagagtagactttcttctcaaacttatctttgtgctgttttccttccccagacctcatagtctggagcccatgtttccaggggtggaatttgattttcccagagaggagctgtgttcggcttctaggctgaggagctaagctgccgagcctctgccagccctctgtggattcgctcctgcattattcagcgcctttgctgacagagcaccatgttccactgctgagcagatcagggtgaatttccaagagggaacattgcagatggttttgcctttagggatggattttcttactcccaagtgactcacttctggtaaaattaaaaaaaaaaaaaagaacaaccttgagtcccttgagtctgtccccaccatctttgctcagagggaattaaggagccaattcagagctttaaaaaagtcacgtgatgattcattatctttttgctggttgtttcctgccccctccccccccacccccacccactgacttgtagtttttcataagcatttattcatccttgaattttattttatttttttatttttttttgagacagagtcttgctctgtcacccagggtggagtgcagtggtgcgatcttggctcactgcagcttccgcctcccgggtttgagcaattcttgtgcttccacctcctgaggagctgggattacaagcatgcaccaccatgcccgactaatttttgtatttttagtagatacagagttcatagccaggctggtcttgaactcctgacctcaggtgatccgcccacctcggcctcccagaatgctaggattacaggtgtgagccactgcgcccggcccatccttgaagtttaactgcaaccccatctccttccctctttgcatggggtaaaaccctactgcaaggactcactagaattccttccactcacatcccctctgatgatctggccttgctgtcaattgctgtgaccatggacaagttgccttgctgcctctcctgaacatgggaggtacacaaggcctttcttcaggggtttattcccagcagctgatctgctgctgtcggtggaattagtttgcacacacagcatcccggggagtggaacagtgctttcttagcacaaaacagacacgtttgcttcccttctttcagtgaaggggaacccacggctggaaaatactggaaggcaattgtaaccttaggcagccaacaacacttcagtcctttggaagtggattttaaggaagaggagacttcaaacggtagagctctttgtgatgtacctcttagagaatacctttttgattcctacacttattctcctctcaccaagtgatacttaaagggatgccctaaaacagcagtaaagtcataggcccctttttataaatttcatgaattcactacttttttcccatcacgtcttctcttaaccaatgtatctgcatttggtttgcgtaaaagaagaaatgtttcctctgctcctgggctcaccattaattctgatgagataggcctttctcctctaaaggcaacagggcattggccaaatcccctgttttactgcatccctttttggagctcagtattggcctgtcctgacccccctggtttgcctcagaataattattaagggcatgtgtcttgaaacaagtcgcacccaaggctgctagcctgtgtattgactgcttgatttataacgaatgctgaatttggctaggcaaatgagaaacgtggtagggtcagccttctgcctcctcctggtttacagactcatcttgcccattcatttttcccatctaaggctttaatttgatacccagtgggttggtcttaagcaaccaggcaagatccagaggagactgtccaggctgccgcccccactggccaggcagaccccgttccttttgcgagtttcctgcaaggctgttgttgactcgggggagcggcttttagttgctcaggcttctttctgctgctgcagaggaatgtgttcccctgtagaggctgttggaaagggcagtgcagacaagccggcttctcaggcatttaaacaagttgtctggaggttgtcagactctgcagcgcatcagcccctccttttgttcgttcgtaatgccacagtgtttatggagccctgccttttggaggagtgggaagtggagcttccaactgttagcctatgtgtttctgtcatttagaggcaataagaagaacatgaccttttctggaactgctgccccccgcaccccccccaaaaaaattagaaaatggttagttttgattacattcaccttgaccactttcttcccaagtgaagctgaccacgattctttgttggagccaagtttttgtatttgcatattcccctcgggtaggaactgggtcagttattattgttctaactagcaggcggaattggggtctctgaggcatgagggagattccattgtcttctgtgtattctgctggtatttcatatctgatgaaggtcgattcttatccctaattgacttcctcttgggttttgtagtctgagtatttgaaatcacatgttgattgggctgggtgtggtagcacaagcttgtaatcccagcactttgggaggccgaggtgggcggatcacgaggtcaagagatcaagaccatcctggctaacatggtgaaaccccatctctactaaaaatacaaaaaattagccgggcgtggtggcgggcgcctgtagtcccagctactcgggaggctgaggcaggagaatggcgtgaacccgggaggcggagcttgcagtgagccgagatcacgccactgcactccagcctgggtgacagagcaagactctgtctcaaaaaagaaaagaaaaagaaatcacaagttgatctttctgaatgttggggcccaatgtatttgagtaataaacttgtaacatgagggaaatggacaagtgaaccttcttaaggactcatggtaatttgactctctcctgtatgattctttactgacagtgacatgaaggggaattgcctggggtagacttaggctgtctagtgtcatatgctgcttttattaatccggagatttctgattggaatatatttccatttcaatgggattagagtataaagaatgctttgttacaattatttacttacaccgccaccaccgtaagtaataatagtagttagcatttaccctgtgtgtgttacctataaggtgctgttctcagcacttcatgtgaattattcctcaaattatccccaaactctctgagactgcgctgttaccattttgctttgtagctaaagaaacagcttagagaggttgagtaactcctccaaggcatactcagcagtaggcaggacttgaacctgcgttgtgatttgtgaattcccacttttaaccacccttcactgcccatctacactgcctcttgcacatctcatattttgccagatgggaaaactcaccaaggatgaagcttccttaagatctttttgagtataaataggccatctgttgatctgtgtgtccatcaggttaggggctcttacctcaagccaacatatggcagaaaagatatgtattgatgtcttgtgggatagttaataaaacacaaatgtgcagtgcagcttctttaacctgctccatcttggacccaaattcccccacccctgctgccaaacaggcctctaactgatggggtgggtgtccccatcagctctgtgctggcccagcttccttggggttggccctcaccagagtaagggcacaaaacacagctctcgaggggttctgcagacgaccagagcctgagaccttttcttggcagctggtgtcagttccctgttggatctgtccttcccttctgaatcctagtgggatctcctcactacctggtcactatctctgttctcacaacaagatttaaacaattataggatatcagtgcactgtgagaccacaaactcttctagtccattcccctccttctaatgaggggcccccacagctgtggggttgtatcatctaagccagacctccagtttccttttcactaaaatacctacctttgaaataaaagtgaaaacttacatcaaaacagcatcatgcctggaacatactgaatggacagcatttcctttctttcccctccttattctcctgattattaattatttgcctgactttggatagctattggcttctgtcctctgatattaatgtactcataatttctgtttcttacctggttttggactaattgctctatttttatttttattttttggcacatgctctgcctctccaattctgacatttcttgcagtcctctcagcatatttctgatcacagtcccaaatgacattgagaagccctgataggaaaatgctgtgtaagaaatatgagttatttgtctgtgtgactagaactttcctggtgtaagttcagaactttccagaacttccctgaactttactctgtccggttcagaccatctgaatgcagatgtctgacttggggatagatcctccactgatcaatcattcagagaaaagccacagaaaacacacaagattagaaaaataaaacccacatggaaaggctttagtgaggttacagcatagattatgcagtctgggaaaagaaggataatgcagattaaaatatctgaaatattagaatagcataaatgtagttaacttcggagccggaagaccagggttgaatcttggcttcttcccttactggccatgtaaccttgggcttcttgcttaacccctctgagctgcagaaggggggatgctgctgttgatgtcatcatcaccaatggcagcagtagaagctatcaatgatggtggttatcacttttattaccattgtttttagtaaggagagctaacgagacaggctccaactgctcttctcccgtgggaattgcagttttctgcagtggatcctgtgacagattcctgtggattcctgggacagacttagccacctgtcctttcttctatcctcctgtactcatcagattgagcaccatgtgggtccagtccctgagatgagtgcttgatagatagaggtgaacgatgggggcttggtcttacagagctgacctgtaaaatcctctccaccatatccagtgcatacagctgggcattctttgtgtagatcaccccagttattagaacctctatttcagtaattcactctctgggctctagttcttccttgtgaattttactctcagggaagccccgactgtgctcctgaagctgtttttatttgtagtaatttagcatgcgtccaggaattgaggactcttgcctacccaaaatcagaggtggggaggaaaaccacggtatttcagtccttttgttctttttgaggtctgtaattcaccaaagccaggtccaccaaagtaaattattaccataatttatggtgagaattatttggggccacagatgtcaagtggaagcttgcaggtaagtatgattgagaaagtacaaaattttgaaatgaactctaaccttatgagtctgttgctctaaggatctaaggatattaggaggtagtgttaagaatcacaactgcattgttaaacgccaagtgttctttgtgatttgattgaaactgtagttgggattcttcaggttccatatgtggggcaacatttaaatattaacattcttgggaagattttgtatagacagctttctctgtcatccgaatgccgtgtggtcttcagagcatgtcataagaaaagtcatgagacacaaatctgatggaactttctttagcatatgtttaagacttgtcatcttcccatctcatctttgcagtagaaaaataccaacgtttccctgaacaaaatagaagtattttccacttccccatttctgaagctcctagacgttttatatttcttttgagtaagagattgctttgtatccaggagcctttgcatggtgccttttcttttactggtttgtttatttgggagatggagtcttgctctgtcacccaggctggagtgcattggcatgatctcggctcactgcaatctccacctcctgggtttaaggggttctcgtgcctcagcttcccgagtggctgggattacaggttcacgccaccatgcccagctaattttttgtatttttagtagagacagggttttaccatgttgcctaagctggtctcctgagctcaggcaatctgcccgcctctgcctcccaaactgctagaattacaggcgtgagccaccaccacgcctgactccttttctttttcttgatgttactgaagactttattttggaagtagtgagggcccagagctgatcccttctggagatgtgtcacagggtaaagaatgtggctttgaaactccaactctgtcacttaaagctgtgcctctttcagagttacttaaccactctgaaccttagtttcctcttctgcaaaatgggagactagcaacctgccacccaactgactgctctgggctatttatgagacagtctctgctctcgggagacatccctctttggcttattcatcctcactcatctgcgttggagagatgcacttggtgcctctcctgcagaaggggtgttaggaggctgttgcgtttgtcaccagggaggtgatgttttccccattgggaaccctaggccagcaaacttcgagaagtgtctgtggcagcttgaatgctgctatttaagagttgataaagaggcagcttggagaaaacctcaagcttatttggttgagtggggtggctgtgtgagaattaagtaatgagtagacctgaagcatctggtgggatctccagcagttagtaaatggcagctgtttttattctcatcccttgtgggcagtactgtccagttccagtgatgggcattagtggcatttgggatttgaggataaccttcataggttggaatgagtaccgtagcaaaacagaattctgctcttagccagaaagcattccagttagcaaactacctgacagtgtaatgtgcccagaggacccaggagggccatcccagggagaacagcatcgccatttctgctgaccacatgctgtctcctgagccccggtatctgaggccctcatcgaaggcataggcatattaacagttatgctgccagacttttatcagcagtctgtacttctccttttatcttcggaactgtgatgaaaagaacagtccactcccttctgatctcaacacttaccaaagctcatctgttcacaggcaaatgtactaaaacattttttattggagactgagtttcatgtgtagacatcattgtatttctgtgtggtgtcctcagattttcactcttgttttttccccagctgccttttttaaaaactcctttgcactcttaaacgtcaggctgagtgtatgtgtgtaaataaacgctttgggtggaggatattgttctgctgtgacaagccatcaagcagcacagcaagaaacaatacttttctaatttgtgagttattcttacgtttcccttttgcaaggctagttatttcattaaattcatttaatttaagctttgaaatcttttttttttttttgagatggagtcttgctctgtcctccaggctggattgcagtggcgtgatctcggctcactgcaagctccgcctctcaggttcacgccattctcctgcctcagcctcctgagtagctgggactacaggcgcccgccaccacatccagctaatttttttttatttttagtagagatggggtttcactgtgttagccaggatagtctcgatcacctgatttgtgatctgcccgccttggcctcccaaagttctgggattacaggcgtaagcaccgcgcccggcctaaggtttcaatcttaataagaatggctaacttttagatgagagttttacatcagaaaacctcatcgtacccagagagatgcttctttaattcagatttgaagggatgagtttccttgttctggattaaacagctcactcagacacaccaaatgaatgcagtgtgcagtcctaggtggcaccaatcacagaagagtgaaaagcataaaacagttttagaaaaggtcaccacacttagaaatagaaatccacccttgctcacgcaacccgagggatttgaaaataatttcgaaaatcaatttaaacatgtaggccacccgtcttttggagagatgcagttggtgcctctcctgcagaaggggtgttaggaggctgttgtgtttgttgccagggaggtgatgttttccccattgggaaccctaggccagcaaacttcgggaagtgtctgtggcagcttgaatgctgctatttcagagctgatgaagaggcagcttggagaaaacctcaaaaataaatactctgattcatcattgttgttcaggctttccagccgtcagagccagcccagggttctgagacaaagggtaacattcagcacagagcccagcggagagtctggagccctgactgtctctaaaagagggggcggagagggaggcagctgcctgcaaaccctggagtggggcttgacgctggggggacggcgtgtgctggttttgctgctttgggggtgaggagaggatgaataatccaaagagggacgtctcccgagagcagggaccatctcataaatagcccagagcagtcagttgggtggcgggctgccgtgcgggggctgcagttagaagcagcactcggagtggagtggggcctcccagcggggccctgctgcactttgtgagtgctctgtggtcgaaggccagctgggcctgaaggcaaaacatctggattttgcagagggttcctaggctgagacggaattcaggctgtaggctctgtgagaccttgtgtgaaacccccggttctgtctctgtcacttgtttgagtctcccatttctctgtctatcaaaagattgaatatggtggcttacaacagaggcagtcgagggtaattattagtatcatggtttgacctcgagatctggcacttcctggacctattccgttgtatatttctctgtgcactccctgagcctcccttttctcagctgagaaaatggtcacacctatggtatcccacactgtggaaaatgaccaaataagacaaggtatgtgcaagtatttggtagaaccctacagaggtaggaagtggctgttactagctgtttccactggtattctctggccatctcagagctgtttagggaccattccagctacaggggagggcaagatttagagtagactctcaaatgagtctatctgattctttggaagcacgagctctagtaagatagtttgaacaaagatgtgaccatgaggggttttgttttattttttaactagattttgatatgttgtgtgccgcttctccactgcacagattgaccaagagttagctgcagattgtggctcagtaagaaggtcttgtggtacgtgctcctgcggcccccacctcaaactcttgcctctggtgttcttgaaagaaatgaggggacctttgcccgagccaagggaaaatgcaagattttggaggcttagcccctttattgtttttttcctctgttgcttatattgatttctgcggcaaagagcagttgactgggattgaaagctactctgctggtcttggatgtggaagaaaaaataattcccactttccaaatagaggctcatccagaggcagcagatgccagaggcagcagatgctagctgcagttctgcaggcaggaattgcacgtgcaaagcagagctgacgtccagtccacgcctcatggcactttggaagtgcatctgacaccgtttgcctgccatacacaagccacaaagactttttgaggcgacaggttatgccaaaaattaagtaaaaatgacacagcttcagatgacatttacatatctatttttgaggtttcagaacatgtgccctataaaaatgtacaactgcattgtttaaaactcttctgagtctctgaggattttctatcagtgcatgcctctcagttatcacttaaatgtcaaggccctaagcttgtatgagcccctaaaatgtttttgagccccacagtaaatttttggctgaccacatttgttctatgtaaggctgataacaagccaccacgtggaatctcacagtgggactttagtatcaggcaattgcagagtcctgaagctcgtgttgcggttattatggttctatataaagccccaggggagaaagtcatttcatgcttttaaaattactagttaatgtttaaggagtttatacggagtggactgagccaagcattttccccttaactttaaaattattacagagaggccttaagaaactgttctgtattagatggtgattaaaatatgacctttttctttctttatgcttaggattttcacgatgtggtttgcaattaatttgtatgtgcacagtctttgtgctagtttctgtggacatacagtggtgctacttggccttaagagcttcctgtgtgtggttgggagataggcagttagtaagccatgtgtgctgtgagaaaacccagagcatagaagtcgcacatgagagtaccaggtgctgagtaccatgggggtgagagcaaggagggattatttctgccccaagaaggcttcttgggaaatagagcagttatgaaggacctggaaagatgttccaataagacttgggtgaggagacacaatagtcccaagtagggagggcagagcaccctgagtagaggtgtggtgtcaggaagtgtgagaattcttcagagactgatagtcggaagggattcctctgcaaaggcctgtggaaggatatgaaggttggaaagacaagtgggagccattggggagtctcaacaaatgtgtattgtattgtgtgtgtttcacttggaaaattatcttgctattaatgagaaagtacagattaatgctttttttgttttactggattcaaattatatttgacaagtcatttcattctagtgtatgcatgtgattttcttggaacgagggtaacattttaaagataggatttgatgagtcaatgaggtatttttcaagtagattacttagaaaatgttatagtcataaaatatcttggagttacagttaagagtcaattattgtttcatctataggcatccaattaaagttgaattatgctgttattttcactcaatttccaaagctatgcacttccgtaatttctatccttgtttatagtcagtataatgtttaatgcaatgtgcctgatttagcactttgtgttataaattttgcctgataaataatcaacttattttcttccgtatgacgacagttttcttcacagtgaatggagcttagtgtatttatataaaatgtaagtctgggagagtttccattatagttcaagtatatttaatgttcaaaagaatgcagtatttgtggtttcctggcattctttgaataccatgtggctcttctctcttccttctcaccaaaaccctagtcattttattatttatataatgagatactgtaagatactaaaacataagttattgtgaggtctggcttttgatgctatgaagtaccctttgttatttgagactaatgaaatgaaatcagtgagttccagcttgtctactagtatgttgcttgaaacaattacattcttttgaacattaaatttatatatttgaactataaggaaactctcccagacttgtattttatatactctaagctccattgaccatgcagaaatctgtcagcatatgagaggaacaagcggattatttatcaggcagattttataatgcagaaatacgaagcaacatagtgctgtggtgaagacagaattgaacattgttagacacttagcaatcccaagaggcatcatgaagtccatgtaccctacaccatagaaaaggctacaccccaaagttctggaacaagcctggtttgctggctttctggtgtcaaatgtcagaagcagaaaatgggaggatggtaaaacagtagactcagtgagagcaggactgaacttcagcaggccccataattgtacagaaacaagattgctaggctgggtgctgtggctcacgcctgtaatcccagcactttgggaggccaaggcaggcagatcacttgaggtcaggagttcgagaccagcctggccgacttggtgaaaccctgactgtactaaaaaaaatacaaaaattagccacgtgtggtggtgcacacctgtagtccctgctactggggtggtggggggagctgaggcaggagaatcgctggaacccgggaggtggagactgcagtgagccaagatcagaccactgcactgcagcctgggcgacacagcgagaccccatctcaaacaacaactacaaaagatttctcatggccacttagtttaggaagaagacccccatgtagttcatgaacccaatgctgtgaaccaaaatactataaacactagtattctaggtcaccactgtgatcattgagaaaatgttgaagtatattgacatattttgtttaacaaaacaagggacttaaagtgcgttttagaaatatttgtatacatgctggtttaaaaaagaaaagactaaaaacaagccttagtacataaaaagaaaatattcagttttccagaaaatgaggttactcccttacattgagagttacatgaagccttgttacagtacttttagtcttctttattcaaagaaagaattaccaatatcattttttttttaagatggagtgagtcttgctttgtcacccaggctggagtactgtggcatgatctcagctcactgcaacctccacctcccaggttcaagccattctactgtctcaccctcccaagtagctgggattacaggcatgcgccaccatgcccagctaatttttgtatttttagtagagatgggatttcaccatgttggtcaggcaggtttcaaactcttgacctcaggtgatccacccgcctcggcctcccaaagtgctgggattacaggcatgagccaccatgtccgaccaccaatatcattttttaaaagtaaattattacgatttccttaggtggttaataaattaccattattttctctattttacagatcacgaaatgataagtaacttaccgaaagttacattatttaagttaatcaaatgtttattgattgccagacttttttctaggcttaagcaaatgttggaaaatacttctctgagctttcaaaaatgttatttctacttgtcagtgctgcaggagtttaatacagataatttaggctgggcgcagtgaatcacgcctgtaatcccagcactttgggaggccaaggcgggcagatcacgaggtcaggagatcgagaccatcctggctaacacggtgaaaccccgcctctactaaaaaatacaaaaaattagccaggcgtggtggcgggtgcctgtagtcccagctactcaggaggctgaggtaggagaatggcgtgaacccaaaaggcggagcttgcagtgagccaagattgtgccactgcactccagcctgggcgacagagcgagactctgtctcaaaaaaacagataatttatctacatactgtatgactttactttaaaaaatgtttgtatccttgtagtaagactgttattttttttaatcctacatcacatcatgcattcctgagtgtgagctaccagtgtttttgtctagggctagattactagagctaaaatatcgggagaattaatgagaaaaaaaggcttaaccactgaggctctgtcaatatcagtttttgtggcaggctatgtttactttcttcaaggaaaaatgtcaggcaaaattttatcactacaaatacaaaagagaagaacattaaaaaaatctgatcattatagaaatcatagtcagtgcagaatgtttcctgcagaatccaagtgtttagtgaatgttggtggaaaatatgaagtgtgtcatgtgattggaaagtcatttaccatattcatttttcttttaggaaaaaaagtaaattagattttgtatgagaataaaccttactgagacttgttaattttgctctgaaatttactgtttgatattaatctggccagtctagctttcttttagattaatgttaccatgatacttcgttttttatccttttacttttcatatatctgtgtctttaagtctaaaacgagtttcatatagacagtatcagtatgtagtctggtccttttttatctgctgtgacaatctttgccatttaattgcagtctttacaccatttatatgtaatggaattatcattaatttacatgggattataatttacatttaatgaccactatccttttatttgcattcagttcatcctcttgttccctttttccttctgttgggatgagtatttttaattacttcattttattatgtttggttgtattagtttctaatatgattagctgtattagtttctaaggctgccataacagattaacatagagtgtctcaaaacaacagaaatgtattcatacacagttctgaaagctagaagtccacaattaaggccttggcagggtcatgcttcctttgaaggctcttggcaagaatctttccttgcattttcctacgttgtgttagttgccgctaatcctctatgttcattggcttgtggctgcatctctccagtttccgcctctgtgttcacatggccatcttccctctgtgtgtgcctgccatttccaaatctttctttccttataaaaatagcaatcattggatttaggggctaccctaatccaatattggcctcatgttacttcattacatttgcaaagaccttatttccaaataacgtcacattcacgtagacctggagtaaaggcttcgagatattgttttggggaacacaatacgacccgcagcattagttttacctcttcgtgttttgttttgttttgtttgtggttgatctagggcttgtaatgtaaatctttaatcaatcagtctactttccaacaatattataccacatcacatatggtgtaagaaccttacaacagtttacttgtatttcccctcattttgccaagcataaaatactattgctttaagctactgtagcatctcccatatctgtcccctcctctgtattcctactactactgactaaggtgagctccttgttatttcttgccttttgtcttgagtagtctggagtttcaccagtttaccttagcgatcttgcccttacctatctaccttcctttctcacttaggtatcgtgtttatgtctccagatatgcctgtgtatgttacatctctgtactttgctcacactgaacttgaacaccctcccctccacttatctttcaaacagttatttccctttcaaaaccaagacaagtcttgccttctttgaatcactcaatgcagtcagctgtggtctccctctgtgccctgctatggatgacacacaatctcagtcccaatcccaggtcctgttacgttttactggataatttgtctatcctcttcctcccaaggggataggaaccttgtgagagtcatctcctagcatctaggatgtcaccagactgataatcactgttccatgaatgtacactaaatgaagttatcaatgaatcagtaagttgagtgctggtttcactagtccttactgtttactgagagttgtttataaatgactaaatgttcccttggtaggtgttgtgatgaatcctacctaccctgggtaagttccttgactattcattgttaacttcatcgaaagttacttgagaatcaagagtcattttgacagcttcaaatattgacagaaggctgtggacatattttccagatgccttaaaaaaataggatgatttcctcattgaagtagaaaataacccttgataccaccagttcaactcaaatatttacttgggcaaataattatttgcaagcaaagaaaccatcttacggctttttattctgacacattaaagcacttaccatgagaaaaccatacaaacatcttttagataattttgaccagaaacattggaaggacattcatgacatatcctggctgcttagaggtttgcaaaacatgctgctccactctttttttcttaggcctgtacacagatcccaagtcattttttaaatgtggaaatgtttaaagggttgtagtgttttctgattacagaaaccatacgaattgtagctgtaattgtggggctagagcctgagggagcttttcgctgattcttgttcggggggatttccttgaagtcgacagtggaagaacattataaagcaaaaactacagctccttacacttctccttagctgtgaaaataaagaccaaaaaatttactgagatgatggtgaaggccaccaaacctcacagggctgagtcagctggtgcctatgagggcgcccctccttgacacttccttccttttggcaggaaggagaggggcagaaagtcatctcctgccgcctccctcccctcagaaaatgatttataatgtttgagagatctactgtgagcaaagttcaacacacatgcctaaaggacacgtcctctaacaaatgaggacttagcaagctgcctaccaggcaccaagctgtgtgtaccacacaggtatttctcacttaatctttacaacaacccattaagataggtgatctggtgtcctgagtggtggccctctctcatgcatatctgtatcccaatccctggaacctgtaaatattgccttatttggaaaaaaagggtcttgaggtgaccctatcctggactatctgcatgggccctaaatgccatctcatggactttcgaaaaggtgaggttgagatgggagtgatgctgacaaggcagggcggctggaggaggtgggagctggattccctcctagcgcctaccgaatacgtttcggcaagtttttttttttttgaagcaggctctctctctgttgcccaggctggagtgtagtggcgcaatcacagctcagtcactgcagcctccgcctcccgggctcaagcaatcttcctgcctcagcctcctgagtagctgggaccacaagtgcactaccacacccagctaatttttgtattttttggtagagatggggttttgccatgttgacaggctggtttcaaactcctgggctcaagtgacccgcctgtcttgacctcccagagtgctgggattacaggcatgagccaccgtgccgggccactttctgtaattttaagctaccaagtttatggcagttttttttttttttttttacaataaccacaggaagtccatgcaggtgccattattgcctcattttacagagggggaaactgaggcttagagagatggattaaggtgctcaagtttgtaaattgggtgtgggtggagctcggatgcatgctcagtccttcgtccagagcctgggctctcaacttctttccagtgaggaaatgcaaatttgcttctgtgactgataacagggtgggtggataccagccagggtctggtgtagctcagcaggttgctcccttctgccatgcaataataagaatcacctgtggcccaggcctctctaaagagattgaagtcttagaggaggttggtacctctccaggccacgggacgggaatgacagtgcatttgcctgtgtcgtagccacctgcttttaatcagcactttaaagggggcagaaaccacagatttcacataaattgatattgagcagttgtgtgaattccatttggacctcctctggtggtggttctaacccaaattatttaaagtatttggtaggaacacaagccacttgctgatgagagagaggagtaaaaaaagacactgatttttccattctagaaattttatttcttaaagcaagaaatccttaattgcctcctatgttgctgttcttatttgcccctttttagtggtcagtggggtgtgtttcttaattgtgatggcacagaattcaccttggtcccaaacaagaagtgaagggggttaagaaatctaaaaggaatgaagtttatggaaatgtgagtcacctctcgtcacacaccactacctcctcccccagtcaaggaattcctctgaaattccctgcatgtttctctttagactcttaagacccctgggtacttgcatctccatttagaacaacttgagagaatccctggcctgttgtatttcatatacttcccagtgtctcacacacacgcagacttgcttttctgacacgtgcagagttttactcttttttctcgggtgaagagacgtaaccatgatggaaaatgagatcccaagactaaaaccagttagatgatgttcatctgcttctaagccagcattctctcacaaaggcttccctttgaggtcttcctgggtgtaggtccttggggaaaacgtgccaagtttctgcacagactgtcccttgtctcttgacaattgaaagttccacggcaggttaaagaaggctctgggtccgggtgcagtggtccatgtctgtaatcccaacactttgggaggccgaggcaggtagatcacctgagttcaggagctcaagaccagcctggccaacatagtgaaaccatgtctactaaaaatacaaaaattagctgggtgtggtggcggacatctgtagtctcagctactcgggaggctgaggcaggagaatggcttgaacccgggaggcagaggtagcagtgaaccgagatcgtgccactgcactccagcctgggtgacagagtgagactctgtctcaaaatcaatcaatcaatcaataaggctctgggaatagaaatgggaaagattctccagtgcgggcaaaggaaagcacagtcctgattaaagcttcctgccagcattaaatgtccgttcattcactgcctcctccatggtgcgatgcgggtggaaaggaagcgacacattcgtctttcttgcaaagagcttgcaatgctgtattctgttgagcatgtaagagtggggagctgtgtgtgttttatgaaaatgtcttttgttaccaagcatagctcttattaaacggcttcttttcttttaaagcctatataacatgagttacatgggcgtttacatcaattttgtgttggtatatagtaaattaccccaaaacacagtggcttaaaacaattgatgtttattatttcacagcatcttttttaattgttgttttttgagacaaggtctcactctgtcacccaggctggagtgcagtggcacagtcatgactcactgtagccttgatctcctggcctcaagtgatcctcccaccttagccctgtgagtagctgggaccacaggcatgcactgccacacctggctaattttttatacttttccgtagagacagggttttgccatgttgccttggcttcatagcatctttgggtcagaaattggtacccagctgagcaaggtgtctgcctcagggactcacataaggctgcaatcaaggtatgggctggggctgcggccatctcaagacttgagtaggggaggacccattcccaagcctgcttttcgcagggtttagttccttgcaagctgttggcggaagcctgccttgattctcgccatagggcagctcgcagcatggtagctggcttccatcagagtgagtaagagagggcgagccagacgaaatcagtcttataacctaatccaggagtgacaccccatcacttttgctatattccatatacttgaagtgagtcactaggtccagcccatactcaagggggggatattgtttgaacacttaagtaccaggacaggggacaggggcaaattagaggggaactcagaggctgcctaccatagcagaacagtaagtttcacttgaagcaaacatatttatgagaatcctaatttatatatatatatgagagagagaggggggaattatctttctcttctttcctttaatgaagtataattcacatattacaaaatgcatagatctgaagtgcatagtttaatgaattctgaaaaatgtgtaggattttgttattttataaaaccctgggccatgaggtttctttaaatgccaaatactatagatttatttacagtgtatatatttatgtacagtgtaaacaataggtgtatttggccaggcacaatgactcatgcccgtaatcccagcacttgtggaggccaaggtgggcagatcacttgagcccaggagtttgagaccagtctgggcaacatgacaaaatcccatctctaggaaaaaatacaaaattagctgggcatggtggtacatgcctatactcccaatgagtcgggaggttgaggcaggagaatcaacagagcctgggagttagagggtgcagtgagccatgattgcaccactgcactccagtctgggtaatagctaagaccctgtctccaaaacaaaacaaaaagatgtatttgttatgtattgcatataacaaatgtccctaaaatgtcgtggcttaaagcaacaccatttattttctcgcagtttctgtgggtcacagttcagctgcgtgcttgtgattgagggtttctcccgggctgcagcccagaagtctaatcatctgaggctcgactggggaaggatctgcttctaagcctgctcatgtgatggcaggattcagttcctcgttgacgttagactggacccttagttccttatggctgttggctggactttgccctcagttccttgccccatgggctccttgcttcctaaaagcacccaagccaagattgcactgtcaggagagaactaccagcaagatcgcagtcatggtcttttatactctaatcacataagtgacaacctgacattttcaccatagtctgttcatttgaagtgagccactaggtccagcccacactcaaggagagactacacaagggcatgagcaccaggaggcagggacgcactgagagccatgtcagatgccgcctcccgccatgtatgatgaaatacactatagacacaactgttttaagagcctaccagttttatgaacccaagtatgtctttttagtagaacatctaaatctagacagctagaagaactacattttataaaaatctgaatattttcttttttttttttgagacagagtctcactctgttgctggtgccagagtgcagtggtgtgatcttggctcactgcaacctctgccccctgggttcaagcgattcttctgcctcagcctcccaggtagctgggactacaggcttgtaccagcatgcctggctaatttttgcatttttagtagaggtggggttttgccgtgttgcccaggctggtctcaaactcctgagctcaagcgatccacccgcctcagcctcccaaagttctgggattatagcgtgagccaccctgcacctggcctgatgaatgatttttaaattgtgactcccctatgctcaaatgagattggatcaaatgtcttctctagcaaataaataattccatagctagaaagatctttggtaggtagtttccttcctcttgtgtgttccctgagctctcctactgacgttttggaatattttcacagattcttgaatactcctccctgccagaggtaaagagcttaactcttatcctcttaagtgtggactagatttcgcgacttgcttctaatggatagaatatggtagcagtgacagtgtgtgacttctgagaatagctgtaaaaggcatcgtagcttcctcattgctgtttttcttggatcacttgctctggggaagcccagcagccatgccgtgaggacactcaagcagcctttgaaggagctgctggtgaggaactgagtcttcctgctgacattgacatgagcgaagcatcttggaagtggatcctttcatttttcaggtaccgtgccagggcctgtgagggaaccaagacgtgtaagacatggcctctcattagtgtttaagcagtagagaaagctggtgccatctcattgttcaggagatgaagtgtgtggccggggtgatccagagagtctccttgaaagtacagtgttgaaccttggactttggggtagaattcagacagggtgatggacagctaaagtggttcagaggctggggtacagcatgaggttattaaaatgatggggctgagaagtacaagacctgtaagtgaagaactgggcaccagacattggcatgaagagaaagaagacacctgtgttcagaagtgagcctgccagggcagagttaagactttttgctggccaggtatggtggctcacgcctgtcatcccaacactttgggaggccaaggtgggagaattgctctagaccagcttgggcaacatcgtgtgaccccgtctctatgaaaaaaaaaaaaaacgagagaaaaaaagttatttctcaaaaaatagccttggacttgttcaaatttggatcaggtgtgaacttgtcccagtggagccatggagcccaggctgtgtgtcagaaagcctgcaataggcttccttgacccagaagatttttagagcctccattaccaatcacgctatgacacgtttcttgttcccattggggcctgtgtttcaaactttgggctggaagagaacattcccgtgactactcacatcatttctattacctacagctcttctcccctgtattgctagtctgcctctaccttttgagatcctactcactctccgaaggtaaggtgggtgacctgttaattttaaaggacttttttttggtggggggcactagcaaataaattaaatctatggatgtgaagggagtttggttatgacatccactgccccattaacagccttgtccttcctcttggcttcccaagctgtgtgttctgttgaagaggaggcctctccttgccccaggaatggatcagccagttgggattatctgttgcctctaaacacttgtagtactgtgttgatgccatcccattgtacttgtgattccacgttgtcaccttaagtagattgtaaattcttttttttttttttttaaagacagggtctcactctgtcgcccaggctggagagcagtggcacgatctcagctcactgcaacctctgcctcaggttctggcaattctcctgcctcaacctcccgagtagctgagactacaggcgcacgctgccatgcccggccaagtttttgtattttagtagagatggggtttcaccctgttgcccaggctcgtctcgaactcctgagctcaggcaatccacctgcctcggcctcccaaagtggtgggattacaggcgtgagccaccacgcccagccagtagattgtaaattctttgaaggcaggtatcgtatctttctgtgcagtcagcacagcattttaaatgcaatgcttgcttatgaagggctgtttttctttctggattgttgcgtgtggcagatggagtgccacgcaaccagacttcttggctacaacacacatgtggcttcttttatggaagttgccacctgcagatccttcaccaccaagaacatgcttttctgtcatattgcagaatctttgtggaggatcctcgttcttccttaacttcctttgtgccacacgcttccccacttcacttgggcacctttgaacagagaagcaggattgctgcctccccaccagtgtaataaatgctctttacaaatgtccctccttggaagtatatcttgtagaaatcctagtttctaacttcatccaagaaatttctagacaacttgtagcctagattatcctttaagagccacttacactactggaaaacaactccacccaggttcttatttgagttacagggacaagaagcctttggattgcaggtttaaaaaaaaattttttttttattgctgagacttctattatgaactaccacagttgacaaactgttagtttccatagcaattttagactgtccttaggtgaagggtttcccttccagttgctatttaagatgtgtggaatccaagaagtcacaaaaggtatttcatgtgtcataccttggcaatgcgtgctactaattatttttttgttcctgtcgttaaatatagagccttctcatttattttgtcaaatgcattttcctctactacttttttttttctttttaaagaaagatgctctgtgaaaaggaagccattcatccatccaggtgagctctggatgggcgagccagccatggggactcctccctgggactggagctctttttgactgagctgcacctttgagcatcgagtttctgtttaccacctggatgctttccattttgaacacatttgggcctttcactgaaaggcactttaaaaattcaaggttttagcatcatcaccaaaaacatctactaaaatatgcatttgtacctggagtcatttaaaacaaatgagttaacctcctgtgctctgagaataatcttttctttcttcttcttttttttttttttttttggtcaagacaatagtcttcatgggcattaggtgacaacagctatgcaatttcattttagtccataatacattatttaaagaggttattgaaaatgttgattcctggagctaaagaaatggaaatatttaaccaaaagaagagaacatttgaagacctcaaagctttcatgagatgtttgaaaggcagttgaatgtggagagggtatgctatctgctatggtctggctctgtttccccacccaaatctcaccttgatttgtatcaagagcaagaacagttggagacaactaaatcatggggggcagtgtttttcccatgctgttctcatgatagtgagttctcagagatctgacagttttataaggggcttccccctttgctcagctctcattcttctctctcctgccgccttgtgaaggacatgtttgcatccccttccaccatgattttaagtttcctgaggcctccccaggcctgtggatctgtgagtcaattaaatctctttcccttataaattaccccatctcgggtatgtccttataacagcatgagaatggactaatacactactacctgatactccccggggaagaaccccacagcatcaggataggggataaggaaagcaatttgggtcaatggaggagcaaatttgccagcagtttggagctgttgatagttggattagatggtttcatgaagttttgagcctctagattcagagaccaagtgaccaccttccccttgcgctgagagggaatttcttcaactggttggaaatggaatgataggtaggatccagaagggctatctaacttgataatttatgtgattgttttctcatttaagggagagaatattatctacagtgtttctgatttttttaagggccttggggaaggacataatgaattattcagagacttctctctgtgaagcaagttgcacagagacagacaacttgatacaaattacgattctaaatttgttagtaatatattttattcatgcactctacttacaatagatttcctgcttgacatttcttagacatatcactcatgatcccacagttgctctttgaatgggtgcgaaacctgtgcaaaaaaaaaaaaagatgtacacagtctaatgaattatgcaagtcttaaaatgtctcaagaaaaagattactcattaggattttcgaatgaataaattcaacataattgttggtgcaactgctctctcatgtaataggtaccaaaatctgattcatgttttatattggagggacgggtacttttctgaagaattttaataaaggcaaataaatgccttttctaggatgctttatagtagagcccacaaaggttttcttcagcaatactatcagtgctgcttttctctccatacttccaaaacctagaattttttgccagtactttttccctgttttcttctgagtggtaaaatccatctgggcagattttctacaggcctgtgagggggtgttagccagagagcagtgttttgagctcatatacagaataggtgcctctggatagaagttccgatcccagtatcctctcccaggccccagttctgcacaggcagaggacaccatccccatgcagtccagacacctgccagcaaatgtactcgtttgctgacatctagggagccttgtgatgcttctgaatactgcccaccgttcccaattgctgaaatgtttaagaactttatagctctagccaatacgggaatagctgtacattcaggaatgctcgtgaaatgtggcagggccttgccctcctaggcttgaggcccaggctcctgatggtcggtttgattggtggcttatccatgcacctgatagttatttatggctacgtgctaggtactgtgcagacaccgaagcataaacatttcccctcctggggcttctggtcttgttgaagagacggacagtcaacatgtatgccaataaatacattatttgtttaaagtcacagtaggtgctatgtaggcgaaaaacaaggagtactggtaaggaataggagaagagggctttgctgggatgggacctttagcagagacttgggggatgtgtgggatcagtgtagggagaggagaggggagcaagccagggagaaaggagcttggccgagggcctagagcacccggggcaaagggggacctggtgcaggctgaggcaggtgagctgagcagaggcagacagggcccagtgcagtgaggaatctgattctcatccagctgcaaaggtaagagttataaggttttaggctaagagtgagatcatcataaagatggccctgactactgcctaggaggagtggagagtaagggggggagggaggacagactgtaagtggaaaagagagaatgtgagaagagtagtggttggcaattgcagttgttttagtccaagatgatgatacccgcagctggggtggtggcagcgaaagcagccgacggtgaaggtctgcatggaggttcggccatggacctgaggggtaatctgccatgcagttcagaatgatgaccctcggaccgggcatgcttctcagttaacatctgatgctgccctactaaaggcaaaacggatggtctaatgcaggcaaactggaaatagtgctggtaagaactgagagcacctgtgcttgccatccccatgcattcgaacaggctgtggcttccctctgggctcaagtggaactgtttggacagtacacatttgaatctgtgacagctcttgcactggactgggaaagttttgggcaaaaggagtccttgaatcagagactcttaatgcagggacagaccttaaaagccctccaagccctccaggccgggcacggtggctcatgcctgtaatcctagcactttgggaggttgaggtggatgggtcacgaggtcaggagttcaagaccagcctggccaagatggtgaaaccctgtctctcctaaaaatacaaaaaaaaaatgagctgggcgtggtggtgggcgcctgtaatcccagctactcaggaggctgaggcagagaattgcttgaactcaggaggtggaggttgcagtgagccaagatcacgccactgcactccagcctgggcgcaacagagtgagtctctgtctcaccaaaaaaaaaaaaaaaaaaaaaaaaaaagctctccagtaccctcatcttagagtttagggaactcaggctcagagaggtttgagttattcatacaaagacacgcagccggtgagtgacagagagaaactgtccaataaggcaaattttttttttaagaattttgaatgatggacttataagtcttcattaagtccttataggatctaatttttataaatcctttcagaactaatttatttaaggattaagccagtcaaaatcccagaacggtttcaagtcaacagcttaaaagtggaatctgaatgttaaccaagatgattttccttgtatgtggacggctgtaattgggccccagtctctcatgtgaaaagccaaacagattcagatctaatgagttctggccgctggggcagatggattttggaatttgctatttatagtgttttcaagtgtcaccttccccttttaataagcactgagctgtgatctggccccaggagcctggagcacattggtaggtgtgctgagggcctcacagccgaatgacttctggtccaggtttggaattgaaggtttaagttgggatgttggctattcctcagaagtgaggatgtgttcttccaaataaatggtgatcaatccctgtgcattggagagctgatgggggtgtgcttggcggagagaggcatacccccagaggcttgaggagggcagttgtatttcacgtgctgaggagagtagtggtgtggttaaatcaggaataaaaaaaaaatatgaagaaattgtcagggagagcttcagctgggcccaaaggaaatcaagaaaagagcaaatgagaatgcaatttaaaatgtaaatacaaactgaaatcaaagccatttctatgaaacatttaagaacattctgtaagtattgctggtcaggaaagcacaaaaaattgtctgtgttttgagcccattgtcagtgtattatttagagggaagttctgatttttgctaaggggttattccgagttgcgaagtggtgtggtgttgggggaagaataccaccaactccaggccagctgctgcatctcctggaatctctgttttctcttctgtaagatgggagtcagggtggcctccatctgatcacactgaattgttgagtgactcaaaggagataatgtaccaaacactttgtaagccctatgacaccgttcaaagtctatttcctcccagctctgttttctaaaatcaggctgtatgttcgaatcacctgaggaacttaagactattaccagcgccaccactggcatttttcattctcttggacagcagaggttttccaaagccctggatgtcattctgctgggcaagtctggctgacggggctctgaggagttggagggcctgtccacccttgcctttgggaaaccagccagccagtggtccaaggagattgtcggctgtcttcccaagtcagcgccatcttccttcctgctcatttcctgtctcccagtttttccctggaacctttccatttaaatatgaattcagctgcagcctgcggggatctgaagtactagcgagttgactgcctgaggaggtgggcctgtggagaaccagagctacagttttccacaaaacatatcattttaaatgattctgaagcctgttaaattacactgatgggattaatctgataaagtggtaacagggtagatgcaccgaaatgatcgctttcacatgctttttaattcagtcaaaattaatgaaagatcttgtgtttacggatggaactggagtttaaaattctgaattcattagcctgttttaatgcataaatctaacttccttgtccgtgtgtgaaactcaactagagtgcagctcgatgctactctgccaagagaacaggcagaaggaagccacattttacccttgaagccgggttagccccgtgccttgatcatgccactgagaatgtatgtttctagtctgaatccttttggctttatgttgtcattcagcgtgtgtcatgtccacacccagggataattcctgtcttagaaataaggtgtatgatccagcaattacacttctggatatagacccagaagagggtctcgaagagatacttgtatgcccatgttcgtagcagcagcaacattcacaatagataagaggtagaagcaacccaagtgcctattgaacagatgaatggataaacaaaatgtggtaactacatatgatagagtgttgttcagtcttcaagaagaaagaaatgctgacacctgctacagtgtggatgaaccctgaagactttctgctaaatgaaaaagccattcaaaaaaggacagatattaaacgattatatgaggtacttggaatagtcagaaatcatggcaagtataatgatggctgctagaggctacagggaaggaggaatgttaatgggtatagagtttcagttgtggaagatgaaagagttgttgaggtggatggtggtgatggttgcagaatagtgtgaatgtacttactgccatacaactgtacacttaaaaatggttaaagtggtcaatttaattatatatataattaaatatatataattaaattatatatataattaaatatatataattaaattatatatataattaaatatatataattaaattatatatataattaaattatatatataattaaatatatataattaagttatatataaaattaaatatatataattaaattatatataattatatatatatatatctcaccacaataaaaaaaaaagtaaaacataacaaaagaatagaggtatctgtaggagctctctgccctaattcagatgagtaccaccctataaatgctggtgaagtctacaggatttttgccagcatggcaaccactgtgctgtccattcttggtcagacctgtagaagggaaacagcagttgtggaagtatgtctcaggcaccctggaggacacctaaggggaaactcatctgacaaggacacagacatttttctaggttccctgagtcttctgtgtggtccatcctaccagctggggttatctgatattccagtgtatgtgaaaataatagctaagttttgtttttttttgttgttgttgttgttgttttttggcagagtctcactgagtcacccaggctggagtgcactggcactatcttggctcactgcaacctccatctcctgggttcaagcgattcttctgcctcagccttctgagtagctgggattacaggtgcgcgccaccacgcccagctaatttttgtatttttagtagagacagggtttcaccatgttggccaggctagtctcaaactcctgacctcagattatctgcccacctcggcctcccgaagtgctgggattacaggcatgaacactgtgcctggccagcttgataaatttttatgcagaatggttttattttattattatttggaagggaatagtggcccttctctctgatttctggttatatacctataactgtagcagctatttcatcctgttagctttttttttaaaaagatattttttagagccattgttttagggttataggaaaatggagtggaaagtacagtgttcccttatacctgcccctctcctcaacagtctcccctcttattaacatcttgcattaattagtgtggtacatttcttacaactgatgcaatattattaacaaaagtccatggtctacattagggttcggtcttggtagtgtatagtctgtgggtttggacaaatgtgtcatggcccgtatccacctttatagtatcatacagaggatcttcactgccctaaaaatcctctgtgctccatcttgttcttccctccctcccatcagcccctgatccttctattgcctccatagtttttccttttctggaatgtcatatagttgaagtcatgcagtatgtagcctgttcagattggcttctttcacttagtaatatgcactttagtttcctccatgccttttcttgacttgatagttcatttctttttagtgctaaatcatattccatcatctgggtataccatggtttatccattcacctattcaagggtatcttggttgcttccaagtcctgtgctcttttaagatttcagtttttgacccttgatgtgacaagatgggaagggccacaaaatatctcattctttttctcctgttgacttagtctgaatactccagactgtgctgacctgtgtggttcagtctaggagccataggctctgtgaggctgttgaacagttgaaatgcggctggtccaaatggagatgtttgtactgtctgtgcagaggtacgttggatttcagacttagtataaacaaaagagtttaaagtatcattaatttcttacatcagttatgtatagaaatgataatttatatcttggattatataaaacatttaaaaattgttgtacttgtttcttctttccttccttccttccttccttccttccttccttccttccttccttccttcctcctttctttctctctctctttctttcttcctctcttccttcctttcttccttttcttcctttcttccttctttctttctctttctttctttcgagacagagtctcgctctgttgcccaggttggagtgcagtggggccatctcggctctgtgcaggctctgcctcccgggttcaagggattctcctgcctcagcctcccgagtagctagaattacatttgcccaccactacacctggctaatttctgtatttttagtaaagatgaggtttcaccatgttggtcaggctggtctcaaactcctgacctcaggtgatccacctgcctcgaactcccagagtgctgggattataggtatgagccactgtgcccagcctctttttaattgtttaatgagactactagaaaactgtaaattacctacagctcacataatgtttctgttgggtggtgcttctgggaaaaagaggaatgcgtggcttttgtccatggtgcctctttaaggatgttattcagctgatgtttctcaggtacctgctatgtgccaagcactgttgaagcacttcagataattcagtgattgaaagaaacaaaacccatgactttgtgggttttagtacattagatttggatattatcaaattattttggcactttttctccacagtagcactactgtttttaaaagaccagtgccagccgggtgcagtggctcatgcctgtaatcccagcattttgggaggctgaggtgggtggatcacgaggtcgggagttcaagaccagcctggccaagatggtgaaaccccatctctactaaaaatacaaaaattagccggacgcagtggcaggcacctgtagtcccagctactcaggaggctgaggcaggagaatcgcttgaacccggttggcagaggttgcactgagccaagatcacgccactgcactccagcctgggtgatagagtaagactccgtgtcaaaacaacaatcaccaccaccaccaccacaacaagaaacacacaccagtggcccaggaaagacaaaggaggctttaggatatgtcccggttctcattctggtcccaacacttattatggatgtaacttttggcagttccttacccgttaagccttggtttcctaaccgtaaaatgggactaagtaattcctctcatagagtgctgcttgtgcaacatggggtcagaatgagtactcaggaagtgattcccactcagcccgcatcccttcctggagcactgcagttttgggattcttgtctccagcccagctcttacagcccctgagagcatgctgagcaggggaaagctgctctaaagttcaatttgcattgtaccttctccatttacatttcttgaccttttgctttctcatccagcaatccccagcagggtgtctgtgttctaaggcacccacctagcctctttctgaattttaatcccagctctggctaaaagcctgaaagcaaaatatgaatcgtagctccacaattataacgtgggactttctttataaaatgaagttgctctagcagaaagccagggctacaaatcagtagcggcttcaggatgcatggcctctttctggcataggaggcccctttttcttctcagtcgcggtgtttcttccaacatctatgcatgttgaagtctggagaaggctgatgctgagagatatgtactaatgaaatgcacaggtgttatctttttctgttccaagtccctgtgtgccctcctgtcttggtgggtggcatggcaggacatagaaacacttggaacctgtttactattttccaaaaaggccttgcctgtagcccattgatctacccactatgtatattcattttaatgctgtttttgagtccgttgactaccccgggaaatcaaagttgactaccacagccctagtcctcaagtgtcttgcctgcaatgaggttacctggcctattagaattaaggactaaaatgcaggagctggggtcacacctgccagctgtttgtgagccctgaagatgttggggatttaaattttagatagatcattgtagctgcaaggggtaggacggataggtggggtatccagagtccttggataccttgtcttcctggaccctctctcagcacccttgggctaagatgcactcttgaacacatttcctctatggcccctttcagatctgctgatgatacctggattccttctttcagagtgacccagccccatcccagggaacgggcagatgggctctgttgcccatctcaaagttcccttactttttttcttttgaggttttatcagtccagaagtggaaagaagatggatgccattagctttagaaatattttttatgttttagggagaaagaagcagagaatatacttttagatgagcacactttaaaataccagtaagacagacttgttggaagacaggcattgtgaagaactgttgttgttttttggttttttttttttttttttttttgcaacagctttccccactttgggaaatgagaacttatgccctcctgaatgttgtatttgatgggacttagatccatgggggaattttattttattttttaggaaaaggtaacctactaagtatagttatatccttctagcatgaaatataatcatttattagaccagaactgtttgttaattcagcagtgtgtcttgaaaaagagccaccctcaaatttaaagtagaaatagattcttcattctacacctttttgacatcagatttgctttcctggtctcagtgcaggtgcccctactgtttggtgtttgggacacagcctccgagtaagtccaaggagagcttggggttaggcagtataggccatgagccccttgccagcctcccagggactttgagaggagctgtttggggcaagatgcttaatgaaaggatgttttgtaatttagagagaaaaaagaaatttatcccatagataactaaaccctcaatgggaatattagaaaatacaattgtcacattatgtaatatttgtacattttccactgcaagtaagaatgcgtcctttccttaattttaaaatatggaaaaggtcgacctttctgctaccgtaaggaaaatcaagggaaagggaggttttatacatgatatggggaacttggtataattatttagctcagtatgaaattctgccacaggaatataaggtaattaatttctctaagtatgaaatgcaatcttgaaaaactaggaaacaggtgccgaggtgacaagataggaagagaagctgagtgttgtgcagtggcaccgaacaacttctggaacattccagagcgtggctttgtagctggagagagcctcctggcttctgtgtggcgaccgagactgacccctgctggcagattgttgctaagccgtggctgttaatgaagcagggcaataaggcccttaagcaggagatcctgccaggccacaggcaggtctgtctccgaggctatgccttgtaccagcccttgatgctgttgcctgaattcccagtgggaagaaaaatggacccagcagtttttagtgttttggtctcagtttccaccatctctcccctttcccagtctgggatgtcagtgtttgctctctcctccctaccctctgttacctcaagatttcatggaaataaaaagccctgctaacatcacaaagaggctgaaaattccagatccacctcggagccagacacttgagaaatttgatgccaaggtaacctgcgtttgggaaaacatccttattaggtttatttaagaacgatttgaaaaattcctataagtgaaaatcagatgggaagaagtccaaaaatctgattcatgccatgactgtgatacaaccaagatcttcgtgagccagtggatggggaagagagataatgtacaatatttctatgtgtttcctggaaaaattcttaaacggattataaaaagcactaagtgtaaaggaaaatgttaatacattggactgcattaaataatagaccagcagaggtctggcgtggtgactcatgcctgtaatcccagaactttgggaggctgaggcaggcagatcacttgaggtcagtagttcgagactggcctggccaacacgatgaaaccccatctctagtaaaattataaaattagctgggcatggtggcacacacctgtaatcccagctgctagggaggctgaagcatgagaatcacttgaaccccaaaggcagaggttgcagtgagctgagatggcaccactgcactccagcctagacgacagaataagactctgtctcaaaaaacccccaaaaaatagatgtgcagagtctttatttgtggtagaggttagtgttttccccactacattttccaccagcttgttctgggagctgcttttgggtgctggtgaggagtaattcgtggtttaggaagcttgagtgcgggtgctgggtcctctgcttgttgctcagcagggtactggaggccaggaaggctggcgctgcagaaatctgtcttcagtgcacttactgctgttgccatggacagctcattcgtatagctggtgtggagctaatgaagtagggatgtttttaaaatgaaattttaaaaatggggtttgagaagtacataaacagttcattgtggcataaaatgacattataatcatttaattttgagatgatttaaaaatcatttcctcatgttccatgttctacagcttaccagtcaggaaaaaggataattttgtgggactcaatgaagtgatgaaattgagaacaaagcctttcatctttggacttacacttccatgttcctaaaagagttaggcagggatatgtaggtaaatcaaagactggaaacgtagggtctttggaaacttttttctgggtcatctttttagtcttaaagctaagccttcagttgccaagcagtggtttttttaatgaatgaggctggtcaataggatatctatattttaaaaacctcaaccacaagtaacaccctacacaaaaaccaattacagatagatagtagacctaattgtaaaacaataaatgttctagaaaatgacagagaacatgtttatgaagttgaggtacaaaataattttgtaaacaggatctaaatagaactaaccctaaaggaaaagattaatcaggcatttttgttaattgaaacatcaaagaatgaaaggtagactggtattgggggaagatatttgctacacttatacctgttaaagggcttgtgtcctgaatttaaaaaaaaggtcaggtgcggtggctcacacctgtaatcccagcactttggaggccgaggcaggcggggatcgcctgaggtcaggcgttcaagacagcctggccaacatggtgaaactctgtctctactaaaaatacaaaaattagccaggcatggtggcaggcacctgtaatcccagctacctgggaggctgagacaggagaatcgcttgaacccaggaggtggaggttgcagtgagctgagaccatgccactgcactccagcctgagcaagaagagtgaaactccatctcaaaaaaaaagaaaacctcctcctacagatcagtaagaaagacaatccagtagaaaaatggggaggagatttgtaaacttcatgaaagaggatataaaaatggacaataaacataaagtgttcaacctgggtcatcaggggaatgcaaattaaaactgcaatgggatgtcaccagcagtcgtaagaaagaataaaatgaaaaagaccacagtactaagtgttggtgaggacatgctcctggtatgcaaattgctataaccactttagaaaactgtcagtattgactaaagctgaatacacactcctgtcagacagcaattcttctcgtaggtggatccccaaaagaaacatgcatgtgtaccccaaaagtcatgcccaaaatgttcacagaagtattattcataattgccttaacctggaaacaactcagatgttcctcacatgtagaatggatttttttgtataatcctatcatggggtactgtgcagccctgaatgaaaaacctgttatgtgcaacaaaagtgtgatgtcttgcagacataacactgagagaaagaacccaggcacagaattgttttctgtatataaaactcaaaaagaggcaacactcatctctagtgcctaggggtcaaggtaaccacatcttgctggggagaagagtgactagaacaggcacaaggggacttctggggctctcgttccattctgacgatggacgggtttgtggatacacaggcgagattatgttgtgagaatccatcaggctgcatattatgacttgtgcatgtaaaacatgtatgctacacctattaaaacgtgtttgttttagaaatgccttcagtatgtacagctatgatagatcaacagaaaaaataaaacactttaaaatttctttaaaaatttttaaaaagcagtgccttcaaacacccaggctattgtgcagcgtgttgctactgtctgtgatgcctgcgaggcatgggtgagaggaggaggcggtgccagtgagtagagtgagatcgtgatattgctaaatcactttcttagggtgtgaaagactctgctttagctctttttcgggcttttctgccatgccttactagttttggcagttttcctattaaaattatatgtaatgtcttgatataactgtgctcgtctggagctgtgtatttaaatagctgtaaacttctcaacccaaattgtgggaattaaatttccattagcagattggcagcataatctggtgggatgttctctgggcccaaagccaagagccctgggttctagttacagcttctagtcctgacctggagcatgtcactcagccatcctccgtgggtacctcctcctgaaaataatattaaatctacatatggaaatcacatccacccacctctaaggttgctgtgaaggtaagggaaggtaatatctgtgagcactgtttgcaaattgcaactgcagagtcataaatctgtttgcataaaccacacattccagaggggttctaatcgtgtttacatatacttcttaaatttcgtactaaatgtctgtagatatgaagatgtgaaaacaaaagctcagtgagaaagtaaccaacagaatggaggaattctggagaagtcctaacatgtagtgttttcccattcctaatccctatcatcttgtggcattgcgtgtacttatttctgtgttttcacattattaactgaccattttggatggttgaatatacaggagaggtgctggttcaggaaataattgtttttttttaatccatatttcaaaagtaattcttgtcggtatatacaaatatgtttaagttttattatttgccttttaacaaattacaacatgccacattaggaataagtttgacacaccttaatcattttaagtcttattatcactaaaatttgcagcattctccttcatggaagaaaaagttaatttggtggaacctttagtcaaattaattggtcagaagaaatactgtatacttaactgaaagagggaaaaaaaccccatgttttaatgaacttaaatttaattgaacaaccttcctcaatcaatgttttagaaattgtttttctcaggaaacaaactattgacctaggcaagtggtttaaaaacttttgtttgacggtagacatatacttttgcaaataaaaccttccacggaacctgagtccgtagagcagataaaagaccactctgaagcaggggtaggagtggagaaggtagaaaaatgggtggtagatcttaccactgagtgttttgcttttgaaatacgaagcctgttggatgccatggaaagccagataactattactctgtatgatagtgcagggaacgttctgtgtgtggttgtgttatgttgacattccatccagtgtgccactccgtataattccgtctgacgtgccactccatataattgggatgctgtctgttcacttagctgatagaggtgggattcagagactgtggtgtctgtgatgctgtgatcctagacatggtaagtgcgtaatacctctagatgctgatagattaagctatgattgaatttatagtttccagaatgaatattgtactttgagaggctataaagaatatcaggctgggcatggtggcgcacgcctgtaatcccagcactttgggagacagaggtgggcggatcacctgaggtcaggagttcgagaccagcctgcccaacatggcaaaaccccatctctactaaaagtacaaaaattagccaggcgtggtggtgggcacctgtaatcccagctactcaggaggctgaggcaggagaatagcttgaacccgggagcaagaggttacagtgaaccaagattgcaccatgacactccagtctgggccacagagcaaggctccatctcagggggaggaaaaaaaaaagaatatcagtaactgagaaaatacgcaagatgaaccacctttccagaaatgttccagttagtcaaattatcctggtaacccacagctcactgcagccttaatctcctgggctcaaaagatcctcccacctcagcctcccaactaactgggaccataggtgcacaacaccatgcctggctttttgatttttttgtagagatgggctcttgccacattacccaggctggtctcaaacttctgggctcaagcagtcctcctgccttggcctcctaaagtcctgggtcatgagccaccccacctggccctgaggcttttctgactaaaatattttaaaatgttatatatttttaaaactagtttttgctatagtatgagatgaatatctgtccccttttgagtaaatttcaattaaaaaatacagagtcctgtaattcagtgataagggagctggggaggcccttactttcaaacctgaagaattacatctgcttcccaagaactgctttcttgggaacttttaaaagtatgtatttgtttttgtgagtttgtaagagctgcgttctgtctacagaggaacttgttaatgaatccctcctcttatgatattttatatagaaatgcttggtttgtgggttgcgcccatgacatacactctgggaaataagaaaattatagacaaaccaaaatagaaagcagctcctctctcaaggtgagttcagcagttgtcagtggataaaaggaccttgtaatgagcagctaagcccacactcctgaaatgccttttcattgcaagagtgaaaacgagagataaaggaggttttttcctgagtaattctagcttgcctagcacgctatgagcaacagatagaggccaactttaaaatctccatgactgaattataccaccaaaacttgtgatcagttcgttttctgctgaaatcaggaatacatgggtcattaatatcaagtagaatagaaaagagaaaagcagtacctaaacgcaaccatcttttttatcctcagttggaaaagtgtctgttttcttctaattataaagatgctgcatgctcattacaggaagttctaagagtatcaaaaagtgtgaagaattaaagattaaccaaaattctgggaaaagattgttataacaatgttgacaggcatttacaacaaagcataacattattctttgacattatgctttgttgttgtttttaacaagctatatctagcttcctattattttcattttgaagtgcgacattcacccatcagaatatacactgaactcataaaaatattccatgtttcaaaagatgaaatacaacctttaaataaacacctagaaaaatggcctccctgggcacaggggtgcatgcctgtagtcccagctcctcgggaggctgagactggaggatcacttgaggccaaagagtttgaaaccagcctgggtttaacacagacccccatctctaaaaaatgaatttattttaaaattttttatatggcccgaagggtattaaagacaacaatgtaaaacaagatcctgcttattaagttaatgaaatcacaacacccagggttgacaagggagccaaaaatggcagtctttttctgtcttatggcctatacgttgatatggtatatttggaaatgaatttggtgatatgtatcaataagctttactgtttataatcttgatctgagaacttcatttttatatttatttgcctaaagaaagactatatttataagggtgtttgtgttgaaatggtcattccagtggaaatggcctacatggaatgggctgtacctcagctggacttcaattcaaatggctgtctgccagctccgagccttggacaagtcacttaacctctaaccctcagtcagtctctatatttttaaatggggacgacaataatccctgtctcagagtgtttttatgaagattacaatgtaatttaatatgcaaagcacttagaaccctgtctagcacggagaaacagcgcagttgtcaccccttctctgcaggggatacattccagggacccccgtggaagcctaaaactccaatagtgtcaactctgtataagcaggttgattatccctaatctgaaaatttgaaatgttctaaaaaccaaaactcagcggtgaaaggaaatccccactggagcatttcggattttcagattgaggcatttaaccagttagcatgaaacagatattccaaaatcaaaaaaaaaaaaaaaatcctaaattccaagcacttctggtcccaagcattttggctaagggatacccaacctgtactatgtttcttatgcattaatatgtctgatccatttataaattaggcacagtaagagattaacaacaataataaaatagaacaattctaacaatatactgtagtaaaagttatgtgaatggggtctctccctctctgaaaatatcatactgttgatgttagcaatctgggcatatgaaatttcacttatcgggaattttcaccttttcacttaaagtaatttccagcttctctttgacatatctgaattgccggtgtcaccactctggtactttagggccattatgaagtaaaataaggattccttcagttcaagccctgtgatacctcaacagtttatctataaccgatggctacgaagagactaagaggcggtagcagcatctacagaaggggtctgctggacaaagggatgattcgcatcccagatgatatagtgggatggtatgagatttcatcacactattcaggattgtgtgtaatttaaaacttacaaattgggccaggtgtggtagctcatgcctgtgatcccagcattttgggaggccgcggtgggcggatcacctgaggtcaagagttctagaccagcatggccaacatgggtgaaaccccatctctactaaaaatacaaaaattagctgagcatggtggcgcacacctgtaatcccagctactcgggaggctgaggcaggagaatcacttgaacccgggaggcggaggttgcagtgagccgagatcgcatccttgcactccagcctgggtgacaagagcgaaactgtcttaaaaaaataaagttgtttatttctggaattttccttttaatatattcagactgaggctgaccacaggtaattgaaactggaaaacaaaaccacacatacagggattacttggaaacattgcctgttaccaccttatgcattggtgtgaggcttgaatggagtaacacctgagggcagtgtctggatagagtaaaccagcattccatgttagatgatattcttagtgttagtattagtacataaaacttagaaacaggaccgggcacgtggctcatgcctgtaatcccagcactttgggaggccaaggtgggtggatcatgaggtcaggagtttgagaccagcctaaccaacatggtgaaaccccatctctactaaaaatacaaaaattagccaggtgtggtgatgcatgcctgtaatcccagctactccggaggctgaggcaggagaagtgcttgaacctgggaggtggaggttgcagtgagccgagattgtgccactgcactccagcctgggcgacacacccagactccatctcaaacaaaaacttagaaacaaatattcatctaataactggaggaaaagcaaaataaatttcagatggaggctgtgctatgaagactgtcacagttggttacaacacagtgttcattgtaaggataccaaatttcatgtgcgcggttgctctaccaaaggatatgtgcatgggaagatgaagtaaaaggagatgtattccacaggtatagtaccagcttccatggtgcctggcaaagcataaagaagcttgggttttggcctcttgaaattaatttaaagcatgagatgggcttaagcccatactatagagaccattaagatgcaggaagagcttgataattctggaccagtctataatttgaaataaatgtattttgaagggccaaagccagtggctctttactgcagcatgtaatttgattcctattggtttttgcaaggtgcttgaggacttttttcatgctgaaatttcatttctgctgttcgcaggacaagagaaatttgatacccatgtacgacttgaccaggcttgaaatttcactttatttgatggttcggctagtcatatataaattagtgggttcaggcttcagtagggaacacacacagagccagcagctgtggcctgttcctgtctcctgagtgaggagcattcacgatgttcttttcacttagagagggcttagggaagatttatgtgttcgctgtctctcatttctgttctcaaacccttgttttctccgtggaaaatggtgatgtactttttttttttttttttttgagacagggtcttgctctttaacccaggctggagtccagtggtgcgatcttggctcactgcagcctccacctcccgggctcaggtgatcctcccaccccagcctcccaagtagctggcactgcagacgatgcaccaccagctaagttttgtatttttggtagagacggggtttggccatgttgcccaggctggtcttgaacttctgggctgaagcgatctgcctgcctctgcctctcagagtgctgggattacaggtatgagccaccgtgcctggccctgtgatgcacttttaatcacagcggtatttggtcaaaggatggcagaataactaggcttgtgggctagggagcatccaggagggacacctggtcttccgtgagagtccggcgatggggatctttgcatccctctctcacattggtcaaggcctcatttctactcctgatgtctactcctgatttgggcctgagaggtgcgagctccctttccagagtagaataagcagatggtgattctgagcaatgtgggatgtggactgcagcctgggcaagggagtcccttgagatgagtcctccatagcagccaggatgccaccctgacttctggctctcctgactcagtccacttttagtctctttttctgcaggccatgaaatagctcagcccctggcctgcttcagacctagagctcagccagcctgcacttcggctctggttacgtcttggagatctgctctgtttctagcccagggaggtgcgtagtttatatggaagtgaactatatctttttaaaaatacatttccttcttttcttttttattgcgtccatgtatttagagctaaaggagaggtccacagcatgagtttatacttcaccttagccagaagtccctgccacatttatccttagatcagagaatgacactggagtgaggacggggtagtggggggtagggagtggggtgctgccctagcctgttcccagatgctgcataagtcatcgttttcaatcctgcatgcttagcttccgacccctgtcaccctgccaccccctcagaagctgccgcacacctgctctgtgccatggaccagccagagtgcagggtttgtgtcatgcgccccctccaccccgtgagctctttctttaacctttctcctgcaactcctcctcagccccctttgaaatgccaaattcagaagctgtgtttcccttcctcagccagctaacgagagactgaatttaaaacaaaacaaaacaaaacaaaacagccctcattgtctccctttgatatttgcctttcatctcgtctgtcccagggtcggggcatccacctaggccagcactctggaaagacgcctcacctgcagcaggtagagcccagcaagtcggtccaggcttccgcacatggtcatgtccccatgggtttgtccacatgggtttgtttgtccttggaaacccttcagctccagggagcctgaagtccttggcgaaggataaagtggaaggggaatgcagcatgagggagtctttctgttcatattcaccacctgaaaattacaatggttcaagcagtgcaccttctagacgaggtggtctcagcaagccttaaaaccatctggtcaacaagagcaaaacatgtataaggccatgaatgtacctggggctggtttggtttggtttgcacaaaccaccccctcctctgagtgatgtataaataagaaagtaaacccatctccctgccaagtcattctaaagaagtagccctgtcttggatgcccatgtttgtcttccacaccctttagtgtagaagacatcagggcccacctctgcatcctgggcctgtggttcctgtcctcttcatccagatctgtgactgtcgtgatagtgtcctaactgaccgcctgtctctctggtcttgtgcctcctcccagccgtcctcgggcccccttgcactgtggatcacgtccccatgccgacactcatctgtttcgacctgtgggtggctccccgcgcagctcgccaggcaggcctctgtgaactgactctgagagtgctctctggccccaccgttgcttctcacctctgcacttgcaagaggctacttgtgcttctgtgcaggctgtggcctcttggggctccctgcatctgtggtggctgctgctttctgctcggagcatgtgcacatgtgcgttccctagtcagtacacagtcagcccctgctgtggcgctggcacacagcagagagcaagagaagtggctttgccccccattgaacagacagagtagtagggaagacagacatcaagctagtcatcacgaccataattacgtaattaccctttgtgacaagagctgtgaagtggcaggaaggaagcagaccagggtcaaggatggccttcctgtggtgtgatgtgtaagctggaatttgggtaggaaataggtggagaaagagcctgaagaaagatgtttccggaacctgcgatcaagatgtgtgaaagtcgtgatgggaaaatgaggatgacggtagcagtgggtaggggtcagaggtcacgcttaccaagggtttaccgtgtcaggcacgggtctgtgttacctcatcacgtcctcatacgacactgcaagaaaggtgcttttaccatccccactgcacacatgtgaaaactgaggcacagagaggccagtgggcatgcctgagctcacgtggctggtagggtggtgggatttggacccaggtagtctgggtcccgggatcaagctgcagtcactgcagcatcttgctgggaccttgaaagaggcctttgtgactggaactgaaaccagggagctaaggctggaaggcagaggcagggccatggagatggtttaggaagtgagtgatgaaatttggatttttatgtgatcagacttggttgggaggacagtggattgaaggagaggcaagggaaggaggcagagagaggaattatacaccgaaggttaaaaaaaaaatcgggggttggacttccctccttctttcacttggtgctttctccttgcccttcaagacctggtgcaggtgtcactctctctcctcggctcactctctttctctgcgccggagatcctcaagatcaggggagatgtctcggcatctctcagggttcctcatgcacaggcggctttccacaaataaatgaaaggaatggagggaaaatagttacaaagctaagaagcaagatgtttcattgggtaatttaacttttcaagttcataactctgatgtgactttcacagtgtaagctgcctgtggctgatactttactcatggagtactagtggtctgttattcaagctaaaatttccatttccttattagcctgagtgaccagcattactcccctagctccacattcttagggagtcaagaggtcgctttcagcaggccaatctgtgcacgacctgctggtgctgcagcattccttactcagatctcagagaccctgggattttgcagtgctttggaaagctgacagggctggcactgggggctggctgggatgggaacaggctgcccctcttggctctccatataggcctgagagccacgtggtcccacatgagacactgagccatgtttgggctccgcctccagggttccacgcattcttagcatctcagcaatccaaggacaaacacatcagcttccccgtagctaaacataagaaagttgtccgtgtttttatataaactttactgacatttaaacatgcatacttcatgaaaagtgcaatattgtcagtgtgcggtaaagtgggttttcgccaactaaacacacttatgatcaaaacatgcccggatttgcacccagatcaggaaacagaacatgacgccaccctgcgcccttcttgcttcccttctgtttactgcactcctcgtgaaggtaacctttgtcatcgcttctaacagcctggattaattttgcctgttttttgggctttctaccaatgggatcatacaatgtgtagagaggatgtaggtttaagatgagatttgttgcccccccccatgctcgatttatcccatgttcctagaaattatagagataacacaagtggaaagacagtctcacagtctcatgacaggaaggttacccatccggggtcaaaccatgcttggcacagagccacttgttaggattcagcagtaattaaaatgactgtgttgtttataaattgttttatgagtgcattagtgccttgtttattttttatcaccagagaaagagtgatcctcctaagtaaatgttctagatcagttgagaaagcaaactttctcagccaagggccagctagtaaatatttttggctttgcaggcgcatatggtcttcgttgcaaccactcaattctgctcttgggatgcaaaagctgtcttggacaatatatgcacaaatgaggctggctgtgctccaaaaaagctccatttgtggacattcaaataggaagttcacataattttcacttgtcacaaaatattattcttccaactttttaaacttgaaccatatttgagagggaatctttctgaagtgttttgttttttcttttttgttttttgtttttgagacagagtctctctctgtcccccaggctggagtgcagtggcacaatcttggctcactgcaccctctgcctcctgggttcatgccattctcctgcctcagcctcccatgtagctgggactacaggcacccgccaccacgcctggctaattttttgtatttttaatagagatagggtttcaccgttttagccaggatggtctcaatctcctaacctcgtgatctgcccgcctcagcctcccaaagtgctgggattacaggcatgagccaccgtgcccggccatctttctgaagtttttaaacactgatctaaattctcaggatgagctgagaacattttcttagtaaatatgggcaacatggtttaataaaacatggaaaccctggcactgtccttttgccgtgtctctttgggcaagttttaacttctctgggtctgtttcatcttctatgggatggggataaaaggaaggacatttagccattagccccaggagagccatgctagttatttgtgaacagaaccccatctgaagagtcacggaggatcctagttggtcagtgtccaggctgtggcagttgttaaatattttgaatatcactctttgtcatgacatcctctctactgaggtcttgtatacactatggccagcatttgcgtcgtgtatagtaattgctgtttctcctcttcccatggaaatggctgtaggcattcttggctaagagggatacttctgtattaactaccgcaactcaaggacttctgtgctacaggtggaatatccttatccaaaatgcctggaaccagatgtgttttagattcagatttttggatttgggatttgatatagtgtggctgtgtccccacccaaatctcaccttgaattgtaataatccccatgtgtcaagggtggtgccaggtggagataatggaatcatgggggcggttccccccatgctgttctcatggtagtggataagtctcatgagaactgatggttttataaatgggagttcccctgcacaagctctcttgcctgccgccatgtaagatgtgactttgctcctcatttgccttccaccatgattgtgaggcctccccagccttgtggaactgtgagtccattaaacctctttcctttatacattgccccatcttgggtatgtctttattagcagcgtgagagcagactaacacaggattctaggcctgtagtttgtgtagttttccattcccctagtggccaccaggatgtgagctgtaccttcacctagcctgcccttaagtcagctcctctaccaactctaccttgctgtttcagattggtaggctgattaaaactctctaaagccagaggaggcctgcattccaccctcagctgagtgtgagccccgtgtgacctaggaagtcagcagcacagactttggggccagatagtctggtggaaccccagcccctgccattgatgttatgtacatcctgggacgtgttacttaccctctctgttcttcagttttctcctctgtgaaatggggagaaatagcacctactgcatagtggctgtgaggattaggtgaattagtatgtgagaacatttcaaacagtccaggaagcactatgtaaatattagctgtcattattttttttgttttcactcaaaacacattacttggttctgatgcttgctagagatagttgaggttcccgggtatatgatctccagattagagaagttacatattaagtgacagatttggtgttgggaggaatctcatgggcatttttttaggatttgattattttctgttgtatctcattgtcgtctttttaatagctgtagacatctaatcctgagctagtgttttactgttctgttactcataaaaattctgaaatgcaggggttaagaatagacaatcaagtcttaagtgctttgcaaaatgaatttattcctttgagaattaaagtgatgtcctgaaggaagtcacagttaatggtcagtttcctttagggaaatattcttgaagaattagagtgctgctctcacatatctttgatggaaaccaaacaactcctgggttaatgtttagttaaatgaaccaaaaaaaaaaaaagtatcactttgcttagttagaagcaaaggaaaatattaattattcgaatggagaaatgtttgaaaatgagaaataattatgttacggtggtgggattacagatgataagtatttttctttttttgaagttgggtaagtatttttctttttttgaagatggatttgccttttaaaaggaaagggggaaaaagcctgaagctgttacagtctgtctctaaactaaattatcttcactgcaatccaacattgtgcagctaagtatcataaaattaagactcacagcctaaaccctctaataggtaagactattctaagacactggtaacacgtctctgaaaagtgctggcgttttgtgctgttagtttcctgggttgattttggtttgagttcacagcagaagtctgttgggtagccagaaaggaagaatcatcacgttgggacacaaatccgagtcctgtctgtcctttgcattcttccttcccccacgtcgtcctggcttggcttcaagcaagtctgtgaggtaaaggttggtggcttagcttcctagggcttctgtaacaaattatcaccatctggtagtttttattgttttggtttttgtttgtttgtttttggcttttgtttttgttttttcgatggaatctcgctctgtcgcccaggctggagtgcagtggcttgatctcggctcactgcaacctccgcctcctggtttcaagcagttctcctgcctcagcctcccaagtagctgggactagaggtgcccgccaccatgcccagctgatttttgtatttttttttagtagagacagggtttcaccgtattgatcaggctggttttgacctccagacctcaggtgatctgcctgccttggcctcccaaagtgctgggattacaggcatgagccaccgtgcccggccaatctggtagttttaaaacaaaagaaatttattatattacagttcaggagcccagaagtcccaaatcaacatgtcaggagggccacactccctccaaagtctcaggggaagatccttcctggcctcttcccactcctggtggcttctgttgttcctcaccctgtgactgcattactccattctctgccaatgtcttcacacggccttcttccctttggctctgtcaaatccccttcgtctttctgaggacaccagtcattggacttgaggcctaccctaaatccaggatgatcttatctcgaggtctttatttaattacacctgcaaaaaccttacttctacatgaagtggcattgttcgtctgggttaatacctgaggttcattgcctcatgccaaggaaatcaaggacactgacacacaaggagtgagtttaagagcaggagtttaataggcaagagaaagaggaaagctctctctctccttcagagagagaggggctcctgagtgagtcttccagttccatggtgaaatgcatggggaggggggggtggtggttaatagatgagcgtggagaggcggtgtctgatttacatagggcccaaatgattggttagataggtgtgccatttacatagtgtaggaagaagatggctgccccaccctaatcttttgttaggcaggtgggttctctacctggccagcgccatgttgcctgcttctttattgcacacctggttgacagaagggaagatggaccctccatgttgaacacgcctgacccccaggtagccatttcctatccgcagagctgccggcattcacccgtgcaagcttccagcttgcttatctatgtctgcagctcgattttacaggctgctctgctagaaaagaaatgatctgggggctgctttttgttaaaacagaaaccttgctgaggactctcttaccctcgctaactgcctaaataatttctttctagttcctgtagcacaaataagattacattctcaggtattggggattaagacttgggaccactccttaagccactgtagctgacctcacagatgtctcagctgaccaccaggcaggtgtttccacccaaggacgcacttccccattccccatggcaccagcaatgtggagtggggagccgcggagcagggagccagcagcttaagtttgaaatccagctcactgttcttgagactggaacctggagggcattattaaatgtctcccagccttggttcctgtcttgtgtaaagtgaaggtgacggtgtctacccctctgggtcacaagaagcatgtgggagaatatgggaaagtagctgacagggtgcacaagttacagcaggaactcaatatgtgtccttgagtctgaatgcagtcatttagggtcctcagtattaactgccttgctctcaggtggatgatgtttgaggattaacaaatctgttgggtgaatccagataaatggggagttgacctttctggatgacacaggttgttgaccatggtttaacatattcaataagttaatataaagagtcttggcagtgcctggtgcggcaaagggacctatatctgtggttgtcattgtcgttgctatggttgccattgctatggcaccataaccttgttgatctgaaccagtagagatgaggctttgaggtggcccctggagatcacagctgaggagccctaagcccacccccagaaatgttgtgaaagtggctgccttctttcctttacctaacttgtgacatccttcagcccaggactcagtacacagtgggccctcaaaaaataggattaactattaactgaaagatcttattccaggtgttcagggaatcagcagaattagcgtgactttctgctaataatatcttcaactgatgtgataagagtagagttctaccagtggccactgcaaaagacacagagcatgcaaaatcctctctccttttatcagaaggaagagcttctccatcctttcaaccttggaccagtaattggtccctttaggagttagtttaagaaaagctatgcatgccttagccagcctgaagtcagacccttaatgggaagctggtgctttattgatgctcagtaacagaacactgctttgagctcaaaataacttctactaagctccttcaacagcttgctccctaggtggctcagtgttttgctgctgtctgaagttgtatatactccagtgaagcttgagtttcttcatggtcatcatccactatcaccagttaatatgggctgaatatccataacatgtcagactcagtcgggatacataaagaagaccctgtacctgcactggggttgtgggtctgagggccattagaactctagatggctgcacagacacaggtgaggctgtggagcaaaggcagagttggtggtgaagggcctatttttaacttttattgccgccatgttgctcctacgatgccattatgaatggtctctgtgagtccaggcagtggttagtgtctactcagaaacctcacaatgtctgtcctcctgggatagaatatgaacagaatccaggtctggggccatggatgttgaacgtgatagtatgtttcctggtatcactaaggtctgatctcttcccgttttcctacagttctatgaacatttctttctaacacaatgttttcttagggctaattttaagttattttttggggactatcatcccttatatccttctccttccaaggtatcccaaagttgatgtgcagtgttactgtacactttttcagcatgtgcaaatctgtctagcttataatctagcatcattttgtgttgttttacattttatataaattgtattacactctacagattcgtttgaaacttgttttctgtccaacctgatagatttgagatttatccatattgatttatgtagatctagttcattcattttacttgttatatatgatgacagtaattggttcgttttcctaatggaggacagctagattgcttccacatttctgctcttttaaacagatatatatatagatagatagacagatagatagatagattgattgattagatagatatagatatatagatatatataacatatatgtgtgtgtatatatacatatatacgtatatgtgtgtgtatatgtatacatatatacgtatatgtgtgtatatgtatacatatatacgtatatgtgtgtatatgtatacatatatacgtatatgtgtgtatatgtatacatatatacgtatatgtgtgtgtatatgtatacatatatacgtatatgtgtgtatctacatatacatatatacatatgtatgtgtgtgtgtgtgtgtgtgtgtgtgtatatatatatatatatatatatatatatatatatatcctgcagtagctcttcttgtgagattctcctatgtgagaattcccctaggtctggggtgtactcagaaggggaactgccagtcatatgtatctttaactttactagctttggcaacttgctctgcaaagtgtctgaaccaatttacattccaccagcagtgttggaggattctacttcctcaaattcttaccaataaatgcttttatcaggttgaccaaaaagattccatgtggctggggtgaaagagcaggtgtttgcctctctgtgattgctgggaaggttaaacaccttttcataggttgattagccatcagtgttgcttcttctgtgaattgtttgtttatatctctagcacctttttcctccttcctgttttggggcatgaggaagagaggtgatgctttactcactgattggtagaaattccttacatattctggatactaattttttgttgatataagttgcaaattatcttctgctgggatttgacattttcataaaatattttgatgaaagaaaaatgagaaatagggaagagcattcaacctttaatagaagcatctgtaaaagggtctatttgttctgctcctgagacaagttggtggtgtgttaaactaatgaatcattacagttcccatatatgcagttatcattacatgagccttttttatttctttctgaggttttattttgctttgctttttttttttttttttttttttttttgagagtttcgctttgttgcccaggctggagtgcagtggcaccatgtcagctcactgcaacctctgcctcccaggttcaagcaattctagtgccctagcctcctgagtaactgggattacaggcacccaccaccatgctcggctgattttttgcatttttgtagagacagggtatcaccatgttgcccaggctgatctcgaactactgatctcaggtaatccacctgtctcagtctcccaaagtgctaggattacagacatgagccactgcactggtcttgctttgcctttttaaggcatcacctttagggacttgcctttgttcttgatggttctccagggtcacttgtttgagactttagtaacaagttgctgataccttaggtaatgatacttacaattacctaagtcccagatgaacgtgaagtctgcccacttccaggtcatgggatcttaagttcttatgacccataaaagacttagactagcttcttgacacctaccagctcatgggtgagtagctcccatcctcccaaactagaagcaattcatttcattacaaacccaccaaaaagcacaattctgtccaccaagagataacggctgttagtaccctgaaatatatcctgttaaactttttctaatacatatgagtatgtgaatatcatataactaaagtgatcataaaatacttattttagattgtaggtttttttacacaatacgtgtctcagaagtcttcctaggttaatgcatacactcctacagtggcagctttaatggctgtgtagtattccattgttatcttgaagattttaaaacatcttttttgttggatatgtggctgatttccatttttttactataaggagcaatctttaagtgaaccttcttgtacatggatgtttgtgaacatccaaaatctaagacctggaattgcagggtgaaagttacactgatctctgcgacttttgttgtataccctacaggtgtttagcataatggggaggggcagttgtctggggctctcatttggaggaaacttactgagcatgaattggggatacgaagatgataagatgatctcactcccttgtgtcaggggctcatggtctagggcagcagtcttcaacctttttggtgcagggactggtttcatggaagacaatttttccatggacccggttgtggtgtggtttcaggatgaaactttccacctcagatcattaggcattagattctcagaaggagggcatagcctagatctctcaatgtgcagttcacaatagggtttgtgctcctatgagaatctcatgccgccggtgatctgacggtaggcagagctcaggcggtaatgcttgcttgcccgccgctcacctcctgctgtgcaccccagttcctaacaggccatggacaggcaccggtccatggcctgggggttgggggccatacactggcagctgggcaggaggcagcaggctcaggacatgaggaaactgaccctaggagggaggaggttggtctccagtttcaggaggtagatgtcaactgcctgaaattctctggagacaatacccctggctcccctctccacacatcagccctctgtctgaatgatataacatgattcccttgactaaaagcacagcccttgctgtatctgaggtgagccacaaaacctcttgcacttcagtctccacccctgttagttgtggagaataatacctgtagcttgctctgcttcacagccatgagatgcaaggcacataatggatggaagagtgctcggccactgtgaagctctgtgtaaatgttatatacacagtactcccaatgccgtcctcagagcgtgcacgagggcgtctgatgaataccagctctcagaagatgttaaagaggatgctggtctggacgtagtggctcacgcctgtaatcccagcactttgggaggccaaggtgtgtggatcacctgaggtctggagttctgagaccagactggccaatgtggtgaaactccatctctactaaaaatacaaaaattagctggacatgatggcgggtgcctataatcccagctacgtgggaggctgaggcaggagaatcacttgaacccgggaggcggagattgcagtgagccgagatcacgctactgcactccagcctgggcaacggagcaagactccgtctcaaaaaaaaaaaagtggatgccggtcctgaaatgagacctcccttctgaaccggagtgtggacagcccaggaacccaccgccgcagcttaaaatcctcagctgaacatcactgggggagcacatgggctctgcttgcttatggcctgggttcaaatcccaggcctgccatttccagctctgtaacctcagacaagtgactcaaccccctgtaccgcattttccacatctgtgacatctgtgacttggtgtggtcaatgctcaatacatgtaagcttttattattgttgttgttgtttacaactttttgttgttgttgttttaaagacagggtcttgccctgttacccaggctggaatgtagcggcatgatcagggctcgctgtagccttgacttcccagcctcaagcaattgtccttcctcagccccacaagtacctaggactacaggcgtgcaccaccatgcccagctaattttttttttttttattttagtagggatgaggtcttgccgtgttgcccaggctggtcttgaactcccgggctcaaatgatcctcccactttggtctcccagggtgttaggattacaggtgtgagccactgtgcctggccatatttgcagcttgttaatacttacaaggaaactgttagaacagaaaaagaatcattccctcagccatttaaaagcatcctaaaatcaagttcttgttttaagatagttttcattcattgttctggtacttcctaaatagtttcttcccagtaaaagtgcccccactttggtggtttaattataggccatgaggatttgctttttccgtgtaaggttggaagaaaaagttggtttgctgctataggaaatgagtagaagctctgttgccctcgacagccttgtggagttgtcctggaagcctatgtccagagctgtctcccaggtcatcctattgctgcactatggccgactcccatgcagagagggtccttttataaaaacctaaacataaccatgttgagagagcagtcatccctgccgaacctttgctgaagccagttgcctttgctcttagatgatctttgtgcatccaggggttctagaacgttagacccaagagtgtctggtcctagctttgggggtttcttggcctaggatgcaatattttaatggataggatcaacatcagagtaaattttaatttttctaaataaagacattattaaaagttaccagctgagctctgtggttcatgcctgtaattccagtactttgagaggccgaggcaggcagatcacctgaggtcaggagtttgagaccagcctggttaacatggcaaaaccccgtctctactacaaatacaaaaattagccgggcatggtgctacatgcctgtagtcccagctacttgggaggctgaggcaggagaatcgcttgaacccaagaggtagaggttgccatgagccaagattgcaccactgcactccagtctgggtgatccgtctcaaaaaaaaaaaaaaaaaagttaccattggccaaatcaccattttatcaaagaaaagtttatttttacacccaccctcctcaaaaaatagaaaaagaaaggaagcaaagacataagcctggtacatttccaaagactatataaattaatttcatgtaaaacttcctcctttgttcttgtttttcgccggtgcgtccaaggaatcacagacttcatgtacacaaagaaaaggagataagatgacttggtctgagtggcgtggtagatcacactcaggcaagactggagcatgaacggttctcctgaaaattccttctaggctgctagtcagtgagttgtttaaactgactccaatccttttgttgtgcagatgcaaactgtgatgcagttgaattatgtgatttgttttctaaattgttcataaccaaaaaacatcgattcatttttatttatttattttttattttttgagacaaagtctcgctctgtcgcccaggctggagtgcagtggcgcaatctcggctcactgcaacttccatctcctgggttcaagcgattctcctgcctcagcctcccgagtagctgggattacaggcatgtgccaccacactcagataattttgtatttttagtagagacagggtttcaccacattggtcaggctggtctcgaactcccgacctcatgatccacccgcctcagcctaccaaagtgctgggattataggcatgagccaccgtgcccggcccaattcattttattaaataaagaaacatttatttagagtttaaatgtctgatcttgaggttgcgtcagggtgaagactaagctgctgtaataaagacatatgaaattagtggctaaggaaagagagaagtcggtgtttcctcccatgtagcagtccttggtggggtggcatggctccatgtggtcattcagggacctgagctgcttccatcctgatgctctgttgtttttcctgagtgctttcctggtttgcttggtggaagctggattgctactgtgtgtgcatggaagtggaggaagaggatgaggcaccaaagctctgtgtcttgaggccaagacccataagcatcacagcactctgtgcacagcccactagcccaagcccagtaaagcagttgcatataactgcaagagaggcaggcaaatggagtccccagctggaggccacatgcacagctgaaacttgggggtggagggaggaggggttcctatcactaaaagaagaggagaatgactacttggggacaaagagcagattctttgtcatggacatgaagatgtttttaatccattctttctgtctagcagaatgggaaaaggaaacccctgcttctagaactgttccaatgttctgcccatcttgccagactctccctatatttggagggcaaagattcaggcagacatctcttggtgtaaaagtaaatttatctggctgggtgtgggggcccacgcctgtaatcccagcactttgggaggccgaggcagatggatcacctgaggtcaggagttcatgaccagcctggccaacatggaaaaaccccgtctctactaaaaatacaaaaaattagccaggcatggtggcggctgcctgtaatcccagctgctcgggaggctgaggtaggagaatcacttgaacctgggaagcagaggttgcagtgagctgagatcgcaccattgcactccagcctaggcaacaagaatgaaactccgtctcagaaaaaaagagtaaatctatcccacattggtggtttccctgaaggtctggtacaatggaggattccaagcctttctctttttcccaaccatggctcttccactggagtatttcacagggagatccaaggacactgtgggaagaagatcttggatccccaaagcccaaatctgatcgcgttgcccagtgttagtgatgacagctcttcctggcatatgttggttgggtggggtggtctaaggactgcaggatgttttagagcctaaatttaccaactttcggcccctgcttgatgatgctcaacagaacgaacaaagctgtagattacttgtccagatggcctctttatttttagattggtgatcagtttccagcgtctctttatttcttcaccatgatggtctgaatgatgacttcaatgaagggcaaactcaggcactctaggaaagatacattactcagcgtgttattgcctgacacgttctgggaaatcacaggacaatcatcttcatgtgcaacatgtgggtttttttttaatttatttgtttgtttttggcacatttacagttaaattccccagatccaagaaaatgacttcccagttcctggggaaaataaattacgaatggagatggaacccagctcctctctaccacacggggcccagaacatcgtgttctctgctgcaaaactgcatagatcaggttggccacagaactgcaggtgcctcactgatccacattcctcagttaaggaccaagatagaaacctttatatatactctcactgagggaattaattaatgtctgtgttagtttcctagggctgccataacaaattgccacatttcggtggctgaaaacaatagacatgtattctctcacagttcagggaaccagaagtccaaaatcaagagactggcagaaaacaaggtggttccttccatcccatgactccctcctagtttctgctggtgttcagcagtctttgccagtctttgctttgacgatgcattattctaatgtctgcccctgtcttcacatgaccctcttccctgttcctccaattttcaaatctccttcttcttttttaaaaaattatagataagatctcactctgttgcccaggctggagtatggtggtgtgatcttagctcgctgtatcctcaaactcctgggctcaagcaagcctttcaccttggccccccaaaatgctaggattacaggtgtgagccactgcacctggccttccctcacttttctttcgcaagtacatcagtcgttgaatttagggcccatcctaaattctagatcaccttatctcaagatcctcaacttaggtatatttgcaaaaactctattttattttcttttccttcttttttttttttttttgagacagtcttgctctgtcacccaggctggagtgcagtggcgcaatctcggctcactgcaagctccgcctcccaggttcacgctattctcctgcctcagcctcccaagtagctgggactacaggtgcccgccatcaagcccagccaattttttttgtatctttggtagagacagggtttcaccatgttagctaggatggtttcaatctcctgacctcgtgatccgcccgcctcggcctcctggattataggcgtgagccaccacgccctgccaaatttatttattttcaaataaagtcacattcacagataccagggattaggacttgggcatgtcttttcaagggatgcaattccacccactacaatatcatagcaaacgtgcatcaaaaaggttaaatctattaccaccgatcccatgttgtgttgactgcaaaggcgtacggcatcaagccttggaaatgtaacaggcccatttttcgcagttggaaaatcagaagtgctagaaagagagctggctcatcctgtagggatgggtggtgggtcgcctcaggccctcctttcattcccagggaccccgtttgcacagctgcgtgtggagccggctagcacgttgtcagcaacacttctttccgtgtgcttgctcccttagtctctgtaactagcaggtggttgtggtgcctgtcattcatctcccagggctggcttgataaacgttattatacttcttgatgggtaccttctggcgtatttaccgctttgtaactttgctgtttattgtggttccttggagcccaataaaagcaagataagaaaaagcaagcaagaacagggcaggaaaagtcagaactgtaatttagtcatgtaaggttcaattggatgcgtttttcctttgcccccctgccttcaccgctgggctgttcagagccaggctctgctccacttcatccccatcccagtgacattacaccctccacatccccatcctttctggagtgatcagtatcttcttcagtgcatgatggaaaggggaagattttagttcatatcagatgttcagaatctttgtaggaaattgaaaaaatattaaacctttttttttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgtatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaagtttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtagggaagggatccagtttcagctttctacatatggctagccagttttcccagcaccatttattaaatagggaatcctttccccattgcttgtttttctcaggtttgtcaaagatcagatagttgtagatacgcagcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggctttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattttggtatgtggtgtctttgttctcgttggtttcaaagaacatctttatttctgtcttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaagtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaacctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagtggctggtaccggttgttcctttccaggtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggccctcactctcttctggcttgtagggtttctgccgagagatccactgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcattcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacccactgacctgcgcccactgtctggcactccctagtgagatgaacccggtacctcagatggaaatgcagaaatcacccgtcttctgcgtcgctcacgctgggagctgtagaccggagctgttcctattcggccatcttggctcctcctccaaaaatattaaacttaaaacaatttcttcttttaaaatatgtattatgagggatgttgtagtatagccactgtagaatgagagaaaatattatacagatctgaacatgtagcaggcgtggagcgctcaggtttcacgggtggccttggaggttctggctctgatgctacagagacagccaagtataaaggggtccctgagaacctccaacctggcctgtgcactgggaggagtgtgcgctgtgggggagccatggaattttgtgctgtctgcagtgggaaggagcttggcctctcctcttccggggcggtaaccggggattcagtctgtgaggcgggaagcccactaggaggactctcactttgctgagtctctctttcccttctttcttcttcacccaataaaccctgtccttctcacccttcaaagtgtctgtgagcctaatctttcatggtcatgtgacaagagcccggcttttagctgaactaaagagaaagccttacagcactaccatccagcgtcctcctccttcctgccctggattctttagaaatgactggaaactctctccagaaggtgttttctgtgatggcataaatggatcactggaggcccagggccagtgctctctctctgctgtgcttccttggaattctggcccccagccctttcctgaacgcgtcatctccttgagggtaaaaggagccagagaacactatcatcgcagatgcttcatgtgaattgttccatttttaagacaaaggacgacagttggccttaaaaataaatctcatttgtgtttcttttggttgtggagaagtaaagaattttcaaaacgggtcctttttatatacaaacgtttgtctaaatagagcatctttagatcttaaaatgaacagcaaagcgagcactcggagatgcttctgttgtgggctttggtagacagagagagaggtgaaggtcccttctatgcctttttctctttcaaatagttgtttttattgtggtgaaatatccatagcataaaatttaccacttttaactgtggaatgtacagtgtagtcaggtttagcaccttcataatgtcatgtgctcatcaccaccatccatctccagagcttccttgtcctccctgaatgaagctctgtactcatgaaacaccagctcctcattttccctcccctccagcccctggtaaccaccattctaccttctgtctctatgaatctgactgctccagacacctcacataagcagaatcattcagtatttgtcattttgtgactggcttattatttcacttagtatgaagtcctcagggttcattcatgtagtcacatgtgtcagaattttattcagttttaagactgaatagtatctcgctgtatggatataccgccctttgtcgattcactcatcaatggacacttgagttgtttgcaccttcccccgcttcccactgaagccttcctctccatcagttcccggctgtcgctccctgcctctccttggtgatcgcctctggaacagaattttgctgttaggagccactcctgtcaacaggatttcccagagtgtgttaaaagaaaaagcaaatggataatagctctaaataagaacttgctttgggtaagctttggtgacatctgcaagaaaaaaaaaagtggcctgggaaacagggagggttcctggcataataaacattttcttaaacctttatgcaaatcccagattagtagatattgcgggagtcagtttctaaaagaaaacttgatttccgaaggccatgcacagttattctgtttctccatgtgttttgtttgtaagaggaaaacagtggaatagagaatgtttgccacagccaaggttttctctagtccctttggtaggtggaaaccaagtgctggatgaaattgtgtctggatgctgaataaagacatggtttgctgaattcattttggcagcatacactgaggacaaagcaccagtgtacaaccacactacttaattaggattctctgaagacatgccaatagcatctgctcagaagtagtgctgcaaaaagattagtcttgattttgagtatgacttgatttagccagatgcataggcccacttctttaaaagaaagtccaaatttatcttctgtgttctttgagggagtgacaacctagaatcagcttgaaacataaaatgtgcaaagtaaaatttttacaattatgattgcacttctaggatttagtaaacctttaaccaccaagagactggacttgggggtgcgttgcctgtgataggatgccaagttgtttcttggcagaaacatggagattgttaaaccaggatggtaaagagtgactttgtctgtgtcagctactctgaagctatccctgagtcccctggaagacataagcatcccttcctccatgaccccaaggctccttgtgaataataccacattagagcacttgtcacgtcatggtggaattttcatgtgtacatggggtttcatgtacacacgtgtgtatgtaaagggcacagactgcattgttttattccaagcatggggccaatgtattgcagtaacaaggacaaccttttattagatggctactgatcacagtgagaaaggcattagcaccatttcacaactgaggaccaagtagtttagaattccctctggtcactcaactcataagtggacccatgagacctgtgggactccaaagctggtgcttttctcattagaacatgatttccatgttggtgggaatacaccatatgtctcataaaagagttaattatcaaaatcacaatgacattcttcacactcactgggatggccatgatcaaaaaagataatagtaagtgttgatgaggatgtggaaaaattgaaaaccttgtaacttctggaatgtacattggtacagctcctttggaagagtatttggcagtcactcaaaaagttaaagttgccataagacccaacaattcctcttctaggtatataccgaagagaatgaaaacatatgttcttacaaaaattaatacaagaagggtcatagcagcatcattcatagtagccaaatgtccatcagctgatgaatggctaagtaagtgtgatatattcgtgcagttgaacatgattaggcaacaaaaaggaatgaaatacaacacatgctgcaacatagatggacctcagagacatcctgctccgtaaaagaagccagacgcagaaagtcacatattgtatgattccatttatgtgaaacatccagaataagcaaatctgtatagacagaaagtaggttagtggttacctagggctggggatggggagcatttgaaggggattgaggaggaactgctaatgactttgaggttcctttttgagatgacaaattgtgataatgggagcacactgtattaaaaaccatcgaactgtatactttaagtagatgaattgtctggtatgtgaattgtatctcaaagctgtatataaaaaataattaatgaggccagatgtggctgctcatgcctgtaatcccagcactttgggaggctgaggtgggcggatcacgaggtcaggagatccagaccatcctggccaacatggtgaaaccccgtctttactaaaaatacaaaaattagctgggtgtggtggcacgtgcctgtaatcccagctactcgggaggctgaggcaggagaatcgcttgaacccgtgaagcagagattgcatgcagtgagctaaaattgcaccactgcacttcagtctggtaacagagtgagactccgtctcaaaaaaaataataaaatgaagttaaaccaaagaaataccaggagacagtaacattaaagaagtctgaaagagctcatacgaatgtataaggaccccagtagataaactggcaaaataattctaaaagagagcttacagtagagggaatataattaccacacagacaaatggaaaacattctggttctttaacaaagatattaaaattagaaaaataaagtactgtaatatttctcacatatttaattagcaaagcattttaaaaatgattatcaattgctgggaaagagagcaatatttttctatgtttcaggttatatcgtaaattgatactactcttagaaatcagtggccatatatatcaagagttgtaaaacatttgtggctattctatttttagaaatctcttctaaaacatacaaaaatataaaaatgaaagactaatgatgcaaattatgactcatttatgtggtcatttaaaaattagaaaaataaaaattcagttactaagattttaaagttatatgtactgtaagtataacttacagtaaaaaacaggcaagtttaaaattactgaaaggaaataattaaaatgacccagcgatggagttgtggtggagttctgggaaattttttcatttcttattttgtaatgcaattacttttaagttttaaaacatttttataaatagaccttatatttctaagagttatgcttcctagaatattaagtttttgcagattatttcaatcggtaaaaatcaaaagatgccggctctcttggctgacctttaaattaaaatactaatgaagcatttattaccataagagaaaaatatgcttaaaacacctttcattaattgtacttttgccaaaccactctagagttgaatgattctctttctttcccaatttacatagttctgtgggaaaaaatcggacatacagtgagttaagtggagaattgttgcaagcaagccatgaactgccttttaaaagcttgtccttttgaggggaagagacatggattctccacttcatcccctcagttaaacaaaaatctgagccttgcatatttaaagataaaaatatacttaatttttaaagttattgttttggtccagtttagaaaataccacctcattttctcctcccttatgtcttgatattgatcccaaagaatgtgcgtcaaactaagaaagttaattttcatgtagcaacatctggttccttagccaattcagggaactcttgagtgcttatgctcagagcttttgctgctgtttctagattccaccctctgttagcttctcacaagcagtccggtatttggtagagtgtggggggccgggggctcatgaagtcagattccaacgtgcagggtttgtttgagatgcctgtaggatcaaccaggtttcacctctggatgtatgtttaattcagtggacgttgtcattttgatggcacatacccttcagtaaaaagaggttaaaagtattctaaaatgaggtggtggattatctgtttgggtagctacatggtctctgaagtctcttccattttaagataaaattgccaaagacagtttttacaagtttggaactttctgagtgggtgatacgcattagggttttggtggtgctgattattgcatccagaggttggccctgacttctgtcgtctgctggtcttggaatacattgaagcacaccgattggagcacaccgactgaagcacaccgattggagcacaccgattggagcacactgactgaagcacactgattggagcacaccgattggagcacaccaattggcttttgcttttggagcttggttattgtgcagtgttcccacttacctaatcatcactttgttggtggtggagtggagggcctcactctggttccaagcaagtcattagaatgatctacaatttgcagttctaaaatcaggaaaacttggggtttctccaaagcctgcattaaacagaactttttctttcttgaaggtccagatccatacttaaattttacttaaattttaatgagtaatattttcccatcagtggcctaacgcactataaattatgtatgctgcacattaaattcatttttattttttcacaaactggacttaatggcatttgttgttttgtataccctatacgatagaaatttgttgctgaaaaggaattcaggggtcctccagatcactggtttccaaacctgactctttaggaagaaaacaaacaaaaatcctccagtttcgttatggacgtgatgaatgagacacccacggagtatggcccaggaatctgttctcataaaggtctccaggaaggttgggaaggaggagggaagagcgtagagctattctccctgaaaagaaataggccaagagttgattgttgtgttagctggtaatgggtacttagggatccattattctctctgctctttgcatgtatttgaaattttccataatgaaaagacttttaaaaaagattaaataacagcttcccaggtgatcctgaaaatcagccaggtttgggcagcacaatcaatccgcctctcccccttaacaggtgagaacaggaaggcgaacgaggccatgcagtttgcgtgaatgaagaactcatataggatctagaactcctgtttctgccccataggcctaagcccttaactcctcatggcctcctcagactaatcattttgctgaccttcttagcattttaaaagagaattaataaatctgacttgtatgattcacttacttttttttaaacacagaggagtgttgagtgtttttgagatgtttttctttcttcacacatttttctaagatccttttaaacccattccattggacttcaaggtagctattggcttttcaaacataggttacggggctactactttgccgctagttagtgtgtgaggccactggtaaatgaatgaatgaatgagcagtaaaggtgctgaaaagtgtaatgcgtgtctatatgaagcagtgtctattgagcaaaccggagagaccagctccatcctggaaaattaaaacaatggtactgtgactttgcctattgccaatcatcgatcagtcctgtcggtctgacttaaccttctaaagctctttaccacagtgtatagataagttgcctgtcatgtaaatatatcttattgattttgtcaggcagctggccagttttcttaaaaatgtgtcaaattgtctgaatgatttgaccagaaaccccgagagtcaacgtgaggaggaaagaaagaggaagggaacggggaaaaaaagggaaggaaaaagacaaataccacctaattgagactaaaggaatgatcactggggctaccatggcttttgtttggttttggcaaggctttattttattttttttttactgtcagtgaaaacaagaatttgtattgcaggaaaaacaaactaacaagtgttttttcctactgtactctcaacacaaagtgcttctggtcaccaaaatgtggagagatgttgccccccacccacacacaaagcaactctccagcagacaccaaccgggtgtcctatagttcagtgtaattctgagattatctacctggagatagcatcaggtccgacaagataagggttcagtcccacaacactgccccccaccatccctgcttcagacactactcataagtacaggttacccatagctgatgtccaatttagctacaaattgacccccttttagggttctcttgtttgctaggacagctcgcagaactcaggaatgcacgttacttacatttaccagtttattatcaaggatattacaaaggatacaaatgaacagccaggtggaggagatgcacagggcaagggatgtgaggaggggcccagagcttccatggcctccccggacccaccatcaacagagctttctgaaccctgaagtccagagacttttatggaggccttctcacacaggcatgactgatgattcactccatctccagaccctcaccccttcctggagactggggagcagtagagctaaaagtttcaagcttctagtcatggcttggtctttccagtgaccagcctgtatccaggaacccacccagagtcaccccatgataacaaaagacactcccatcacccaggaaattccaagggattagctctgtttcaggatgttggaaatgagtgcttgagtcgcaaaggaaataacactcgaacagaaaatatctcagcaaagcaaatttacttctgcagaagggtgcttcctgtttcagtcacgatcgcaagagcacaccgaacaagggaaggaaggggtttttaaccctaactcagttcctgtctctgtgtccttcccctattgattggggttggactgcacaacctaagatctaagctgacccgactggctactgtttgaaattgcggagggctagttgggtgggaaaggagagactgtccattacagtacaaggcatgtcagggtgcagcaagagcaggaagggtggtttaaatactagaaacgagagtacaaggaagttgggcttcagaacaaagaacaaggacattacaagttaaaccctttgaagaggaattttatcatccctgacaaggaactggggtcaaagaccaaatattagaacaaaaaagtctcctaacatccctgttgctcaggaattacaaagattttagaatctctgggccacgaactgggggaggagtccaagtgaatatttcttattatatcccagtattgctttatttttgttatagatttatcaagatacaattcatgtacccataagcttcacccatttaaagtgtatagctcagtgattttttgtgtatgcctagagttgtacaaatgctaccataatctaattttaggatatattcatcacccctaaaagaaactctatacttactagtagtcatctcccttttccccattatcccgacccttggcaaccactaatctactttttgtctctatggatttgtctattctggacacttcacataaatggaataatacagtaaatggccttttgtaactggcttcttgtattgtgttttcagggttcatccatgttgtagcatgtcatagtgcttcattgttttaatggcctaataatactccattgtatgggtgtaccacattttggttatccatcatcagttgatggacatttaggttgtctctacattttggctattgtgaataattctgccatgaacattacaggtttcatgtggacacatgttttttgttttcttgggtctgtacctaggggtagaattgcagggtcacatgtattaagcattttgaagaactggcagttttctgaagtggttacaccattttatggttcctctagcaatgagttgagggttctgatttctccacatcattgccaacattcatagttacagatcttcttgattctagccatcctcatggatgcaaagtggtacctcattgtggttttgatttgcgtttccctatggctaatgatgttgaacatgtttttatgtgtttattggtcattatatatcttctttggagagcatgtattcaaatccttggtgcatttttataatggatttatttatcttaccattgatgggaaaaacacttgttttattttacacatatctcactttgtgagtaaaaaaaaaaaaaaagattggaggccagattcagtggctcatgcctgtaatcccagcactttgagaggtcacagtaggcagatcacctgaggtcaagagtttgaaaccagcctggtcaacatggtaaaaccctgtctctactaaaaatacaaaaattagctgggcatggtggcaggcgcctgtaatcccagctatttgggaggctgaggcaggagaattgcttgaacccaggagatggaggttgcagtgagccaagaccacaccattgcgctccagcctgggcaacaagagcgaaaatctgtctcaaaaaaaaaaaaaaaaaaaagactggaaaaaataacaaatattttaaacacccaagagacattattaacagtttgattgacttatagttccatgtaacctaattttagggctcattctggtagtggaagaaacctgacattggtaatatataaatagagtgcacacacagaatcctgaatccttttaatgcctattaggatgggtgctaagcctgctgggagaatactgagttagtggagataactgatttacattgagaacgttctgatatttgtgattttctcatactatataaattagagattcatatgtgcaattgagaatatttcactgattctgttggaggtttttttttttttgtctttagctaagttgtatggaaactcaagagataagtacctcatttgtggtattgtgaatttttccaggggaagaaaaccttttttctcttacaaacagttgaagaaaattatcttttctgtttttaaattatcataattgggtttctccatcacagatttgtcaaactatagagtatgtataaagtcatgtttattcatttgatattctcaacataagtattctaaacttgattatgttaattcagaagaatagaacattaagcttagaattaggcaaatatatacaagttgcaattgtgtacagggattgcttatatttccaggataaaatcaaatcttatccccaaatctaattagcagctgttcattggtgtatttgacatacagcagccgacttttctcacctcaataaaccactacatcatcaacagatgcagcggagccttgaccgctaattagagttctctgccagaatcctagagcctgatgttggctctgtgaagagttgagtcaaggacatcccagcagtggtttttggaggaaggaaaattagaggttaaatgcatagccgtctacacaagagagatggttatttttttagatgcacagaagtggatctcagcattataaatacttttattaatcagtgctctttgctactttaaatctgtttccagactccactagtttcctaaagctgctgcagccaattaccaaactcgttttcttaaaacaacggaaatttattccctcacaattctgaggctagaagtccaaaagacacccatcaaggtgtctccaggccatgctttgtgcgaggctctagggaagaatccttccttgcctcttcctggcttctggggcctcccagcaacccctgtgttccccagcttgcagctacatcactccaatctctgcctccgattcacatggccatctcctctctgtgtatctttgtgtgtgtgtccttttccttcttgtaaggacaccagtcattggatttagggcccaccttaatccagtatgacttcatccttttttttttttttttttttttttttgagacagagtcttgctctgtcacccaagctgtagtggcacgatctctgctcactgtaaccttcacctcccagattgaagggattcttgtgcctcagcctccctagtagctaggactacaggtgtgcaccatcacacccagctaatttttgtatttttgtattttcagtagagatggggtttcaccaagatggccaggcttgtcttgaactcctggcttcaagtgatctgtgtgccttggcctccccgagtgctgggattacaggcatgagccaccatgcccagctgacctcatcttaacttaactaaattgcacctgcagagaccctatttccaaataatatcactctctccgattccagctggacgtgaagtggaggggcagggggttgggaggatgggacacagaaacctggccactccatttttgaggtacatttttaatgattgtagattttcatgtatgctacctatcaaacaagataacgacatctcacagatttgggggcgtatgtttgtatatttccggaaggactctaaaaatccagatggaaattgatatttttgaggcatctaccacacgtgaggcagttttgcatcaattatctcctttaattctgtgaagttactttctatttattctggttcctcatataattgcaatttgctgaatttgttggtgagttcttaaaaatgttaccgtttcctacctgttaccatatctgtgtttatctcatgccaaatatataaataactcttcctcagccacttaacagctaaatttgggagagattctgaaactacatgggcctcagtttcctcatctgtaaaagggggccagcaattcatcattaaccttgtgacattgtggtggctggcaaataccgtgtcaaacaggaagtgttccacaagtggcagttcctcgttatgcttttcttaaagctcttttggaggtgtgcacaaattcttattctttttgtgcttactgccaaaaagggtttagggatacatgtgtcgtaccatcccattttccagtagagacattgtaattcatgggcatatcagttaagaattggatgcagctgtatacagtacaaaaattccaaataacagcagactgaatgagaatgtttatttttccctcatgtgaaaggagtagggagggggtgggccagggcttcagagcagttccacagtcatcaggaaccaggcttctgtgtctctgttgtaccatacaagcccagggcttccatgcacagtcccctctgaccccaaatggctgtgtagctccagccctcgcgtttgtgatgcatgctaccaacatgtaaaaggacaaccaggatgcctctcccagctgagtggcctccctctaggcagcttttcaggaagtttccacataacacttccactaatatctcatttgttcagtgaccatgtttagctgcaaagaaggggaaaaatgttttcttctgtttcaggcctcggtgtgcccagctcaaatgagggttctcttatgaaggagggaggggagtggatgtcggggtgggtagccagcattctgtgctgtaatgggattgtattctgtagggctctgaagatagcacttggggattgaggagtctggtctgggaagtgaaccttgtatgtagctctggatctagggttctaaacatcctgctttagaactacagccttgtaagtgatttttgaaacaactcattcataggcagagaactgtctatccttcaagcctgagagaaaatgaataatttacctctccattttgatcacctgccactgtagcattggtccttccaggcctgcgtgtgccctgggagggtgaaacaaagctttgccagaggtgcctccactgtaaagcaaacccacagatagtaactgttgaaaccagcacatccctgtgcagtgaaaagggcattccgtcggcagtcaccaccttgggcctggtcagggtttcagtgaaatccctttccttatgttctgctggcattgaacataagggaagggatttcactgaaatgttgaatgttcaaatccaagcagcttcaaggaatccccccagctcccttgctgtcaggacaggaggtggatctctgggacctcttgaaactgcttggaattggaacattcattgcttttctctagacccagaactaaggcagctttgctcaatgccttgctcagccatttcgccaagtgaggttttatgcaatgttactcgtcactactctgaatcccagtttcagattgcaggacaaacagacgcctttttaatcattgatgccccttcctaagggcccaatcagaaagtctgactgggccctagcaaatcattccttgccaaatgtacatgaatgccagttctaggaagaatgaaatagtaaaaatttgtagaaatcaacatgtcatgtggaattagcttagcacattccagtggctctaggggtccttgtcccccactctcgccttataataaatatagaaagaacattgtccattcaaccctaagacttggattctggctgtgccatgacacctggtagctgaatgtctttgagctcatctttcctcacgtagatgatgagtgaggtgcaatggtgaaggccctctgtggctttgtgatttgtttacttgattatttattgattccattcatgttgcagatgtctgtcgagtatctgctgtgcccaggcaccgtgctaggcactgggggcacacagagtgagtaaggcacgagggcaagttccatccatctctaagagccatgcagactgaggttggagctgcgtgcacagggttatctgcccccagctaccagagcccatttccaagatggtggaaaccacttagtggagtctacactgcagtgagacagatttgctctcagccattgtcacactattaattagcttccactgtgttaagtgccataagcctttgttccagaggaatccaagtgggagaaaaagagcagagtggctggaaggttaggtggtaaggaggcacagaggagggagagggggctggggccagggagctgctgtcatgggcaatgggaagctagcaggggtggggccgtggtcagtttcttggtgggagcaggagctccagctttcctgtggctcagctgaaggttgggtacgaacgggacatagggctgaacagttcacattgttaaaaataaataagttcctcgtttataattctgattaacacagaacatttataaaatacagcctctggaaaagtgacacaaaatgcattacaatatgtcattctcaatcttttaataatgaaaaatgtgagacgcccaagatcaaaggaggcacatgttcagggaactgtttcatctcagagcttgatggggacaggatgatggactgggttttaaaaatggactacctggtcagtttcatgtcttttgacctacctcggtatgggctgttttcctcatgtttataatctagtttaggagctttttcccatcctggctcgttggctggtttgaagcctcactttattcttcagaagggccttggtctgtccaccaccagatgtctcatgtgttatctgacacataccagcttcgtggatatcaaagggggaggattacagggccattgagatcaaaacagagcaaatttgatgatgaaccaggggaaacaggccaagatgtgtccctaatgggcttgttccatccgtttgagtaaattatgcatgggctggcttggagctgccagcagaagcaggtagatctgcctccacctgccaaacccagatccaaatatggaagaaaccacaaggcagccactgactgtggccacaaatgggcacatagtttaccttcactttttgaaaaccatattaaaattgagtcagcactccatagaactgcttgatgaccaccaggccttcctttataaagttctcatgaagaacattaacttttgggaaatgaagcacttatatgactatctagtagagtaggaactacgaacttcttatgttacaatgagagagccattcttatttttttgaaccaagattgagagttttgtcaggccaagaggcagcaggctaatttctcaacctttcaggtgctagaaacacattgtgtcatgaaaatttagttgccccaacgtggtgccctgttgatttttaagtcaagggcaacttcattcttttagtacactgttggaagaatcttgtcctggaggtgttaagattgccttcattaaacatagtcattcaggccgaatgcagtggctcacacctgtaatcccaacactttcggaggccgaggtgggtggatcacctgaggtcaggagttcgagaccagcctgaccaacatggcaaaaccccgtctctactaaaaatacaaaaattagctgggtacggtggtgggcgcctgtaattccagctgctggggaggctgaggtgggagaattgcttgaacccaggaggcagaggttgcagtgagctgagatcgtgccattgcactccagcctggccaatgagtgaaaccctatcgcaaaaaaaaaaaaaaaagaacatagtcattcatttcttcgttcactctcatttttttctaagtgtatacatacagtctttactctgtctatagtctctacacaaagtataagtatttcatttattagaagaaaacattaactgttttggggcccattataatgaatttttaaaacatcacaattttagaattatgattttaaaaaactttactaccaggtacagttttgagaaagctctgggacattgaatagctctgtggctcccaaagataagtcgtagacatcacaataacaagggattatagtatttgagaccttactcatgaattttaataaaaggctgtgtgactcaagcgatttcgtattctgggaaatgttcaaattctgtactacatgcctacattctgcagggttaggctgggaacatagacctttgctgagaatctgaagagaattgctaaggcaactgtgtcccatatcctcaggtataaatcttccctccctccctcccttccttccttccatttgctcatttattcacctacccattgattatcataattctatcaacttttagaatcttgagactttccccaggaaatagatgaggagggggaacccatataagtaaagttgatctcattgggcataattagctcaaatattatatactcttccctcaagaactgagaatgtagggctttatagattttaaaaaatctcatagtcttggcatttttttttctggcaatccaagtcagctggagaagctagggtcgggaaactagttttgcaaactggcagaagtagtggttctttactaagatggctcaattgagtctctctcataaactgttagattatgggcgtcagagctgtttccaaaaggaaacaaattggagtccctctcctcactctctttcgtatcatctaggtaaattgtttaaaattggtctgtgactctggcaggtgtcaaccgctccaagtgactgtaggtttggggttgccctaaagccaaatgcgtagatgatgaaagcattaagaacttctaaacatgagagcaacagctgacgccatctacacggggctgttgggttttttcctctggaaggaagtgacagttggatgcctggcactttcacatggcctattttccccatgggaagttttataaaaatatccattaaggctggtttgtatatgcaacagaagggcataatatgcccctcaaatgaatatcattatctccatccatgaactaaaagcgtttgagggatggcaatgctgtgcaaattccacaaagccacagcttttggcagagctcaactatgtggaaaccgatctcttctctctccccgtctcagtgtctcaaggaaaaacctcattaagcagacaccttaagaagtgtattatcttccctttaaacctccaaaagggagggaagaaaaggagggatgtgagagtgaagctgcctgtgtcatgtccagaagactatctggaagtcttttttacctttctttgctttcttaatcacctcgttgaggttataaagtcacgaaggagactagatttggtagttgttactttaaaacagcccaaaacatttataaaaacaggtttttggggggtaatgaaaaaaaatttaagtcagccacaccgtcacatgttcccttaaatagccacagtggggtcattggtaacatagacccataagcacatgctccatacagaatgggtcatgcagctttcaaagagcagcccttcctcaaggagctgtgttacgtgaatactcatcaaagaaattatccatgccgcttctttctaactcagtgaaaacttgatgaaatagataaaatccacaaagctgtttagcccttcattgaacagcctattttagctggtgcctattttcctgagattatgaaaaatccagttccctctttacaatagtcaccaaaaacctccatttccacaaagggagtaggattgcctctggtcagtaaatggcgattccacctctgggtaggcagaagaaaaggggaagcaataagtgggagggaagcacctataacaggaaaatgcaacttttctagaagtgtctaggagacttgtgttgagatctgactggccagagctatggcctgtggctaccgatagctgcaggagaatcggggaaatgtattttgttagctaaacatgtcatttcaacaaagctcagaaatctattcataaggggaaaaaaaatgaatggcttttggtcagaggcctagcagtgtctgctactggaagggaattcaggcccaggaagtgaaaaccgagtgattctatctaagaagtcaaagtgaacacagtgaatagtttgcatcccatacagatagctcactatcggcagtccacagaaagtgtacattgactgtatctggagggccaaaatttcagccaaacatcttgcctaattattctgtgcatgttttttaaggggaaataaatctgtcttgcagctaacaaaatagccttgagtcttagagtacattttatcatggagcatctgaaaataactcagctctgaagttccatgatgaagttgtcccctggcaatggggtaaaaataagtctttatccattcatcagcacaagtttagctaggctctttcaatgacttagttctagcttatgcatctgctcctaaaacaatattaactcctaatagtctccctaaagaggaactcaaagttctgtagagaagactctggttgactttgatgttcatcaagatgagaggctcttttttgttctcaagattctggattaaatgagctgtcccagtcaatgaaaacttggggcttcaggaacctaacagagccaacccaacagaaaggctaggtgtttgattttcattaaatggcatttacttgtcaacactgtaattcttggaattcaagtgtgtctttaaatatttccactagaagctaatcaaaatcatgattttatccattgaagcatttaaaaatgtgattatttcttctccaaggatctagaaaccctatttcctcgtattctttgtgtttaaaaacatactttgctttaagtttactattgtgaaacctgttataatcaattcaatcataccacccgttttgaccacttagtgttcagaggattatttgctccatttaggaattagaaatcttcatatcttcattagaaccagatttctttgcgaagtctgtggttcttgtagtgggagttaagaggaagcattaaaaatatctgcttcgttcatggagtagatgcacttttcaggacagatccctgttactgatctggtgttttctttgaaaatgtcacagaaacctccaagaatggcaagcaaaagtaagaaatagtacctcctctaggtgcatacgtcccaggtgtgatcagaaagagctcatttgaagcaatgtatttgcatatgtcaaaataatctgatcctctaatgcatttcctctgttaagccatagcaggattttgcagctaaattcagagagtcagcaagaagaaaagggtctttaaaaataagttgaggctggttgcagtggctcctacctctaatcccagcaatttgggcgtccacggcgggaggattgcttgaggccaggagttcaggatcagcccgggcaacatagtgaaactccatccatttaaaaacaacaacaacaaacagctagccatggcagtagctcttcaggaagctgaggcaggaggattgcttgagcccaggagttcaaggttatagagagttgtaatcgtaccactgcacttcagcctgggtgccagagagagaccttgtctgtcaaagaaaaataaaataggttgactaacagtcataataaccagcagccttcctgcagactcttcataaatactgagttgtttataattaattgtttgcaagcaatgaccttctctttctgtaacctgagaaatgagattaacaataacagaggaaagccaattacaaacagatacgtttaccatcaaaattttagcccaacagggcagatcagaagccccagatggctcacttcttttcatctgtgcttaagaatgcagtgaccatataacaaagaatttaaaaattaattgtaatgagagaattgacccatggtggttaccttttcttaggaccatggttttcattttaatgtggaaaactgacatcccctggaaaagtagatattagagtaacacttgttgggtaattaactcaataaacaagggaactgacttgtattagtccattttcacgctgctgataaagacatacccaagactgggaagaaaagtaggtctaatggactcacagttccatgtggctggggaggcctcacaatcatggcggaaggtgaaaggcacttcttaacacggtggtggcacgagagatgagaaagaatcaaaagtggaaaccccttataaaaccatcagatcttgtgagacttactactacaagaacagtacgggggaaccgcccccatgattcaatcatctaccaccaggtccctcccacgacatgtgggaattatgggagtacaattcaagatgagatttgggtggggacacagagccaaaccatatcatgactcttcccaggaaaccgttgatttgtgagttgaatataggctctgctgcttatttagttttttctcccatttcctgtaggacagacattaggacagtttttcttctctatcttccactggtcatttctttggtaaaagaagttgaattgctccttctttgtaccagaatgcctgtgttatcacttgtagcaatagaaattcacaaatgtaatcagatgaaaggtctagaattttcctcagtggataacaatgtaagtatcacttgattattccatccttaattactgacctcagccagatttttttttgcctgaacttgatgtaggcttttaaagagacaggtacacatcagcgggcaatagatttgtttagagaccttggaagcctgatttgcaaagtaacttcatgtaatggtgtgtcacccacgaaggaatgggtggaaagctgcagcttgggttaaatgtcaccattgtcattatcttcagcaaacatgtattgagctcccaggagatatgcaacgtggtctctgatctccaagagtgtgccgtgccttgggagggaatgcaggattcattcgtttgacagatgttcacaaagaacctgcttgatgcagtggccctcttttgggtgctggaagctcaaccatgagcaaggcagatcaggtccctgctacgtgtagaatttacattttaaagaaaaagttgaatttaaacaaaaatggaataagaaagataaagctaaataagaaataagataacagaacaaaagctctggagggcccctttaaccgagagagtcaaggaaaacctggaggagtaggaggcaggcacagttgagttgagccctgaatgacaagtgaggcatcctcctgaagagctggggtgcctggctccaggctgatggacagcaagtgcaaaggccctgaggcaaggaaatgtttaaaacctatgctgagaagaggtgaagagaggggagagagggactttcctgaccagggcagggagtagggggctgtacccaaagacactgaggaaaacttgtagggtgtcatcaagttgacagagagtcctgtggtgggaaaagagactgaacaattacattgggtcaaatggtagccggactaagtaggcactggggagtgactagaggtttttgagcaaaggagtgatgcatgccagtcagtgaatcctgaagagttaatctgactggggtagagtgtggcatggggaaggaagccaccgagaggctagatatggggctgtaaggcctggcttagtctggtaaagtggggttagcatgaaagggccagttcaagagacattgccagccacatggacagtttcatcttggccagttatctccagactctgaaactctctctcagtctgtttctactattgtagtactttggggaaggagtagggagaaaaagatcatagacttgaacaaatcaggtgccactgggcagagggttctaaatttgcactctccaacacagtagccactagtcacctgtggtgatttaaatttaaatgaattatttggccaggcgtggtggctcacacttgtaatcccagcactttgggaggccaaggtgggtggatcacttgaggtcaagagtttgagaccagcgtggccaacgtggtgaaaccccctctctactaaaaatacaaaaaattagccaggtgtggtggcaggtgcctgtaatcccagctactctggagactgagggaggagaatctcttgaacccaggaggcggaggttgcagtgagccaagattgtgcctaggtgacagagtgagactccatctcaaataaataaataaataaataaataaataaataaataaaaagaattatttgcaaataattgcatcattagaaaaaaattataaatgaattaaaagaaatttaaagaattcattaggagtcaccacatttcaaaggctcagtagtcatagaaagctaatggttactatattgaagagtgtggataaaatacttccctcattgcagaagattctgttggacagcattgggctggatcacgaattttctgatgaacaaacccttcatctttctatagatcacaagaaagtctcccatggtgttttatatcacgaactactttgctgtggaaacttctgtttgtacagaacgtttcctcttacggataccaattaagttctttatgatattacattggtttggctgtcaaatgttgtgtgcttaacaaagaatgatagaaaaatcactttccagaacagaatgtttgaattgcatgtagcatagaaactgagtaaaaatttcagcctgatttaacatctttggagtagacttcttaaaggagagggatatgaacactgtaaaacacaaattcatcagaagtgcaatgacaacagggttcctctctactctgctggtgacaaactttaaaactctattgacttgtatctcttgatgtcattctattcccctctagtggaattaaaaggtatctgtctttctactccagcttggacacattcgcagtagtaggaatagaaatctagagataatgaagatagaagatagcattatcacttattttcatatcatgataggctgctgctttacattttaccctttttcctgtcctcaggggaaaatagccttctgttctctgtctatttgagctacttggagaaaaaaagtttaggtatctatcctatgtatcactatttatcctcataccagaagaagccttattgcccaatatgttactaggatgtgccattggttcagcgtctagcacagggtcaggcccgttaattgagttagaggcatgggttgaggtcccgattttaccacttaactatccatggcttcaaattcaatcatttactttcctgaacctccgtctcttcatctttaaactggagactctcctttgactctccatggtcgtatcacaagataaaaggaaataatgaaacctcattgaaagttaaggtggactctgcacatttatgtggcctcattccccaccaccaccactctgcccccagcagcatccttttaggaaagatggataaacaggtaaactagaaatatgtttccgaactctctgcgtacaggtgaagcatggtggggctggggctacctttaagttggttgcaagagcccaaaggctaccatttggtttggttatatttccttttttcttttgtcttcctctttttcttttcttttttttttttgagacagagtctcactctgtcatccagcagtggcatgatcttggctaactggaacctctgcctcccaggctcaagcaatcttcccacctcagcctcccaagtagctgggaccataggtgcacaccaccatgcccagctagtttttgtatttttttttttttttttgagacagagtctcactctgccacccaggctggagtgtagtggcgcagtcttgactcactgcaacctccgcctcctgggttcatgccattctcctgcctcagcctcccgagtagctgggactacaggcacccaccaccaagcccggctaatttttttttttttttgtatttttagtggagacggggtttcaccatgttagccaggctggtctcgatctgctgacctcgtgatccgcctgccttggcctcccaaagtgctgggattacaggcgtgagccatcacgcccagcctagtttttgtatttttggtagagacagggtttttgccatgttggccaggctggtctcaaactcctggattcaagtaatccacctgtctgggcctcccaaaattctgggattacaggcatgagccatcgcgccctgccattttttcttttaaatgttgagttattctaagtttaaagtggctaataggagaaacaataatttggaacattagcagttacagtatttctctagtctcaaaaagagcattctcactagaagtatccacagaaatgcacttaaatgccacatccctccctctcccctttattccagccaccatgtcataacctccctctgcagagcagagaattaagctctaaagactagacatttgttgtggcaaacagtgctgaatttctgcctttattttaacacaactgtctgctacatgtagaaatattagcatatttgcagagatattttcattaggtatttgttttgctttaaaaaacaacccagaaaggtgaatttcaaatgtgcacagtaggtttctgccatcctaaaggcaaacttcaaaattttttaacagctaagcaaaccatgccagtgggttaagatgtaggattggaagtctctgatgctgtcctggggcgtgggggttggggggaatgtatcaatgagtactattttggtcattattcttcaggttgagttctgggaggcattgcttaggacacatttaacgccacaagggaaagtgcattagtgttgccttctgttgtttaaagaaaaggagggagagagggaggaaggaatacatgcatatgatacttttgcatgctctgtgaccaccagcacacaaacaaatgcagagatgctgagaagtgcaaagtgagacgtggaagggcaggtgctaacagacaatgcagctatacttgtgatggtgcttttcacgagtgaagaccaaggtgtaagtgtcttttacccagtcacagctataaaaccgaatccagtggatcaactaaaactaagtgccaaagaggccaatagcagtctagaactacgtgtgagtgtgtgagtgtttcttctggcaggttctcctgttttacggcttcctaccagccatccttaactaacgcatggttggaaattcagtatccccccccaaaaaattgaaccttcatagtttcccaattcctggttttagaaaaggaatgaaggggtatcaattagagatcaagtgcatctttgaggagagaatggcttgctacaatcgaagagaagaaaacctcagctatcaatttgtggaggctttgagcagtcactgagcagatggggttgatgggggtacctaactcatgcacggccaaatgcccaagcctaacaaaaacggagaaaaaccaaggattaacatatcactttttagctaagatgtaaaactggttactggcaagcttattccagcaggctcagcaagcgtccagcacaaccacaagcagcttgatcaaaaacagacctctgcctctcggtggatagcttttgcttttaatattttatgttcacctctttggctcaagatttccacttctggcttttatccttgggaactgataagacacttgcacagtgtgtgcttatagatgctcatggtagtgttattcataacagtgaaaaacaaaatcacctgaatgtttaggaattgggggttgattaaatccatcatagtgtgaatgtatgatgaaatatcatacagtaagatgtgacactgatttatatttaatgacatggaaaaatgtttaacataaactgttagattttttaaaaagctacctatcagcctctctctctttttttctctctcatctttcttgaatgaaatccaccaaaatgttaatgtgtatatacttctttctacttaactaccttttctaattttttacagcaagtatggttttacctacttaaaagaacacgtgacctaaacaatagaaaattagtaacaaattactagaatactattttaccataaactgcacatttcgatttttaaagtgaggttataaccaaaaagatcactgaacatcaataaataaaattggctgggcgctgtggctcacacctctaatcccagcacttggggaggccgacgtgggcggatcaccttaggtcaggagttcgagaccagcctgaccacatggagaaaccccgtctctactaaaaatacaaaaaaattagccaggcatgttggcgcatgcctgtaatcccagctactcgggaggctgaggcaggagaatcacttaaacctgggaggcagaggttgcagtgagccaagattgtgccattgcactccagcctgggcaacaagagtgaaactccgtctcaaaaacaaaaaaagaaaataaaatttatcttaacgtgggtaagaggggttgctgcttgggaaatatctactggaagtaatgaggagtcagggtgaagttcggaggtacctaaagagacagtcctgccgatttggacttggcagtcgagaaaaagacatggttacaccttctgcctcctctgtgtgtttaatagatgaacaaataccagctgctggggaatcttatgacattatagtgaggcataaaaatcagccctcttgcaaataatgttatactatttgaacttcatgacaaaaatgagtgcagaatcccagtcatgttagctccctactaccaaagagtggacttcaaaatttgacccacatcatcacagaatagcagacagggtacctcacacaatgacctgatcctgtttttactaaattaaaatgatgggatcttgcagactctgaataaatgtgtttttgtttatctctgatttgttctcagtcgtacagacttggccatgaattcttataggagacttaccactttgtacagggctggcagaggtttgcataatttagatgcttcttgtattcctattttacgttcctttccaactatggtattggaactaaccaagtctgtaattagcataaacattatttggtgctaaaaaaatggtatcacattttaatagaggatagatcagtggttgtcaggagttaggggaggggagggcatgactataaagagggtggcatgggggagcttctttgtggagattgggaagttccgtatcatgaatatgaatgtgataaaatttcacggaactacacacacataccctcctatacaataagcacatgtgaaatccttatacagtctgttcatagcattgggccagtgtccatttctgggttttgatcatgtgctatggttatgtataatgctgttatttgagtaagctggtgaaaggtccatgggaactctctgtgctatttttacagcttgtgagtctaaaattatttcaaaataaatgttttaaataacatttttttaaaacgtgagctattcctcaaaagattactattctcagagttaccataaagctagttaaagtagtcagtacccccaattgaatgggcaaagaaatacaatatttgaatgactttttccttagaggaatcagtatgacaataggaaaaagaaaaataatgatttatccttgaaacaaaaactggaacaaaaacatgatttaagtatatgtgtaagtatgtacttaaatactaagtagataggctagagaaagacatacaggaatatctgtggaatattgtattattgccccccactaattgttcccttacctctctgatgatcataggtcctacccattgctatgtgacttgtagcccctccctggatgcagagcatccccaacctagggtcagtcttggccaaagggagtgaagtttagctgcttcaagaagcattgacagactgtcgttcagtttcacctcttgcttttcctttcctctgccatgagaatggcatgtcccaaatagcagctgttccttcatctctaggtcctggaataagtagacaggtgctccttctctgaagctcctgatatataacatgagtgagaaataaacctaggccaatgagattttgaggttgtttggtactgctttgttgctgagctaaaattacatctacaaggtggacggtttcattgggcatcaccaacttgaaactactttcagttgaactcaaacctacaagctttcaaagtttgaagtcctaacccatcctgtggctctttaccaaataatataaaatggcagtagatactaagctttctgagggccattgtagattgtgttattatttaaaatatttgctgtccccttctggggaggttattacacccggccctgttgacttccagattggccatgtgccttgctttggccagtgacatgcaaacagaaatgatgacaccatttccaagcaggagatatatgagccgttgagtactctgccatttctttttttcctctgctgtgagattgcatatgtcctagatagtgactgctaaagtccctaagtgaaaagtgagataaatttttgttgtggaaagccactgaaagttagaagtgatttgttagcagtataatctagtctcttcattccaagttagataggacctgagcctcacctggagtcttcacatggtgggcacaccacctggcacatagtaggtgtacggtaaataattttttttaggcaaaatgaagaaattgataggtacctaggaaataaccttatttataaatgagttatgtttagggtttgtgatttgaatacttacacattttaaacatcttatttttattactgttactttagagacagggtctcactatgttgcccaggctgaagtgcagtggctattcacaggcatgatcatggcgcattacagcctcgaacacctgggcttaagcaatcctcctgcctcagcctcccaaatagctgggaccacaagcatgcgccactgcacctagcttatctttttttaatatcagaattccatattaaaccatcagaggtttttgaaatttaaaagttgtgcagggtgactataatcaataataactacacattttaaaataacttaaggagcataattggattgtaactcaatggataaatgtctgaggggatggatactccattctccatgatgtgcttatttcacattgcatgcctgtatcaaaacatgacatgtaccccgtaaatatatacacctatgtactcacaaaagttaaaaataaatttgtttaaagttgattgatgatggagcaaaaactggacataaaacaatgtcttgagatgttaatgaataagatatattatgaaataggaagatggtcttaataatagcttttcattaagagttgtattggtggcttgtggtgttaaatatcttcatagtgccttcatatagacaccttcttctgcagattggtagagaaactgccaacaaagcccctgtgtagtgagatgaggtggttgcgccccagttcctccagcatgctaggcttttcccccaatggtgtctcatgaagcagccggaatatagccagtgtattcagctggacttcgtggtaatttgggttacatagataatgtatggatttattttttaacttaaatcttttcagataatgttaaaagtctcattttactttcatgtctgaacctaatctgtccccacactttcccagagtcatttacttatttatcaatctagaaaaaaactgtcttactgttcagaggagggggctttttgttttttgtttgtttgttttttgttttttgagacggggtcttgctctgttacccaggctggagtgcagtggcatggtcagggcttactgcaaacttgacctcctgggctcaagcagtcctcccacctcagcctcctgagtagctgggactaaaggcataggccaccacccccagctaattttttttttttaagtagagatgaggtctcgttatgttgccccagctagtcttgaactcctgagctcaaacgatcctcccaaagtgcttgtttctgttttttacataaaagtcattatattttatgtcttgtgttgtggcttgctgttttcattagacaatatatcttagagatctgtccatgattttacagaaagatctagctcatttgatttaactgccatggagtattccatagtataaatatattacagtttatttagccattgccttgctgatacagatctatctagaatttttaaaataatttattgcttcccattgaatgattacagcatcttgcatagctgggcaaaggactcataagaaacctactagcaaaacctggtttgacaggttcatccaactgtatagatgagtgttattcaccagaataaactgaagtgttacattgcagatcagaaattaatgagcatcaccaaaaacggaatttctttcgttctttcttagaaaaggaaacatccaacaagatcagtatggtcagaggccaagtgcgatcctaagcccaaatggagagtgggccaggcagacccagccgcctgagaaggggcatggcagctttactgagtacatgatacacaatgtaataattacagtggtccccaagttacatgcaaccaccctgatcatatgacttggttttggtaatcctctcatgttaaccaaaaaaattttaaataggtctttttttatatcatagggttaaaaaaaaaactgcttcctacttccctaaatttcttaagaaatttaagatcgcagtaatgttgctagatttgcccttgaagcagtgttttgggtgtttctcatatagtcagcatgtgggtgacatttagacccaagcttggcttacaagcatgattcatgagaacacatcagatggtgacagcagagaatttcccttggtacttagaggggagcagcttcaaggaggcatactgctctgactgctggaggaagttgcaccgcagagcttctgttggttaaaaacagtcttttccagaaaccctgaacccccagccctcaatgacagatagtttggtccttcaagagaaacctatggggcattttggaggcattcaaatatgggtggaaaattcaagccaggatgacctctaaccaaaaccctgccattattttactcattgcattaaaagcacatgtgcagtgatgtcagttcaaatatgaacatccccatcaaaaaacatcattggttgcctgcctcctggtgtgaagggagcgttaactcctctagagatttcacactgcacatagctagattagtctccagcctcaactactgcctttgcagacttacctagaatatgacttccaggtggctgtagacacaagaatgcatctaggaaatgtgatgcccggtcagcatccgaattctgcacagtgtagatccatgtgtttattttaacatattgcaaatgatagcggtaatgatgatggtgataaagagaaactttggaaaatcttggtagaaatgttgagaaatgtttccaaggaagactaattaagttgctacattataaaactaagaaatgagaaacaggccagcggatgctttcaatagaatttgaatttttcacttgtcatttttttcctaagaggtttagatttagatttgtaggttagactttattcatgcctatgaaaagtgattagctcaaagccttcatttttttctcccaaccacatatatgacagaagtgtctgagctgtatttttccctctttcgttataatataatgtcaggcttgtgacatatgacagcaggtttcacactccacttaatgacaggctgccagttcctggagaactaaaaaggaagactaatatgtatttgactaaaaaggaaaatgttattaacttggtaatagtgaagacttggtgtgcaccagatatttctttgtggccctaagtctagccagacttgctgtaacttatctgtgggatgactttatctacagccctttggtgcacagtgataaaagtgtgctttgttaaggatttagtagttgctttcatacacatttaatgaaggtctaccatgtaggagataaaatgatttcagaggatacaaagacagacttctgcattcaggtagttttgcagttcaagaggaacctattaatgtcactttcctctttttaccttggtttccaggaagctcagagataaagttaatacttaatcctcagttcggcagcatcctttaggacctctctttcctccctgttagactgtcatgtcagtcctctgtgtgtgggaggtgagagataaatgatgaaaaattaaaggggaggtagacagaatcataattatcataagtggcagaatatgttaagtggcatgcaaaagacagaaataaaatgctctggaaggtcagatgaaggagagaaattgtaactggtattgacatctggagagacttcctggaggaggaaggagactttgataatgacttttcaggtgtttcagcaggtggagtcctggcaggtggaggcagcagccgaaatgaagacacagatgagagacaccaaggtgcctgccatctgggactcaccgaagagaaagatcagatgtccaggtttatagatgtaggaaaggatcctgaggctgctctgatcatttccatgatgaatttgatgaatttgatgaatttggtagctatcaggagacctactcttgggccagtgggggcagcttgtgccctggtattgtggtgttcaccttatctgtccatccaggtcacaggcatcacctggaagccgcaagccttacccacctttcaatccctcatggcccaggctggcgccacattttgcctgagctctcattctgcctgtgccttgagatgattttgttttgaaaaacgggtcagaaaggtttggaaacagcagtgtgtttcctttacttagagaaaagcgtcctaattctgcttttcagataaatctttagactcatcctcccacgactccttaacatgagatcagcgggttatatatttaatgaagaagtaaaagatgttcctttggtgctgttctacttgagttaatgtatttcaccagccaatactactgtattccctattcagtaaacagtatatttaatacatatgtagtacagtaaatgctcttgcattggaattatgcatgtaaaatctgatgaaaccctaaactctgtagtttagttaatggtattgtagcattgtcctgggtctgcaaatgtgccgtggttatgtaagatgttatcactggggaagctggatgaagggtatgaaggaacagtctgtactatttttgcaaattcttgtgagtcttaaattatttcaaattaaatagctttaaaaaaaaaagaattaaagagatgatctagtccggttgttttcaactttaattttagcagtggtctccctcttctgccttctcctgcctccatcctcagcatccttaggcaccacctgacgttttaaaaatgctgatcccacccaatacatttaggctccagatgaggaaatcagggcccacagaagtaaaatgcatcactatttagaggctattgatagaaacacagtgagcctggggagtttttaggacgagttgctctctgcagatcttcatgactcacagctctgtcgctaacactgtggtttcttttgtcagactaggtgagattaattagactggaaaagagtttccatgctcctgcatcccattgctgcagtgcaagaaatggcatcatccatataattgagacagtgcaagaggtggtttgggttagcagacagtttaacaaaacaccactcagggcatttgccaagaggactggcttgaaagtccaggcatggggtgcagaagtcgggaatgcgggacctaggaggaagtcccttgacttctgccagcttggccttcactctgaccacctatgaagcctgagggtgattagcccagaggatagggagtcctgtttcctccccatccaggcccaagtcactaaagtattttggggaaaccctgggcaccttgaagtttgctcctaaggataatgtaataataattgcttatatttgtctaaggattttcaggttgcaaagtctttctcttatattccctaagctgggtgtcaccccttgcccatgacacgggcagattggttttatttctgctttataaataaatgacgtgacttttccaaggtaagagcttgtgccgggactggggtcagaacacaggtctccacagtcctgctaagtgctcttctcataggagactctcttgttctaaacaaagatcctggttattgtgaagcacctgtgcacaattgctgatcaacaaacagctggtgctattattattactgtcgttgtaattcataggcaggatctttggccacatgtaattttggggtgtgacaactccaagacttgctggttctccagacttaggcaggaggtggaagcgatggtttcctctcttcctacacctccaaacggtgagaacctgaaggtgccatatggctgttgcgtgagtaagccttaggttttcctgaaaagtgagttgcctgtgtgccacatcaatggagatctatgtgacaaccaactggtatgacaaccaccctggggctgcctggcatgcacatactcctgagggctccgtgcgagctgccattctttattaatttagtgccatttgttgatgcctcgtttctgcagggaaaactggttccttcatttcccctggcatattctgcgccctccgcactgtaggacgcaacctttcctgtcaacacaggtatttttaattggtgctggcaccaacctactccctgaacattcttcctgatgtcctgggatcctggcaaaagtggtgggcttccctaatggtggaagtctaaggccatacttcagaccgtggacccaactactgctttctagaagaaataacctgtcaaggaagatgttgatgtctcacaccctgagagaaacatttaggaggtaaaccactgacctgcctcgaggatatcattaatcatctacacatagaggtgctaggtactcacctcgcaccagtgacacacttactaaatatttgttgaatgacctcctagagcagtggttttccagtctttagtgtgtccgccaacacaaggatcactggcaggatctgctcaaacacagactgtgaggccccacccccagagtttctgactcggttggtctgggaaaggactaagtactatgcctttctaacaagttccaagtgatgtgatgctgtgcgggaaccatgctctgaaaacccttgtcctaaagcagggcttggcaaacttttcctaaaaggacccaaatagtaaatattttagattttgtggcccacacagtctctgtcataattactcaactctgccattatagccaaagaaaatatgtaaataaaggagcatgtctgttttccaataaaattttatttacaaaaataggtggtggacttgtttctaaaatatatatatatatatgtgtgtgtgtgtgtgtgtatatatatatatatatgttgcaaatataaaaatgcgttgtaaatatattgagagccagatcctcattctgggtagatctccaaaagctcttgtgatgggaatccaacgttggtcacatcgtaggtctgtgctctctgaagcagcacaaatacaaaacttggagtgaaacagagatgagcgttgttcctgtgcaaggatcacgtgcaaatatgtgaactgtttcatataaaaaaaaatctgaggtctgatgttcatcaaccatgtgatttggggaaggtcattaacatctctgtaaaacgaggataattaggcagtaaaaactaggggaaaatgctcatttttataagttctgggtggtgcagacacgaggggtttactattctttatacttctctgtatgattgaactatttcagaattctcaaatctgtgtctttaaaaagtagtcataggccaaatgctttgggaggccaaggcaggtggatcacgaggtcaggagatcaagaccatcctggctaacaaagtgaaaccccgtctccactaaaaataccaaaaattagccaggcgtggtagtgggtgcctgtagtcccagctactcggggggctgaggcaggagaatggcatgaacctgggaggcagagcttgcagtgagcagagatcgtgccactgcactctagcctgggcaacagagcaagactgtctaaaaaaaaaaaagtcataacaagcctttggcatatatgtggcttagggtttaggttccatagtcaaccaaaagatgaattatcttacagtcagaatcacctttggaattccccgaaatcaccagcaccaaggccctcagaaagtcagcagccaagaatattctgctttatgtcactttgcattggagaaaccctgagagaaaggttaattcaagcttattatgtctacagtagatctctggatctcctgcccttccccaaaccctgatcttctaaagtcttgcttaattcagtggatggccactctgcctttgcagctgctcaggccacaaggagtgattcaagaggaagaacttaataggaatgagtcctgataggtacatgttgaatatgaaattgttttatagttccaatagaacagtagagtctatggccataccaccctgaacatgcctgatggaaagctaagcagggtcgggtccggttagtacttggatgggagacaaatagatcatctaagtagaagctcagagctctactattatttatttatttattttttgagatggaggctcgctctgtcgcccaggctggcgtgcagtggcataatctcagctcactgcaacctccacctcctggactcaagcgattctcctgcctcagcctctcaagtagctgggattacaggcacacgccaccatgcctgggtaatttttgtatttttaatagagacagggtatcaccatgttggccaggctggtctcaaactcctgatctcaggtgatctgactgcctcagcctcccaaagtgctgagattacaggtgtgtgccactgtgcctggcctacctttatatattaataaacagaggaggctgggcgcggtggcgcatgcctgtaatcccagcactttgggaggccgaagcaagtagatcacctgatgtcaggagtttgagaccagcctgaataacatggtgaaaccccatctctactaaaaattaaaaaaaattaggtgtggtggcaggcacttgtaatcccagctacttgggaggctgagacaggagaatcgcttgaacctgggaggcagaggttgcagtgagccgagctcgtgccactgcactccagcttgggtgacagagtgagactctgtctcaaaaaataataataataaaattgaataaataaataagcagaggccccagaagcagaggcgcttatctgcactacctgcgtggtacctacctaccctgtgatacggcactcttctaagcattttacaaagactgactcgttttgtccttatttatagtaaccacagaagacagatgctgttaatttcccagcttatagatgaggcagaaaggataagtaattcgtccaaggccatgcctctgggtagtagcagagctggaacctgaacccaggcagtgactccagaatctacgctctttaaccacgatggtcttctgtatatcatttttcttccctatccataatctgtgagttgagggacaaaagcttaaaaatctaaagaaaaaagatgtctggttgcacctttggtgctctatgtggtatgctagagaaggtaatgaaattgcagtgggctatggggaggcgtaatttcagtgcctttacgattttcatctgaccatgctgagtttccctataaaaagcataaaatactttggagatggtgcagaagcaggaaaatgtacctgtcagtttggatgtagatctggtttcgcagtgtattgtatttctggatactctgtccaagaggagatctcctgaatgatccatttagggttgttccgttcacttcacaaacacaccgattttgtgtctactcgtgccccagcctgcgctaggcagtggggagacagagaagccaagttgtttaaaacactgtgcttgtccccaagggctttggtgaccatagctccagaagtaatagctttggtggaaaccgtggtatgtgcaaatttcaccccataaatagaggaaacataggtattcattatattaaaacatgatgcgggccaggtgtggtggttcacgcctgtaatcccagcactttgggaggccaaggctggtgcatcacctgaggtcaggagttcgagaccagcctggccaacatggtgaaaccccatctctactaaaaatacaaaaatacccacatcgtggtggatgcctgtaatcccagttactcaggaggctgaggcaggacaatcgtttgaacccaggaggcggaggttgcagtgagctgagatcgcgccactgcactccagcctgggcgacgagcaagactctgtctcaaaaaacaacagtaaatatctaaaatatttagtggcgaagtcaccaccacccattgtgtgactccagagaatgatgcacagtctggtgttatcgaaccttgacttggggctggggagtggtggggcctgagcttggcttaatctaaaaacgtggtcctttcatgactaaaatgagcattgtgcttcttctcctcccaggaccccaggagcaagcacaagttcaaaatccacacttacggaagccccaccttctgcgatcactgtgggtcactgctctatggacttatccatcaagggatgaaatgtgacagtaagtaagttttcttttccagttcatagcgaggctctgtagctcatgctcagggtttgctgagcaaggaaggctcagtaacttttcaacaccaactcttcagtagagggaattagttcagatatctaccagactgacaaagtgtagattcttccactgtcaaagttccaggttattgaactacttgattgcctcattatgaacccccaaaaagcactcgatttataaatgaggttggtgggtgctgtcactttttttttttttttagtggcagaagtcttcaatcactgtaaaatatagcctagtcaaaccccaaagaagacttccaccgccaggtccacatttggttatagcttcaaaataagccaagaaaccctactcattatcttcctgtgtctctaattagtgggtggactgtggaaaaatccagtaggctcttcttaaaactgaaaccaaaatgaacataaaaaccagaatagcatcttattgaagttcactgacccagcatgtttatggacggatcaaatgtgtattagcctggctcaaaacgctgaggaccactgacaagcaagacaccagcccttttctgttattttttgttacgtgtgtatctccatcaactaccaggaggaaagaaaagcaactatgaagactctttgctttgatcattttttttttttggagacggagtctcactctgtcacccaggctagagtgcagtggcgcgatgtcggctcactgcaagctccacctcccgagttcacaccattctcttgcctcagcctcccgagtagctgggactacaggcccccaccaccacacccagctaattttttgtatttttagtagagatggggtttcactgtgttagccaggatagtctcgatctcctgacctcgtgatccgcccgcctcggcctcccaaaatgctgggattataggggtgagtcaccgcgcccaacctgctttgatcgttcttaaagtatgagattcctcaggctatgtttgtttaaatacaagctgatacctttaggacatgaaaagttaattgccgagcctgtttttctaatagatcgggaaccactgtggaaatatcagcctattgccatttgctaatgactattttcatttgctatgatggccagaagctgatatttgtatcttacatggagcaaactgtagaaaaagaaacataaacgagcatcatagagtagatggagtttctcaggacacagggattcttcaccttacagagttgtacggcatcacaaccaaatgcaatgtttgtttacttcaagaaacgctgggatttccaccatttaatcccagcactttgggaggccgaggcgggaggatcacctgaggttaggagttcaagaccagcctgaccaacatagcgaaaccccgtctctactaaaaatgcaaaattagtctggtggtggtggtctcctgtaatcccagctactcaggaggctgaggcaggagaattgcttgaacccaggaggcggcggttgctgtgagccaagattgtgccattgcactccagcctgggcaaacaagagtgaaactcggtctcaaaaaactagaaaaataaaaaaaagaaaccctaggattccaaagacatggttttcaggggttctgcaagggcttacaacttaagtgcatatgtaaatatattttaactactttaaaactgggaacaaaataaatatttgaatgtgttacatactcaaccttcactccttgggcagaacttgcaatcaggtttctcctacagcatcctcttcactgaagagtcagctgggatggggaagcatgccgttagacacggttcctgtttgtactcagttttctgcatgaatgaggatttttggatgctgtactactttaacataatgcaaaaataaatgagatgtggaggctggtctgagacatcaactggtttcaaagttgtgtttgtatcagagggctttattggtgatccttgaatgtctttataataaataagtggtataaatttgtgtttgttagctgagtttatgctaataaaataacactcatatggtttacatcattagattctgctttagactttgtttgcaaaatggtttccttactaaaaatttttgaaaaccgctgacctggaccaatgcttttttgtttggttttgttttaaactctttttcttgggaatcataaggcttctgtggctgccgcctgtgctcctttctggagacaggaggagagcaagccgatgagcaccaggactgcaacccctactgaccttaacttctgcagagaagaagcctcttcctgtgcccttccacctggtgcaattgcaatcctagatagagttccacttgggatggggcaggacgtcagggggcagttagcaacaacaacttgagtgggccaacctctcactttgtagagttggaaatgaaattagagcaaatcagcttcccaagatatacagcagagactgcaacacggcccagtgcactttcacctcccgtcccctccccgttgcctctgtgctttccagaggctctggcatttactgccttcacattgcaaattttgcccggacacttaaagacatgatgtggttaacacaagcaatatacataacacagcttttcaagagcctttatattggctaaattcgaggtgtagaattttgaacagttagccttggaaatagaagcctaatagcatccacatttgtgaattagctaattgttctttcctcagtatgtccatcattctgctgtcagtgtttaatcggagcagtatacattattcatgatgctttttccaatttactttgtcatgttaaaattaaacactcaaaatgaaacggaaaggaagactccaccttgatgattacagaataaccttattagcatcctggcaaggatttgcaaggattccagtggccttccctccttctggaagcctaaaggtacaagggtgatcgagctggaacacccacacacagtcttctgtttgtttccggcacacaggattcttttcagggtttctttggttcattgcaataatactgatctttttttatcctccccctgtctcacccacataatgtcagctgtaaggaatggctgatcatgctaggcgggtatttgttttacttggaatggtatttaaatatttgaagataggtttaaaatatcaaatacaggttctttggggagaaaaacacaggcaatgtacttaaaccttgttgaaaatacaaggttagctgaggaaaggaaaatttaatgaattttctatactcaatccacagattttcactctttctcagtggtaagcccagaatgacataaagaattcattagcaaaaagtcttatgttcaagctgggtgcagtggttcacatccatagtcccagtactttaggaggcctaggtgggaggaccacttgagcccaggagttcaaggctgcagtgagctaggattatgccactgcactctagcctgagagacaaaaggagaccctgtctgaagaaaaaaaaaaaaatcctctgtttaacattttcatattattttgcctctgtgtacataaaatatgaattaggctgagctttgtacatatttacctgtgtgaattttgtatactgttaaatacttgaaacaatcacagaagcccaagctgggatattttgcttcagtgaagactgagcaaatatggtatgagtattttaaggatattgtcactcacatgaagcctgtgctgtacaggacatctgctaacagttctttatgtcaccaaaaacattatagcaaagtatcgagttgggggtaactcattttcacttgtgctcatgcaccaaaacactgaggagcggtggttggagtccatatgcccagctcaccctctcctttcttgattcacagcctgcgatatgaacgttcacaagcaatgcgtcatcaatgtccccagcctctgcggaatggatcacactgagaagagggggcggatttacctaaaggctgaggttgctgatgaaaagctccatgtcacaggtaaggcttgctcatcccggagcagcatcgtgggcaggcatttggatgaaggttacactgatattaaggcagggtgggggctgggctggatgccctgaggcctctggagaggcagtcgccctggtggagccatcactgtctcagagccctccagccctctgagccctcgggttaatacacctcccaggagatgggtctgtacacccaaattcccaaatactcaatgtcacacaaagtcacaagcactgtgtggattgggctattctgacagcatggcccgtgtactctcctcccggtgacagggggtcaggggagccaattaatcaaaatgctgttggagggaatggaactagaacaaggggaggcgaatggatggatgacccaggtgttttgtggcattggcctgtgatggcccaataaatccacctcagcgatagcaacagccgttgagtgcttttgcttcctctgtgttaggtatggtgctaggaacttcacatagattagttatttagacctgacacctagctggttattagcctcgttttccagaaaaggaaactgaggcacagagagatcaataacttgcagtgttacagttagtgaggagctgggataggaatggaggcatttgactccagatactgtgcttataattaccacacctcctacaaacagcctggctatgggaccggaattccctatccaggggcctggttactccctcctcggggctgtttctgggtgggctctgccacaacatggctttttcctgtggttttcccaccaaatccactttcggttcatcggcacactcagtcaagttatcctggagtcttattggcctaggacccatcccgtgtcctcaagatggcttgagttctcggtaccatgacccactccatgttggtgtatggttcagctctcaggcatcagcctatttccttgcacttggggtccctgagggaccaactgtatacattacccttgttgacaagggcattcattttcatttgatcagcaaaggtatcttccttctgtatctaggaatttgaagctatcataaacatggaaagactgatgctaatctattaggtttagataacagaaaacatcatagaagaagggtttaggaggatctgttttaagaaaaaaaggggaaggtggggacttccaaagaaaagcttacctttggaaacatcctcaggtttttcctttgaaagataagcaaatgttctaaccagggctgtcccctcaggtaagaactcagagaagaacaaaggattccaaggtatcactgggagagggtaacagtttgcctctggataaccttgaaaccagctatagctgatggtcaaaatggaactgggaatgaaatccctatcatagatacagaatcccttctgactttttgtagtttttagagaaattcttttattttctcaagaccatccctattgtgccattgcctttggggctgtgattgtcacctgcatttctttttaatgggctgatgctgtccttggaatccctgcccttatctgacagccagggcccctctgactgggcactgatgctctctgcccagaggaagatggtgttcctcgggggccatgagacccctctgcaacatcacagctttgctcttgtttctctttcctactaaggcttccacattgtcaaaaccatgtatggggggagcagattttgcagccgaggggaaaattaccataaaacctagtctccgtaggtggtaagggatcaaggagcataaagtagaatgcctatggctaaacatgtccatgcttttcttaccttttcctttatttccaaagctactgctgttggcagtagaatagacatcacaggtgaatattcagtttaattatgggtttacatgtggctaccttatggctcgctgtaaggcaagaatgcctgaaatgtttagctggcattctttgtgtttctagataaagcaaaacatgtgctatgcatgctggacacgccccgtgccgtcttctgtaataaaagcagcaaccatatggtactgccggaaccttccagtatctcctataaacctcaagagccttgcagatctaaaactgcatagagagcacagatgctctggctggggtggcacaggtacacaggtggaagacaaaggtcaggccttatcgtgctagagcttacatcaggctaattcctctaccattgccaaaagttgaacttgactcacaattgtagagtcagcttaaggaacaagacctttcactgggttggatgtcgactttttgcatgtgaaagccagccagtattgcttatgccaactctctgggctaagtcccttgagaattagtttaaaaatttttgtagagctatagctccactctaggaatgtgaattcagcaagtttaattaataataataataataatgtcttattccattcaggctgctatcacaaaataccttagactgggttatttataaataatgggaattgatgtatcacaattctggaagctgggaagtacaagatcgaggccccagcagattcagtgtctggtgaaggctccgtctctgcttcatagatggcacttctcactgtgtcctcacatggcagaaggagggcaggctgtgtcctcacatggtgcaaggagcgaacttgctccctgtcatctcttttataaggctctgcgtttggttgaaggttatcccgaaaggattacttcccaaaggccctacctcttaatactatcacaccgggaatccaatctgaagatatgaattcagaccacagcaaatagtagcagcagctcacagctattcagtgcttcctccacaggaccgctttctaagtactttatgtactaacttttattcaaatctgtgaagaagttgactttattatccttacgttatagatgaagaaacggagatacaaggaaatgaagtgactcacccagagtcacacagatggtaaattggatggctaaatatttaaatggcacatgcggagagaagatattttgatgacagtttccataagaattggaatctatttttaaagtacagttatgtgtgtgaagggaatccaatgttaagtatggaaagtcaggctcaaggaaataactaattagtaattacatctttaacatttttaatttaaagtaatttaagattttcagaaaagttgcacacacagtacagagttctcgtacacccttcacccagcaacccccgatgttaatgcccttgtataactatagtacctgataaatttatgaaaaataagtgcttacagccaggtgcagtgtctcacacctgtaatcccagcactttgggaggccgaggcgggtggatcgcttgaggtcaggagcttgagaccagcctggccaacatggtaaaaccccatctctactaaaaatacaaaaaattagccaagtatggtggcatgcgcatgtagtcccaggtactcaggaggaggctgaggcaggataatcggttgaacccaggaggtggaggttgcaatgagcccgagattgtgccactgcgttccagcctgggcgacagagcgagagtccatctcaaaaaaaaaaaaaaagaaagaaagaaaaaataggtacccgcattagttactaggaatttttttaaagagccaaatagaagacatcagactcatcttatttcagtataaaaggaccacaagtggtactaagcagagcccccttggggcagtgcttgccaatgatgggtggcacccccatgcccattatctgcctgcaccttctcccaaccaaatagttcaggcatgggtttgtcttgagaaatgttttcataccaatagctaccatttattgagtgcttgctctatatttattgttcataggactggacctttatgctcagcattttatattcattgcttcattgactccccaaccaatcccatgaagtaaatactattattatcctccttcttgaaatgagcaaaggagctgagagaaaggaaggaaatggctccaagttacaaggtggaaagtgatgtagttggggccgcagcccgggcctggcttccacactcttgctttcagtgcataggctatgaatgttccaagtctctcttattaattagagtctcctttggaacaaacaattaacccataaatatttgctgaacccacaatcagcaccccacaaagttttttgaggtcacggaaggtccaaacatgggacttaaaaccaggggagaaaagagtaacacaagaagagaacaaagaacaacccatatccaagtaaaattaaataccaagtacatggtgatgaaatagcacacccttgggaggtactgagggtggggaaggggacagagagggaaggaccctgtggagaagcagccgactgaatactgtaggtatttgagagacagagagggaagagagctccgattgagagagtcagagggctgtgggaattagcctggtggtggctttcatgagaacacaaatataaaccataagccatcacatgcagagtttatggtccagatgcgagtgatttctcagaaaatgcacttaaacctgaaccctgagcagctgtgttaattgctaggttagttcaaactgtgtcttacctatgtagaatcactcaggttgaagataattcccaaagtaacgtagaaactcccgacaggagctctgcttcaggatggaaacctccgtttgcagtcagagatgagttttctttctagcttggtggggtatttatgggaaagccccgagctttggtggtgtatttttattttttgcctttgggcggtggtgctgatattatcagaatggtgtcggggtttttttttcttcttctgataggagattgtaataggttttctacactctagtgtgttttgtaaattcggtttataggagtagtaaaaaaaaaatccctcatgggaaccaattttcaatttaatcttgtaagtaaatggaaaaaatatcgggtgctttagagctgtttcaggagcacgtctctcccacagatagattattctgaagaagagtctaattttctcaacaacttgagtttgttaatttggtgtggagattgaagttttaaactgaactctggtcggggaggggaagacttcctcccagctcttacggcccagagactcctcctgcctacctagggccctgcgcgatttgatgtctgtcacccctgcagatatggagactcaccctcatcttattgtaattaaaacaataatattccctctgtgtgttcttccaccttaccatggtgtatttgttacagaatgaaggaaatgagcctcagctttgtatgataatcgttcattttttttgcttcacccattgatcatacattattgagcgtgtgtcctgctctcttcctggcaccagggatgctaagatgattaagacctagaccgtgtcacagactgtgtggtctttgggggagaattcaggcatgaaaaagaattggcgggtgctgtacctgcagtgggagtttgggagaaggggagcctcagtggccctggggaggcagcaggtgacagcttcacatcggaagtgcagtggagccgggaggacagggaaggaagaagagggcattccaggcaaagatgcagagtgtgttcaggaagctcagcaccatccaggatgtcaggaagttcaagtgagagttggagagagctggagggaagtttgtttctttccattttcaaagtatgagagctgcaatcatcagtttaccagttgcacaatccttaggagccatgcgcacaggctctgagttaaatatttctttttaaaacaggaagattttaagttccaggtagctacgttttcaacaagaacagagcatcagtctcctagcctgaactctacacatcaccctgagattcacagtgagcagagaccttctctatcattgctgggtaaggagacgcagcaggtagcccaacctttgcctaaaagctttgcacaggtaccttttgcagtgacaggcaggctgtggaatataataacttgttggaggctgccagcaaggagatgcaccaagctccttatttaaaggaaaaggcattagttggaagtcatttctgttcaataaatcttggttatgggatttggatccagatcaggaacgtagatggtgatgcagcagatgtatctgctcctttggtttgggatggagagggagagggtgctggcaagaagctgcttatcctcaggggcacccagagtgtccactgttggtgatcctgcatttgaccacctggttcagcgttctcagcagatccctccaactgcaaaggtatttttgttgttgttgttgtttgtaattaataaggaatctggatgtcatacttgatgaacagcaacctcccacctaatggttttaaccttgattattttattttttatttatttgtttatttatttttttgagacacagtctcactctgtcacccagcctggagtgcaatggtgcaatcttggctcattgcaacctccgcctcctggattcaagcgattctcctgcctcagcctctcgagtagttgggattataggtgtgtgccaccatgcccggctaatttttgtttttttggtagagacaaggttccaccatgttagctaggctgatctcgaactcctgacttgaggtgatccacctgccttgacctcccaaagtgttgggattacaggcgtgagccaccgtgcctggccaaccattcttgattaaaagagaatgaggagacatgattaccaaatgcaatctgtaacacttggttggatcctggatccaagaaaaaaacagctgtaaagaacattttggggacagtggggacagttgaatctggactgtattttagagaatgtttttgtaccagtgtgacatttctgggtggtaatggtcatgtgattttggaggggaatgctgaaatattttaggggtcattttttcctaatgtctacaacctacttccaaatggttcaacaaaagcaaaaaaacagacagaaatctgaaaataggaccaggcgggggttggggccaagaagagagcgtgtgtgcaggcaagagcacctgtggcggaataatagtgactctagaaagtgatataggtgttcactgtactgttctttcaacttcactcccaaaaacttgggcaatgatatctatgtctgaagctttgtttcagttgatcgtatttaaatgtactctgtagaggtcattcttggctagaaggaagcccctgctgaagcagccatcagagcgcctcagcagttaagcttccctgcctccaccctcttactctatgaccctcccctgcctctgtccatggccaccaacgcctttccttttgtggatggcagaccaaaggagacaattattctgcctcaacccaacgctgtgtttccttgtggttctgcactgaggctgggcccagaagcctggttcatgaagagcactcacctggcccctggcccctggcccccgttaaacaggtgagtcactgaccatttccttagagccacctgggactggctgcatgggacttgccatgacacagccggccagactgccacaggcaggttctgggaactgtacacttacatggatgggcaggggctgcctgggattgggagccactagtggtctatgtccccaagagcttgtatatgacccccattttccaaatagctcaggcagaaaagaaaatgtgagttaaacagctaaaggagtcatatgtaggtatgtgtacatatgtgtaagaagtaggctggacatggtgactcattcctgtagtcccagctactcaggaagctgaggcaggaggatctcttgagcccaggagtttgagacaagtctgggcaacagggcaagacctcgtctacacaaaaagaaaaaataaccagatgtggtggtgtgcacttgtagtcccagctactcaggaggctgaggcagaaggatcgcttgaacccaggagttcgaggtaacagggatctatgatggcgccactgcatgccagcctaggtgacagagcaaaaccccatctccaaaaaaatagtagttgtgggcacagtattggcaaagctgttgcttattgtataaataaacatcaaggagttggggaatggctgagtgggccgtttgcattctgcatctcccctccccttggataccactctcctcgatctgggggttccatgcctactttaaagacaccagcttctatttcctgcaagtttccagctcttaaaaaaaaaaaaaaaaaacaaaaccaacaagctttatgatgctcacatatgagaaactacttcctttagtttgtctttaaatactggtagagaaaagtccataataagaggggtaactgctcttcatgacaaagcacactttatctccatggctttgtagaagtttcatgaatccactaacatcagctaattctgaaagtgataggcattgttgcattaattttccctggggagaggcacagcaagactgggtcctctcttttgtagatggagaagtaagaatgagtggggcgttcagtgttcttgcagagaggattggtgggtccgtttagctaggaagtggtcgcaccatctagccaggggacccttattatccaatgatctctatgtgcctggcatcttgcaaatggaaatgctaacaagatccagccagtcacagcagtagcagctgcctagaaaggggacatgaagggcaaaccagagaagctccgggtgtttcttgaatgcttagatcctgtgagaagagaaaccgacactgattgaacacttttcgtgtaccaggccccaactggatgctttcctatgtatttcatcccaaccaccttttgggaaaaatgctatcatcatcaccagcagcagcagcagcatcattacccttttgtaagtgaggaaactgaggcttgtagagctcccgcagcctgcccagctgcctctagcacacacgcatgcccttcccactattgtaagcagctgaccgttggctctggctgagggaagatcctgtgattactcacagctgtttcccttgagtacagacacagcctacactgttgcttcaagtgcttgcaatttcacatttctatcctgcaattaattgtggaggctactctgggatggctccgcagctcctgtgattactgttctgttggcaccactgggggtgagggtctgtcctcacttccgcagaccctgcattttccagggtttccataatggctggaaataaaaatggcagcagggaatctgggtgaagtcttctgtgctggaaaatgaagaattaaaatgggcagaaggatggaaacaagccgctacaggacgtgttttgacagcatgtgagttgcgtgggcatgtgactggaccagccctttcttggcatccgtctggctttttcttagtggccccagttcttccccattggagactcatcctgctctcacgttctcacagtcttcaaagaaaccaaatctagcagtcacctgccttgagttcactggtgcttaacatccaggcacatccttggcacaagaaaacaggaaagtgcgtcttagctaaaacatacagcggtgtgcttgtaccagaagaaagcctgcacattatcccattcaaatgcgtatgcttttgggtcatgactggcatgtgttcagtggatttatctactctatcttcttccttgattgggcattcctaaacatcagtgtcttatgtccacatgaccccttctgtaggcagtactttgcccatctccccatatttaccccttatgtcccctacacgtttgcactcagatttccaagccatgagcagcttccccactgtggcaggcaacagcccaccagtgtttcttccctcctcacttttgcttgtgccattttccctgctccccagagaacgtctttttaacattcagctgcagttacctttaggaagcctctcctcacattttatgccatgcctgaaaccaaccactttctctccatgccctttataacatgtattatgagatttcacctgtgtgtttatttacatgttgatctccttccactatgtcataagtcctttgaggtcagagatagtgtcttatctcctgtacccagcccagtgcctcaaatttgtaccaaatgtgtgtctgttgagccgatgatgatgatgatggaagtacacaatacagcatagaaactgactcaggcttttactgcactcctcaccccaaatccaggtgactctccccattttagccctacatctggatcaagttaaaatgatcctgttttaacccaattcataaagccacatggctctgggatcctttagagaaacatctatcagctaagaaaaaggttgcatcttctcagagacacatgattatttacattccgactgtggtacctcgtcctgactgatctgtggctcatcttaatgtcagatatgtacagacttgcagcatgccatcccacagattgttattcatgcttggttctctgtgcggggactccaacagagcttttcactctgggtgcttagtcactagatgtgcgtgggaggcagcaagattggaacaaggggcaaagagttgccagtgtcatttccttcatgcagcatttgtctttgttgtaaagcaccctggtatccatgctcatggtgacatagtttctctttctcctgcttaagataccccaagtccccagattctttatagggtcatcagtcatctgtcgtctttgacttcagtgactgctgccaggaggaagcactcttaaagataggctttgaatgcttacatccctggaagaggagaagcaaattatttctggggcctctttcaagattaccccattagcatacagagacattgatattgactgagcaggtcattcttgtgcaggattttaattgcttctaattataggattatcatttaagcacaagattaattgctgtgaaattattgcaaggaactttatcttctggaaagtaaatgtgttagccaagtgagaaatctcttagaagcttgcaaatgatgtcttttcaatcactttccattgaaactttcttctaatgcttggggaatgagagagagatcttgggggatcaggagggaagacgaaataaataacagataaatgctccttttgtttcccggttctccatcaaaagggtggaaaacttgaagtgtttgggaatggttatgttcaccaatggaaatgtcctaaaataaatgcagaaatttttttcctctcttgatccatgtcatcttcaacggtgggtgggtaggaatggctcagtaggaagctagaataggcaggtgctgtcctatggtccttttcaacaccaagctgctctgatatcttagcaaaaaatatgtatatatatattttcagatgtgttgtaaaggaatctcccattaacatgtatacacctgctctgattattggcatcaaaatggtacagagaaacatcagactatgtgcatcttagcttgtaggcgtttccaattggaaagattcagatttcctgagaaaatatgagataagttagctcctgagcttgttctaaaatatccccatttgaatagggggccatggccacccactggaagctctgcacagagcatccccatgagggactttttatactgagaatggtagctgcctttacatgcattttcctttttaattaatgcaaggtttgtggttaattaaagatagtcagggtcccttttcaaaccaaagcaggcactttttcctagaataaagaagagagaatagaagcaaggcaaacttcctataaaagtttttgcagtgggggtggtgaatttggggaatgtggcctgaaggaagtgttgtttcatcaacttcgactcacttgaggtagggaatgtaatcaaaagagacaccttcctcactgaacacccagcagggacatggctctttttctgggaaatgccgcactgacctccctttctctttgttaagtcactcagctgggagtgggggtacagtgcaggagagacacatttctctgggatatattgctgctgtcatcttatggcccgcacaggtggaagaactctcgtggaagaactctcacaggtgaacatctgcccaaaagagcaagtgtatgtgcagtgaatgttagaaatagcaccagagccctccttactctttactaatacccaacctctctgaaagaccctgaagtctgtttcaatccctcccaccccaatatggcagggactctgttatccttaaaacttctggcttctgaaggatgctagtatatatttgaaaaacaaaaaaatcccagcatactttacatgaccaacactccataaagaaagaatacagcaggcttgtgtttataaaataatagaagtgacttgcatttagaggatactatggtgcattagtctattctcattctgctatgaagaaatacccgagactggtaatttctagaggaaagaggtttaattgactcacagttctgcagggctggggaggcctcaggaaacttacgatcatggcagaagaagaagcaaacacatccttcttcacgtggcggcaggaaggagaagaagaatgagagcccagtaaaggggaaagccccttataaaaccatcagatctcagccgggcacagtggctcatgcctgtaatcccagcactttgggaggtcaaggtgggcagatcacctgaggtcaagagttcaagaccagcctggccaacatggtgaaaccccctctctactaaaaatacaagaaattagctgggcatggtggcagacacctgtaatcccagctacttgggaggctgaggcagaggcaggagaattgcttgaacccaggaggcagaggttgcagtgagctgagatggcgccattgcactccagcctggacaacaagagcaaaactctgtcttcaaaaacaacaacaacaacaacaacaacaacaacaacagatctcattatcttcacctcgtccttcctacaacctgtggggattatgagaactacaattcaaggtgagatttgggtggggacacagccaaaccatatcatatggcgttgactttgaagtcaggtagactggatttgaatcccaactatagcactaattaatgttgaatacgtattaggggttgttactctattaatggagttttactccagtcacgttaagtcatgtagctcaatggactgaagcatgtcactttattgacaaattaactctttcagtcctgactctttcatggtgtagctataaccacagtgggactccagcagccccaaccaagaaaatctaaccccagacctcatttgttttttcttcactatgcccaccaagcaagacacaggaacacactgtgaaatcactttcaaaattggaaggcctctgtatgagtagaacagttgcatattaagctgaggatattaaccttaaagattttaactggctgtgaaccttgacctcatggcttaacctctctttgtttccctctcctctgcaaattcagattaaggcacttgaactacatgaaccctgacgttcccttcagctctggcattttgttgagagctgtttcagagagagctaatcggtggtgccaataagtgtgccccttcgtgaggaactgatggtagattggagactctagggactctgcaaatggatgaggcctgagaggctgctggtccggtgattttcaaacaagttggaacatcacatcttgtttgagatgatattcaaatgatatttcaccagagttactctgattgaagggaagaaaatagggtactcaccttcttcctcctcctccaccagccatgaggagactctgtggagcagagtttgaaagtcaaggatgtaggctgggtgtagggcctcacacctgtgtcccagtactttgagaggcggaagcagaagatcccttgaggccagaagttcaagaccatcctgggcaacagaacaagaccttgtctctataaagagtaaaaataaatataatttaaaaattaaaaataaaaattagccgggcatggtggcacacatgctgcactttggtcccaactactcaggaggctgatgtgggaggattacctgagcccaggagtttgaggctgcagtgagccaagattgcactccagcctgggtagcagagtgagactccgtcacaaaaaaaagaagtcactaatgtgattgttatcacactgtgctggggtccgtgcaccccatgcagcaaagccaaatgctgatgttgggttaacagcaggagaaactgaggcgtttattgccaagcaaggagaattgagcagctcgtgctgatgacttgaactggcagatagcttacagctatccattatttaaaggcgggaaggtggaggttacagtcgaagtcattcagtacctgggggccacatgttggtttgacccaaacaggtaggacatcccaaagctggggaggcggtgtgccacagtcatggctggattcaaagatcttctgatttgtgattagttaaggaggcgaagctttgtctaagaattagggatcaacaaaaaaaaaaacaatgttagctctggcttttgggtacaaaagcatcgaagggagatggaagaatgtagaacaaagaacagcagtcagagtgctgtcttctgctccccccatccaagggctgtgtgccagtgggtccgtttggtgggggtccagttttctgaaacaactcaagggcatgtgtttagatgttatctttaatttctacagaaagcaaaacatctcctaacttccttgctgttgttttaacttactgataccttcttccttgtcaagttgctcatttaattctcaaggctacctaggtgcctggaattttccttgaaggaactcaagattttcctttatttccatgttagggggtgctcctgcccggggaccctctgaaaattctgtcccatggtccatccccttcattttcatgcataaaaaccacggctcagggaatatggctactatgtagggtctttggggttataaaggataaaaccggccgggcgcgatggctcacgcctgtaatcccagcactttgggaagccgaggcgggcggatcacgaggtcaggagatcaagaccatcctggctaacacggtgaaaacctgtctctactaaaaaatatatatatataataacaatacaaaaaattagccgggtgtggtggcgggcgcctgtagtcccagctactcgggaggctgaggcagaagaatggcatgaacccgggaggcagaacttgcagtgagccgagatcgcaccactgcactccagcctgggcaacagagcaagacgctgtcttaaaaataaattaattaattaattaattaaaggataaaaccaacccactcaggtagaagggggaattagcaaaagaaatctagagtatcgtgaaacgcaagggtgggaatgccttggagccataagaatactgagaacccaagattctctttctgtatctcacctcttctttctccatactgccttcatttgtttcttttccacaacacgttagactttctttgcattgcagaaaacatggccctagacgattctacagcttcgcctcttgcagctgcatgtcttctactgtgtcagtcacaaatccaaaaattctgggaaagggattcatcgactcagtgtgggtcacatgccaccctggaccaatggactgtgactggagggcagatatggggtggggtgggaggtgggagacattttcaggaacaaggaatagtgagaagcagacaaaactgtaggtaatgcaacactgccatgaaacgtgagccagggttgtgcaggaagtgtgttcaggaggaggatgcagccaggctcctgccttctacttcgatgctcctttccttcaaccaccttgcacatccgtgaaattactcaagagggacagtggctgagcttatgtccaaaagttggatatgactcatcagttccttttgaacacgtcaacctgctcctggcctggctggtctccaaaaacagccaagggtaaagaaaaaaacttgattgagtgacatttgtccaattcagccacccagtgcattaatcaccctttttatttagaagctgtaaaacagcacaacaggttccaggcgtaaatggtgttgatgtggaagagattgagtgatggtggtacccgcaggaagcaagtcctttgaatgggctcacggggagattgtggaacaagtggctcaggaaggtggagctgtttgatcagggcctaggaactagacaaggccctccagaatgcattttgagccattggccttaaacaaccttcccctgcggcagctttttctgcaggccacgttgctgccttggcagaccctcaccccttacccctggagcttttctttcacgaggaattcctactgcgagaataaacaaaggtagttggcagcatgctaacaatgcctccaggttcttagcctctgtcctgagaagagccagccaggcaacctggctttcattcagcaagggaagagaaaagcaaggtaccttttatccctgaatcatcgccacaaggccctctcaggtcaggaaactgatgtgtctcctgcttggtttgtaaaccatgtggatgatacccagaatatcaggtcctctctctctcttccgtccaaacgaaagcacttagatgtcacatgcccaccttgtaagtcctcatgggatttgggatcctcatcctgtgcacagaccttgactcatgggctctacaacattggctgtcttcctgtttaatttccctttctactgacagttttgccaattcagtgatggctttagcgccatggctcagcggcacccaagcagcttgagacatccgtggtttgggggtcatcttagttatttcatggaatgaaaagttttacatccaagatactcggcccccagtcatttcttttctgtatcaatttagtctctctttagttttggtgcatgtggttgacttgtggtagtctaaggtgttgacggactggcccagagagagatctcaaagctagtgagaatgtgtccaggttcttgtttgattttgttttggtttgattttgattgtggtcgagataagaggcttttccaggtgaaaatctcgtaggcctggcatcatacctgtaattaatgtttatcttctgctttatactctcagattaaagacagcaatggtataacagcaaggctggaaagaataaagtttactcctgttttatctctctctccaaacaccgtagtgttccagagacagatactgatagtctcttgtgctcatgaactcctagtagctcctgataagtacatttctcagagaatcagctctgagcccatttgtggggaacaagtgtatgggaaagtcgtcgattctgcaggtgttgggaacagttctgtaatgggatagcagatccctcttctgctggcggatggaggaaggatacccttgccggtggacagttgcctcctaatcaggaattatgcctcatgctcagccagggccttccaggcaaggaagccgagcaaagcccactggaagacagggctccctcgggcacaaacaagaacagcttcctgctcctctccagcctcaaaggttcatgcgccttgtccctcagataaaggtgctagaaagaaggttggtgtcactggacgtcgtctcttagggtgattcagctacttcaggcgaggggttgggaggaaccaataaatatttttgtctttgtttgccacactgatgtgaatgcttataattttattagcagctgcctgggagccaggcctgacttaatttaatttaatctcctgggttatttcagttcggtttagtctattttaagcacagatgaagaggaaataatcagaccgaggggaaagatgagggaggggctggaggggccatccgctgccctcgctagttcctcaggcttaacttgtcttgatataaagggaatgacttcatggaggcaggttagccagacgaagttctagctctcactgtgttttgtctctggtatcatcaccttgttctctaagaaaagaagcatgatatcagctttgttgggggagggaggatgggggatattaattatgccactagaaatacaaatggagcaattttcttgtgccaggcaggactgaatagtgacaccttccccggccctccctttctccttttagcaaactcactgatcactgtgttgtggtagctctttctctttggagtgttttttgttgttgttgtttggtttgtttgattttggggtttttttttttttgagacagggtctcactcagtcacccaggctggagttcagtggcgtgatcttgactcactgcaacctctgcctcccaggttcaagtgattctcgtggctcagcctcctgagtagctggaactacaggcacatgccaccacgccctgctaatttttgtatttttagtagagatagggtttcgccatgttggccgggcaggtctcgaactcctggcctcaagtgatccacccgcctcgggctcccaaagtgccgggtttctaggtgtgagccaccgcgcccaaccgtctttggagtgttttgatgccctgggattggtggtttgggaggcaggatggcagagcctccgctttgagcagtttcttctgagtgaatatgtggttcagaggcccactcagcgaagcccaaggcccaaagaccaccaagtcctgtggcctgggctgccctgcctgccctgagcccaggagctgcgtcccaaggccaccccatcatttcctgcccccagggcctgtgaggctgtgcatttggtttagtaccaggaatcatcaagaacaagagaaattcatgggcccagtcagagaacccaaaggtaatgagaatgtccagagggtttttttgttttaaacagtgattgagatgataagaggtattgccaggtgaaaatctcttagccttgacatcatcaaagaagagagattcgtcatctcatgatgaagagagattcatctcaatttcttgtttctttggggtttttgttttgctttggttttttttttttttttttttttttttggcaatgtcttgctgtttcactcaggctggagggcagtgttgcgatcatagctcaccgcagccatgatgagctgccgggctcaagtgattcttctgcctcagcccctgtagctgggactaccacacccagataattttttaaatgtttgtacagatagggtctgaccacattaccaggctggtctcacactcctggcctcaagcaatcttcccaccccagtctaccaaagtgatgggattacaggtgtgagccactgtgcccggctcattgcagttttatatgccaaccctgaaagcagaaaattgtatccccactgaagtgctggttccatgaacccaggatttttatgggtcttattcattgcagaatccccgaactcatggtgcctgggacccagcatgttctcagtgtgtgtccgaataacactggagggttttttctggatgatactgataattacagaagttaagagttattaagtgcttattttgtgccaagcactatgccaagggttttacttgtataatcttttttaatacttaaacggttcctattgcatgaaactcttaccttcatttaaatggaggcatagaggatttcaggaacttgccaggtgacaaggtggagctagaacttgaatctaggcagaacatttttatctgtgtcctgagagtttccatgagaacatgaccaaaaggttttctggtatacgctgagtcacctgcatgagtgttcattcagaaccatcctcccaacaccctgcacagtggagatgccctgagaagggagcatcgctgggcttggggctgagtgtaggagtggcaagagggggtccaagtacctcccatggctcattaaagtcacctgagtagacctgctaagcactcactcctccatgccggatttctcaaagtgtgctgctggtctacctggagtggggtagagtacttccccaccccaggcttcctgaatcagattctctaagaacaagcgcagagcctgcaagtaaattctattgttagtgagttctccaaggtggttcttaggcacctaacatttgagacctgcagctatgggtatttttgctcctagccttgcggtatgttagatttacttaaaaacatacaagtgtctatatgtttgggatggtgttggagggaatttattaaaactagagttcttctttatccagaaaagcacacacattaggaaaggcaatagcatctgaagacagaggagtggcgtgtagctcattttggcctttcctgttgaaggcccccaggttcactcttgggatgaccaggcccctagagaccaattccaatgtagtcctgactgggcagtccatcaggatgccagtttatgaatttacagagaacaataaagttgaccatgtgacttgatgagagcaatcagtgtagagaagataccaggcaaggcataatgaacccattttattgatttgtcaaattaagcaccatcacatagactacatagagcagaaatccgctttgggagtgccttctcccctacagacaaacctgaggggactcagaatgctgcctagcaaacatagaattataacaaggggatgtgataaatgttggatggcagcagactaaggtttaacattcatctcaagttagaggcggctgctgtgctgctggggccagaagcacttgaagtcaaatgcttagatgccgctccttggacctgtgtcataggctctgctgacatttgcctggagcctctgctttctcgctgctcatttgaacatattcatactggacacaagctggtcctacaagcctagtacctctcagaaccctctctccttcaggggactttgagaagctctgctctgatccaatattgatgaatccagtagtttgttgatttccaaagaaagatcttgctttcctcatttcctactacccaaggaagggagaatcacctcattatggctccaaatttcaacagatgttatataaagggctatataagtattcctgtatcttcattctttgcaaaaatgccttccccaaaatctgactctttgtctgtcagataaatgatatgtagaattttgtatcttaccttctaggagaaagagtagtcgtaactctccatgcctctccagggaaccctttgaatcccccccccacacacaaatttagagattatttccaggacaaaggactatatgaaggacccttaactatctagtacccagactagtaacgtagactttggtgataccatgaaaacgaaggcataatcatgtgctatgaaaatggattaggaagcagcttctgttcacagtagaaagaatcttagagatttccctgtccagccaactcctttgttttccagactgaatataaaaactcactaaagattgcccaagaaagtgagcagcaggacagagcaagccgaaggtccctgcccagtcccttcccccacctctgccaccttttaaatcccatctggaatgtctgcgtgtttagttcagttggaggttagggatctaggaggtaaaatggccaccaggatgatgtcaaatcgagttaaacagatacagccttggcctttaaagaacagaccacactggaggcatatgtattcatccgttcttacactgctaataaagacatacctgagactgggtaatttatcaaggaaaaaggtttaattggctcagagttcagcatgtctagggatgcctcaggaaacttacaatcatggtggaatcttcacatggcggcagcaaggagaagtgcagagtaaagcagggaaaagccccttataaagccatcagatcttgtgagaactcactcactatcacaagaacagcatggaggtaactgcccccatgactcagttacctcccaccaggtccctcccacaacacatggggattaggggaactacaagatgagatttgggtgcagacacagggccaaaccacatcaaggaaccacattcaaaagccacccacacagggacaagttaacaacatgaaagcaaaggtaagagtgtctgccatgagaactgatggtaggcagcttagatgtgaagtgagtggccaagagtaatttattcctcttccaattaaccagactttctagaaacagtggaattccaagagctacttaagaaatcgagatatccttgcatttctggattgaattgcggtaaccagttggtaacctctgaaatgcaatctctcttatgtccctctgaaatgttaagaagattcaggaagtgacagaaacccacgatcaagactggcaaaccacttactgccaccttggagaaatttctgttgcccgttagcccagtggtcaagtgttaagaaacaattatcagtggtctggccatactggatgcatgaaaaaaccaaagtcctgcacacctgaaagaaagcaagaagattttttgggcctccccttttgctcagataaacagggtcttcgaccagccaaaaaacctgggaggcactcctttgctatggagtttctctcatttcagaggaccaaaatagtgtcttctctcatctttccatacagtctacaaatagactgtaacttccaaaggaaaaagaaaagggctgttgttggtgagttatgtcctgagggttagcagctctgcaagcgaagtatagtggacacaggtgtggaggtgagaagaacttcagggtcaggggattctaactttaaacggacttcacagattcaagatgtgtaattaccaagcactgtgaattggaattaccaagcactgtgaattggatatgatcctacctggctccagcaaaaacacactcgtcattggactaagagccatgaacatcaacttgagtgccctggaagagggaagcaagttctctagtgtcccagtagacagtggatagagccaatgtggcatacaaacagtatctttgggcaaataacacatctagatgtacttgtctttgaggacaagtaaagaaagaaaacaaacccaaaatatggggcccatttttaaaacatgggagataaagggatagtatcatggagaacatatttgaatatagattattggaagaaaagaaattacagaagagtatttgagaaaactccatacacattataatagggtgcaggaggctgggcacagtggcttacacctgtaatcccagcactctgggaggccaaggcaaaaggatcacttgaggccagaagtttgagaccagcctgggcaacatagcaagttctgcctctacaaaaaaatttaaaaattagccaggcatggtggcacacacctgtagtcccagctactcaggagattgaggtgggaggattgtggagcccatgagttcaaggctgcagtgagctatgatctcatcactgcactccagcctgagtgacatagtgagaccctctctttaaaaaaaaaaaaatgcacaatctctgtaaaacaggaacataatgccatttgaacaaacaggttgagaggaaaagcaagcagaatgagattttttaaaatgatagtgggctatataaagagacagaaaagatgaaaggaagtggacaagtaaatgccagtttccagtaaggaaatttatagtacataattaaaatctttgtggtgcaacaaacagcagaattggcattgcagaaaatcaaatcagcgctgtgcaagaatcctgggaagctcttctagaatgcaggcaaaaggacaaaaccatggtgatgaaagagagaataatgaaaaatggaagactgggaacaggatataaattgagaataatagctttgtcccaaagataaaagaagaaaaaattgaaaaagaagcactaattcaatatgataggaccaaatttatggagcattcaaatgaaaaggaatgcactctgttcctacaaaattaaccaaaagaagtctgcatttagaagcattctgggctgggtgcggtggctcacacctgtaattgcagcactttgggaggccgaagttgggcagatcacttgaactcaggagttcaagaccagcctgggcaacatggtgaaaccccgtctctactaaaaatacaaaaaattagctgggcatggtgatgggcgcctgtagtcccagctactctggaggctgaggcacaagaatcgcttgaacccaggaggcggaggttgcagtgagctgagattgcgccactgcaccccagcctgggtgacagagcgagactctgtctcagaaaagaaacattctggaaaacttttaattacaaagaaagaaaacaaatgtcttttcttcagaatatataggtgacctacaggagaacaaaaaccaggttgtcactagacctctaatcgtatgcactactaaattttaagagataagaaaacatcacttacagagtttggaagaacaaagtgaattggccccaaatttctcacccagccaagttgccagtcgtggcatattctcagagatgcaagagctcagaatatacatcacccacactttcttgaaaattatttaaaggcgagctaaagaggacggcaagatgaagtaaaattaaaagttcagggatgggaagtcatataaggataagcagtaagcactaaaatcagttgaacctgttaatgtggaaaacagctatcaaaactgtaactcatataaaaattatgacaagcattagagatcccatactccagataattttacagtaacaaaaagaggaagtaggatgggagctcacagggagtaagaacagagcatgcacaatgcttcatacccttggggagaggagtcagaagatgctatctcattctttcctttggtgatcggagaaatgtaggataaaaaatgttttggggtgaatcttgagatagtcagcagtagaatttaaacaacattttaaaaattttggccgggcattgtggctcacacttgcaattccatcactttgggaagctgaggtgggaggattgcttgaacccaggaattgaagatgggcctggacatggtgaaatcgccatctctacccaaaaaaaacacagaaatgaccggtgtgatggcgtgtgtctgtagtcccagctactcgggaggctgaggtaggaggattgcttgagcacaggaggtcaaggctgtagtgagccatgatcacactactacactccagcctgggtggcagagtgagactctatctcaaaaataaatttaaaaaaattatagaaaaaataaatgcaaagaaaacagagtatagtaaaagagtgaaggctgggtgcaatgcctcatgcctgtaatcccagcactttgggaggccgaggtgggcagatcacaaggtcaggagttcgagaccagtctggccaacctagcaaaaccccatctctactaaaaatacaaaaaattagcctggtgtggtggtgtgcgcctgtaatcccagctacttgggaggctgaggtaggagaatggcctgaacccgggaggcagaggttgcagtgagccgagattgcaccattgcacaccagcccaggagacagtgggagactcatctcaaaaaaaaaaaaaaaaaaaaaaaagactgaaaacaaagcaagtaactaggagacagagggacaacaacaagtgaagctccacacgacagaggcagccaagaagtgggggggtttaagaatgtactggaatggggctgcctgtgttttcagcccctccccttgctagctgggtgaccttgtcctaggtactgcttaatctctccaagcctcagctttcctcgtctataaaatgtggataccaagtagggttattgcggaggttagttaatatgtccaaggtgctgagtaccttatcaggtacgtacttgtgggtacgaatattgaggataaggtaacagattaaactgcccaccattttcagatgggatgttttgctaaagttcagcgatatcctatgaatgagacctacacgtaaagtaaaatgacccataaacactgagaaaaaggatgggcagtgatttatgagatgaaagaaagaaagcagtggaagtagaattgccccaagtcaggaaactctgtgtacctggatggagaaagccgagtcgggggcttgtaccactaacatgcattggaaatctagaacaatttaaagtctaagcttgttgcacaaattagcagaaagttgaagaagataaaatacatggccctgaaaacagagcgaacattaacaaacagaagccacacagaccaatgggaaagatagggcttattccactaataatgttgagaagttgtctaaacatttggaggaaaataaatgagatcttctttcacactgtacaccaaaataaatttcaaatggtcttaagagttaaatataagaaagaaacaaaataattaaaacttaggtgaatattaagctaatctcagaaagggcaaggtttttgtaagcctaaaagaaatggaaaaaataaaaggaaatgtttgacagatttaactacataataagttaagcttctctgtttctagaagaatggtgacatgtaacacagtttgcagcaactatgacaaaaggcttttatcatttatatctcaacaactcttctaacacagtaagaaaacttgttactaccttctagaaaacttgaataaggagttaagtcaggcagaaataaatacaaatgggcaaataaccatggaaaaaaaatttaacctcaaaaataagaaagtcaaaattacagtgttattctttacttttctcaccacttcttgatatggttttggtaggattgtggtaaacttttagaggagtaatttggcaatgtatgccaagaatcttgaataatttccatcctttaagctacttccaagaatgtattcttattcttctttgcatcagaaaatctgtggcgttcttaaacacacagggtatgatcagacttgcacagcataaatagaacaagaaaaaaagtatcagaaatttcaatgaatatttatgcatgaagatgatcagttgctatgttatttgtaaaggtgaaaaatgataaactttgtagatgcccccaaacagggaattgattaaataaattctgattagccataaaatgagatgttagacatttaaaatgttttcaaagcatactttgttataaaggcaggttctaaaactttattcctagtgtgatgtgaattctataaaaataaatatttcaatgtagatagatgtggaagatactggccataaacatgctaatgtgccaatgttggttctcccatgcagaagtatagttgttttagttttcttctttatatttttatgtctttaaatttcttgtatgatgggtgcacccgttactcctataataagaaaaaaattttcttaaatatcttcctacgttgtttatgcagaatcgtttcagtctctcataacctgggaaatatttctctcacaactaggtttcattttcttttgaaacatcagaattatagaactttaatgtaaaattttatgtcccactaattgtaaaagggaaagtaatgaaatatttatgatctttttccaaggactaaacattgttgtttctcatcttataccacagtcctccgaattctcttatgtaagttttgttccagtagaattttggttgatgagttgccaacctgtgttttctggtacgtgaatgggacagaaattcactcttatcaccaagcagccagcctcaccagcaaaatagaatattcactaaataggttccaaataagaaaatggttaatgtccctcagtccaggtttgtgtacagggccatatgaagctgtgaggcgatgtctgatcaggtgtatttttagtgtatctcattattcttgcctttgtctctggtaataaggaaacaaatatcacaaaatttaggggtcattatttctaaacatgaaagagatcacatcagaaattctgcaacattcataaacacagacggtgtcagcagacttgatacagcataaatagaacaaatgcagtgaactagacagcacccagacccagtttgtacacagaatctcagtctataattacccagtcaaaaattgttcatcgtggttgatgacacctgtgcattttatttcctgaaatctagagaagttccacgtgatcactatttaaccaagagcaaaagtccctttctgacccatttttcctgtaagtggagatacatcctgtgctcttttgtctttgtgggtacagagattctttcttcaaagcatttaacattttcaaaaaagtgtgccactccttttggcctggctttcttcgcccgtgaaaaggcctgggtggtttttccttgtccaagagtccctccaaatggacgctttatgtactgcaaccaagagctgagaagtttccaagctttcctgtctgtgttagcattccggtcattcagcaggaatccaatgagcgcagattttatcttgtctgtcctgtgttgccctgggggagtgatccctggggatgcgagggggtgtggcccttgccctcaaggtgctgtcagtctgtagacatggaacacctttgggctgggctaggctggcaggagagtggaagggcagaggaaatgggtcttgtgcaaggctaagggctgacagcactgagatggatggaggagtgtccccagcgatggggcagtgtggacccagaagcacagagcaaggtgggcacagagatacacgtgttcagcagttactcagttcacgcatggtgctgtgctgggcagtaggggttcaaaataactaaaagagactaaccttgttggtgtggagtggttcttttgggttatataaatactaaatgtgataggttgcatgcagttaaatatttagcatatagaaccaacccatcagaaccaatgccagctcctaagtcataccagcatctgctaggggaatgtgggccagaagacggagcgtcactgacatttagatagaggtgttcaagtaaatggtaggaaacagattagaggcctgttttccatgttgggagcctaaaagatacagtaaccaagtgccactcaagctgtggtagagaatatctcagttctaacttgttaatgggagaagaatatgattttgttgttgcttctggccaaatgattccagtgaatcagtctgatgagtggcagtgcctgggctgccacccacaaccaactctcacctgtcctgtcgactcttcattgttcatgcttgagaaatcagttacctccttatgccatggagggcctgactgcagtgcacgcccaccaatgggaagtcgtgcccacaccagtggcaagatatgccaccaccatcatggaccaaccacccaacgcctcctatccaaaggcagatcccagcaagcacttgctctctgttgccgggacttctcccagctccaaaactgccttagtctgatctattaatatatctttttaactgggtggctcataaacaacagaagtttacttctcacagttatggaggctggagactccaagttcagggcacaggaagactcagtggctagagagggcccatttgccgacagccccacatcctcacacggtggaagggcaaaccagctcccttgggcttctcttataagggcactgatcctctccatggaggctctgccctcctggcctaatcacctcccaaaggcccctcctcttaatgtcatcgccttgggggttaggatttcaaacacaaattgggggcaggaggcacaaacattcagaccacagcacagagctcttcccatccccagccgaagtaggaatgacccagaggaaggctgctgtccctttgcacacaggttctgaaagtgcgtggagagaggacgatccctcggtccctgcagaaccaggctcttgaagcatatagcagaggttctctacccagggcctaccctagaatgtcatcaaaactgcagtgttgtattaaaggggtgcatggcttagagagaatggagaatgcccagcccagaggcccagagtgttttaggatgtgcctgttacccaaagttaaaatctgtatgcgtcaggagtgacacttgggagctacacttcccaaccccctctcctgcggccaccggagcctgcctgggccccttctcctgaaacggccttctctgcccacataatagcccctagcgatgccagttctggttcctccgcggggtcccacgccagctgacccagcagtacctgtaacgtgtcccacccttgccagggtttgtgtgcctgcatggttttagaggttccaagtcagagcccctaaaccccttgccttattgctagacagcttgaccgcccccggaacatcacgtgggaagggcgctcggtaaatcctgttctggaggcaatctgtcactccaccagtttcccaatcaacatttgccgaggagttctggctcccggtgcagaactgacttgtggcgacgtgagggaactggcagcttcttagacccaagttctccctcgcagcatcgtcagaagaggcccaaagtagagacgcaaacaaaccctgagaacagcgtgttcttcccagtaacgtgaccgggaaaatgtgagccagaggaaacttgagagctccgtggtgcggctgagctggtggggtgagggttttttccctttttctatctggtccagcccatcggccacttgagatgctcctgaactgagtaaccaagctgttcggagggtactttctcagcaggacaagccctgagctctggaaaaacgcagctagaataacgaggaagcagaggggcctctcccacaccaggcttgccccgacaggtcagcttgcttgtggcccagcgctactgcgcacatgttcctttaagatccctatttccgaggcagccgtggcataattaaagaatggccctgtggatgtcctacggtgctcactgtttgcacttgcttctgggtggggctaaggtgtgggaccggccggggaagcctgaacaaggtggggttggccaattgcaacaggtcacagccagatcagataccctgaggaggaggctgtgagtcatgtttgtccagaagtgccaactgctgcaccagaaaagccgggagaaaagaagcaagcgtaaggtgcacatgagaggtgctggtttctgaaggttctgttaagacaggagaagatggatcatagttcctgtcaggagacacaccctctcccccgacccccagcccagaaccccttccttgctttatagcacaaggtgaaagttcagaggctcagctcaaagcagaaggaacctaagggaagtagagcgtccttttttgtgtcactttctcctcaaacaactcactgtgttggtggggtagtgtttgttctatgctgggggtcagcaaactacggcccaaggtccaaatctggcccacagcttatttttatttatttatttatttattgagactgagtctcgctctgtcgcccaggctggagcacaatggcacaatctcggctcactgaaacctctggctcctgggttgaagcaattctcctgcctcagacccctgagtagctgggactacaggcgcacgctgctacacccggctaattatttgtattttaatagagacgagttttcaccgtgttgcccaggctggtctcaagctcctgagctcaggcagtgcacccaccttggcctcccaaagtgctaagattacaggcgtgagccactgtgcctggcctattttttaaataaagttttattggaacacagctgcgttcgtttgttcacatatcgtccgtgtctgctttcgctatgcaatagacctgaatagtggcagtagagactttgtgacctgcaaagcctaaatgactggtgatctggctctttttagaaaaggtttgctatctcctattccacactaataggtgaacctgaatgcagaggtcaccttgtgaggaccacacagaggttaatgcccaggccccctgaggcaggactgagttgcactcctgactccatcccttactaaatgttcaaccttgagcaggtttgttaacatctgtctgccttggttttgtcatctggaaaacgggcatctgagtcattatttcacaggagtattgtgagtattaagtgagtgggtgtagtaaagcacgtggaaacctgtcagtaaaggcctctttgttaattcagatataactcacaggtcataatattcaccctttaaaaatgtacagtgtagtggttttcagtatattcacaagattgtgcaatatacaccaccactgtctaacccagaacattgtcatcacttcaagaagaaattcctcagtagtacttgtagtaggatgaataaccaccacccaaagacatcagatcttaatccctggaatctgtaaatgtgcccttaatttggaaaaagggtctttgcaatgtgataaagttaagcatcttgaggtggggaaattcttctggatgatctggatgggccctaaatgtgatcacatgtgtattcttagagaggcatagagagaaattacaggcacagagaagaaggtgatgtggccacaagccaagtcatgcctgccaccactggaaggtggaagaggcctggagtggattttcctctagagcctccagaaggaacatggccctgcagagcccctgattttggcctggtgatgtggatgttggactcttggcctccagaactgcaagagaatacatttctgttgtcttaactgggaagtttgcgtatactttgttccagcagccacaggaaactgaggatacctattgctaagattactattgatgtcatcctgctagcagaaggtaggccagagctagattaagtcctgtgatctgaactggggcagtgtgagctttagcatactccacttagtggtggagaagcctacttaagccaacaggcattcatctggcaggcaccccacaccttttccccacaccacttacttttttgtttcctcctgcatagggctaaacagtccttgttgactgaaaaaaaaaaaaaggacagtcccagccacccaacaggcttctcgtagtatgcacaccactgtcattgggaacatgactgtagggaaatgaacactgttttagatacatttatgctattttgtggagtgtcgtttttccttggtttcaatatttgttttgtggccttaaaaatctctacatcggtgcagatttacccagcccattttcacacccactgcaatcttcttttccctctatgctttccatgtgctgtttgtcctagaattggtaactgcagcagagagagagagaacccacaaagcaccatttcctctttggtggcatggttgctgggtactcactggctacgtggtcactgggtacatcatggtcttcattgattcagtccctggcctgttggttcttaggcagatgtcagcacattccagctgtagtgactggagcaccccagtgtactaagaggtttattggttttagaattgcatccctgaagctactacactcacaccttttttttttttttttttttctttgagacagagtcttgctctgtcacccaggctggagtgcagtggcgcaatctgggctcactgcaagctctgccgcccgggttcacgccattctcctgcctcagcctcccgagtagctgtgactacaggcgtccgccaccacacccggctaatttttttgtatttttagtggagatggggtttcaccgtgttagccaggatggtctcaatctcctgacctcgtgatccacccgccttggcctcccagagtgctgggattacaggttgagccaccgtgcccggcctacactcacacctttaaatcaggtgcagcacctttaaaccccttcactaagttcaaggcaccaaagcacagacatagctgtgcaggctttgcctgccttcccaccactcctctaggcacacccagggctcaatacagcactgcaagatgtgtgttcacttttccctctgtgctctttggccacccatctttctagtggaagagtttcctttcctcctcgttctcctgagcaacgttttcctccatcccctcctagctgaggctgacttcaccacctcttctctgggactttgtcttgctcaagtcatttcaatacatcagcaagcgaaagtggagttttgtacagtcagaagcttgcccgagctcagctactcattagctttgtgtggtggacaggttatttcacctctctctgcctgaaggccctatctgcaaatgggcttgataatagcatctttttacatgaaattaatttatggatctaaagtcctttgagagaacattctggatatctaataattatcaaaataatgaattctctgggttcgaagtcattttttattcctcaaagacaaggctcatgggttgtggaagcgtccttcactccgtggcctggtgttgaatgacatgaagttcttttgaccacagacactaaatctcgcctgtttccagcacttacctgcccttccaccaacatttttgcattcacatttcttttgctgtgggtaacttcaaacaaagaagagtttgtttgtttgttttttctgcagtgtcagagaacatttttgctcatgcctggtgtggagtaggattcgagaattttgtttactctcgcttttgctgtcaggcaggggtggaggtgggaggtgtcacggggtcagcacagactgaacaatcctgacttttgcagtaattctgttttgagcctttgtccttgtttttggcttttaagtagaagccaggagcaggggtgctcttagagggggggagaaaaagtaataaaaacagagaattatttcctaaagcaaaacagatcatttggagggccatgttgtccttaaatatggagacacttgacttttatgcattactaaacagtgtctctgtatagacatgaaccctttgatgggcagagtcactgtgggtcagtgctgacaagtctggtcctcaggcaacagggatacagctgtgtcctcaacaaagcttttggtgtatgtgcccgtggatgaatccttcagaacctctgcatgaccttactttgacccattgcccagctagagcaccctcagagtgaaattaaaaatccacattgggggtgggggaggtgggaaaggggcacacgctgggtaggttcagcagtgttgccaccgatctagcttttatgcaaggcagtgagtcacaggtgtttatcattccaccccaccatttatgctacatatattctctggattaagaaaccacctggagggactgggtgcagtggctcaggcctgtaatccgagcactttgggaggccaaggtgggtggatcacttgaggtcgggggtttgagaccagcctggccaacgtggtgaaaccccgtctctactaaaaatactaaaattagccaggtgtgatggtgggtgcttgtagttccagctactcaggaggctgacgcaggagactcacttgaacccgggaggcggaagttgcagtgagccaagattgcgccactgcactccagcctgggtgacagagggagactccatctcaaaaaacagaaggaaagcatctggaccgttctctgaacggattgcattgatctgttggatcagtggatccaatggatcaaggattgcattgagttatttttttttaattgcaaattactttggaacacctagttgctgactgtttcactgtagcctaatggggtctgttaccctgaggaaacagccctgcttctggggtcagagagaactgaatgaaagtgggagtagtggtggtgacggcgaagatgataaagatagcaaatgcttctttaacactaccattagtaataatagcaagtatataagacttactttgtcctgggttctcttctaatgctttgcgtatatcaattcacttagttccacagcaaccctatgggttcggcactgttattttccctgttttacagatgaataaactgcgaagttgggtaatttatccaaagccatacagctaataagtggcagggcagagatttggccctagctgcccacgctcttggtccctaagtgatgctgcccctgagaagtcacccaccacctgcagcacccattcacgtgagatggcctgactttcccctgtgcaccatcagatgtgtatccctcactcgggtgcctgcaagcctttgtgagcgcaccttgcttctctcagggaaagcatagcggtcactcccgcctggcttcctgtctgggtccacatctccacttttcatcaagcaggctcttggcaaaatcactggcttcattgcctagcctgcactgtgccatctactgtggtgcacctgtggcttagattctccaatccggctagggcggcccagtcctgcgagctgaggagcagcccatctgcctgtatccccactccattcctgaacatttacttacaactctaaaactctcatgtcctgggttcccgagccacctgcatcggggatcactgggtaggtggttctccatcttcatcatcttatttgaatgggctttatccagaaatgacaggttacatgatcaggaaattatataaccttctaacccaggctggtttttctcagtgccgggcttgacagctgataatttcagagcagccatctgaagccaaaaaaatgagaatataattagtattctgtatttctattaaagttctggaattacagaacagactttctattctgaaatggccagtgccgtggcacagatgtatttcctcagcagatgtctcctcctcataaaggctgcagaactgctaatgagctgcaatagaaaagcattcttcccgcgttccctgccagggccttgggcccatttgggcagacctcggggagcagtcactgcttctgcagctgaaggagcaagggaagtgtgttgtttctatactgttgtgtttagagactacctgtcttttgaaagttgagttggcatgatagatcttttaaaaaaaaactcattttcaatagtgtgtgtatctaagtagtgtgattttgttgttgttgttgttgttgtttccttatcttaattctgtgggtcaaaacaatttggttcttgcagaaagtgaaagacaagaaatgagccgtgggacctgtgctgggtctgttcttcttggacccagtattgctcttaggctgtggaacttgctcttgcttagtaactcggaattggcattccctccaactgtgcttcccaaatgtgggatgggaccactgatgggtgtgacttttggttgcacttgaggtgatttctgaaggtactgtacggatgttaaaaagcattaaattacgtgatgagttagttattctcaattttctttcaatctcagttgaagcagcaaagacttctggggctggaatatccttaacacactagcgcttgttaatttcccctttgtagctaagagacagaagatctcaggcaactggatccagctagaaatgaataacatctattttcattgtgtttacttttatggttaccttccatttatggcaaacaatcttggttttctgtttcctatagtgatgtgtttcctttttaaatgatggatattaaaaagcgagccaatttaaagaaaaatgtgaataatagttgaagtcttcaaatgatgtcagtgtgctaggccagggagcacacttagagagcaaatgctgggtgcagtgaacagtgcctggacctggcttcacctgagactcacctggggagcttaaagatcctggtgcctgggtgtcaacccggaccaagtagatctgactctctgaaggtggggcccagggatcagtgtttgactaaaacatcccaggtgtttccagggtgtagctgaggttgagaatgtctgcccacctatcctggggcagcgtcctcaccctctgactccatatctttttttgggggggtcggggggatagagtctcactgtgtcacccaggctggagtgcagtggcatgatctcagctcactgcagcctccgcctcctgggttcaagcgattctcgtgcctcagtctcctgagtatctgggattacaggtgcccaccagcacgcccggcttctttttgtatttttagtagaaatggggtttcaccatgttggccagactggtctcaaactcccaacatcatgtgatccacctgcctcagcctcccaaagtgttgggatttgactccacatcttgatcacatctttcccttgtttctctcttctgtctctagcccttgttctcatccgcttccccacttcaattttcctcttattttctctttcctagcttccccagcttcccctcttccatcttccttacaactattcctatgagtaatgccccctagcattgcctcttagcctgacattcttgaaaccatacagttgaaaccctgttagaacattaccacactgtactgttttccccggcatttgcttaccactccgtaagctgttggtgcagtttctgcacatctaagattgttctccaccagtaacttgtattaagagcaattatgatcatcactattgtgctctcaccgagtgcctatcactgctctaagcactttacatggatgagcctacataatccttgcttgaaggagatataattttccagatgaggaaacttaggaagataaaatagcttgtccacaaccacagagtggcagagccagaattcaaatgcaggcagccttgccccagatcctacactctgagcagatgggaccctaagttagttgctcgtaatcctgattcaggtgtcctggcatgccatgagtcacactcacacaggctgttctctgctgtgataagaaattgaaatttggacccactatttgcttcaatgacatttagaattgataactctttttattttcaacttaaatggtagtatctcagtaggacactcacagctttaaatcccatcaagattttaactcatcaccattccgaagagatcttacttaaatgattttttttgtgtgtgttgtctgtcaggaatataaattgaagatataaaagccagcacccgcaataattctgcaactggtaggaggcaacccaggacctcttggtgaccttaataagggtcttctttggcttatccaggatgtgaccttctgcagcctccagtattagacattccagggcattttctgccttttaaaaagcatctgattctcattctggtgtttaatcagagagagaccgttggcctctttccattcctcatgggagagctccatttttgtgctcacatttttcatctttggtgatactcagggttgatgttttagtgggctagactttctgcattggattaaaacctttcacatgagcttggtgaattctccagtgaccaagtcccctgggggcctccaaccctatagattccagcatgataagagtggaaaggagtccggaacatcatgcctggggtatagtgagcactcacaccatggatttattttttcattttccaagcccccaaccatgtaaggtattttataaacattattttatttgattctcccaacaattctataccactggaattatgtccgtcttcatttttctagatgaagagacagaggctcagagactaagcttcccagtgctcagggttacatggtgaaggaggcagagtttgcatgtacacctgctgagccacagggaccatgcctatgtgttttatttgtgtgctatctgctccctgagatgaatgaggttagatattttcttaggagaagaaatacttggaaggcacaaatggggtatgacaaactatgttcagcttctctgtggctagcagacctgagctagccccctccccctctgtatttgaatatagtcccatctgttacctacctatgtaaggcttccaggtaaggaggatgtaaggctgttggctggcaggaggcagaacacagtagatccacagactagtaaaggcaatgcctgtctctgacttccgatcttagggctgtacctccctcatttgtgtccaaagacccaacatctttagggttctccccctgcctcctccccatctaaccctgcccactgacaactccagtgccttcttctcaagttcttctgtaattcttaatttaataatcaaactatgctgataaactatgctaattgcctagatctgtggttctgcaacttttatggacatcagaatcacctggaggcttggtaaacacagatcattggacctcaccccagagttctgattcaggaggtgttgccagtgccgccggtccagggaccacactgtgggaaccactgaatcagggagcctggtcccagttatatgtgtgttgatggtgtctgaccagttgggtatctgataattcagccttactgggaaagatgccatgggaagataggaaggcatttgagataggagactcaggcttttgtcccttcatcatagcagtagataattatcttttacgttgacgtgcagtggctttagacagcttctcatggttgtgagcctctgccagctcttaaatctttgagcctgttttcctctgtggatgaaatggcctttccttctaattatttttgattcccatatcaggtttctcaagctaagattgcattggaagcacctggaggtcttgttaaagtgaggattctgagttattaagtctgaggtgggacccaaggttctgcatgtctaatgagctcccaggtgatatagatgctgccggtccatggaccagcaattctgagttacaactgtatacagcagtggtgcttgcccctgctgcccagtagaatcacccaaggagcttttaaaaacgaatacttgagccacattccttggagattctagtttaattctggggattagaatttttaactcccccattccccaacccccatgtgattccaatgtacagtcagagttggaagccattggcctttacccacaaaaagggataacaccttctgggagctcaggtgcgtgtgtggcaccatagaccaggttgggctggtcgcttccatgcagggagggtgcaccattactcctggggagctgcaaaggtcacctgggaatcttgttaaattacagattctgctttggcaggtttggggtgggacctgggtttctgcatttctaatagatatcttagtgttgctgatgctgccagtccaggctggtgctaagtcccaagacccacccacaagggcccacacgatgcccattatctctgccggtggtggcagcgggtagcttttctcatgtcgagtgttagaggcttttggcttccaccatctgtctccttaaacgccattctgacgtctcttttattcagcttggtattgacacaagacagcgggcaatataggtctgttctctttttgtaatattttcttccttctctcttcacagtacgagatgcaaaaaatctaatccctatggatccaaacgggctttcagatccttatgtgaagctgaaacttattcctgatcccaagaatgaaagcaagcaaaaaaccaaaaccatccgctccacactaaatccgcagtggaatgagtcctttacattgtaagtggtctctccttgatcaaatttcattcctatacaccatgcagttgcccacctcattatttgaggtaatgaagtaggttcattataaacgtctttaaacatgtcttcagtcctaagacctcctcaggctgccattagggaggtagctattagcacctgttcgatagatagtaatttgatttatcaagagttgcataattcaggcctcagattattattatctaatctggataaacaattctatttaaggaaatagaattaaggtaaatagaatttaagctaaaaatgtgtcaggtgtgtccacctcttgatggacttaggttcttttgggagttaggggagggcataaggcaagaatttaaataatttttagaccacagaatgagtgagtaacatagaaagtgttattgccactgaaatgggaagatcattcttgccttcaaagagagaagacttcctggaaaaggtgacatttaaagccagcctgggagggttgccaggatttcagaggtagagaaggggaagaaggaaggagggaataaataaatcaggaggactgagtgtagctgagggaaagcaagagttcccctttgtagagtagtatacaggaagcagtttttctgtggacaaccagaaaggtagctgtctgttctagagggaccagcaagctctgctctataaaggatcagatagtatatattttaggccttgtgggtcatatagcctctgttgcaccggtataactttctagtgccaaaggagccataggcaatatgtaaacagatagccatggctgggtcctaataaaactttatttataaaaatagacagtgggatagatttggcccatgggtcatagtttgttaactcctgtagcgctttgcttgccagcataaggggttggtattttactggaccaggaagacaaatatactatttctttatctcaggctcgagtcatatacatgtggtatctcccaagaaaccatgatcaagataacctagtgtttgcatgtgtgtgtgtcttgtagcaaattgaaaccttcagacaaagaccgacgactgtctgtagaaatctgggactgggatcgaacaacaaggaatgacttcatgggatccctttcctttggagtttcggagctgatgaagatgccggccagtggatggtatggaagccgcttaggttgagtatgtctcaaagcatcagaccatttagacagttaggtttcagtctctcaaatgtcagttgaggctggacatggtgcctcatgcttgtaatcccagcacttcaagaggccgaggcaggtggattgcttgagctctgaggtttgagaccagcctgggcaacatggagaaaccccacctctacagaaaatacaaaaattagccaggtgtggtggtgtacccctgtagtcccagctacccaggaggccgaggcatgaggatcacttgagcccaggaggctgaggctgcagtgagctttgattccgccaccgtcccccagcctgcacaacagagctaccctgtctcaaaaatataaaaatgtaaaaaaagtcaaatgtctactgatctggctgtagcctctccgtaggatgcgtttcacaaaaccgctcgactagaggctgcaggaaaggcttgttaaacttgcggtggtaactcttcttctcccgtccttgaaaggtacaagttgcttaaccaagaagaaggtgagtactacaacgtacccattccggaaggggacgaggaaggaaacatggaactcaggcagaaattcgaggtgaggataacaaaatgcccggaaacacctttcctttagaaagcccaacttcaggaacggccgagatgttgtggtcacatttttgaaaagcaaaaaaaaagtaatctcaatgttaatgatctttttctttatttaaaaacatgaatgttgttcgttccctttcctttgcaagctgttgactttttatgactcttaccacttagaaaatggaaactggaaatatcgcagaactgagagcatggttgatttctgcataagagatctgtttgcacatcactggggagagaagcaggctctgagggcaggattgttcttacaaaggaggacttgtgctcttctgaaaaggaggaagtcattttggcctttccttgggagctcatttgtgtgtaatcaggctatcatctgagactttttttttctacagaaagtacaaggttcctaattttgttctgaaagagcagcttaaacaaatatgcctttgtgtgtgatccctttttatttatgctccagatgtttagcaaaggccacctccttctcttcttcctcttggtatttgtgtttgcctctgtcccggattcactggtctttttacttctcctcctctgctccttactcctctttttcttctcctctctctcccttctcctcttcatttaccgacatctcagcttttagtaaacggttcttttctgtaagcaccttccttatgttttaaaggcacaacttctaatatttgtctgtttctctaatcacccttcattttggctgttcgagggactcctagagtagccttttcagtctgtgtaactggttaattccttcgtgaatctttctcttcttcagacttgttagaattccctggaatttccccgctctagagcagtacacgtgcacacgcacacatgtgtgtagatgctgaactgctactgaaatgttgacactaatgggatgctgatgctcctcttttccttcttctgttgttctccaagaaacatacagatctggggggtggggaagagtggtcttggggggataataaacctccttcatgccccccacaaaagaaacatataggtcttatccagagagaatgaatcccaaaggatgtaaaacatgcagttgttcaaattactttgttaaactgatgtttggttaaagttgatgtttgtggcaaatactaaatggcaggggctctttggttagatgtccttgggagcacagacgagtgaaatgattcacagataataaatggcaatgaacggcaggcctcgggattgaagcaggagggagtggtggagactggggtgagctggtaagcttcagctctgtctgcaggtggcagctacggctaccctgccccactcgatgtttctcacaggcgagtccaggccctctattgccggatcttccttcttccagagaagccagaaatccaggtttttatatgatacattctgatttatcttaatgttggcagagttctaatgttaaaacttagaaccaggccctgtgcagtggctcacttctgtaatcccagtactttgggaggatgaggcaggcagatcacttgaggtcaggagttcaagactggccaacatggcgaaacccaatctctactaaaaatacaaaaattagccgggtttggtggcatgtgcctgtactcccagctactccagaggctgagacacgagaatcacttatacctgggaggcggaagttgcagtgagccgagtttgtgccactgcactccagcctgggcaacagagcaagactctgtctcaaaaaaaaaaaaaaaaaaaaaaaaatttagagctgtccggatgtggtagctcacacctgtggtctcagcactttaagaggccaaggcaggcaggttgcttaagctcacaagtttgaaatcagcctgggcaacatggcgaaacccagcctctacaaaaaatagcagggtgtggtggcatgcacccataatcctagctacgagaatcacttgaacctgggcacgagaatcacttgaacctgggaggcagaggttacagtgagccaagatcacgccagtgcactccagcctgggcaacaaagtgagaccctgactcaagaaaacaaacaaaaaacttagaactctgtgtaggtcaaatatgcatctattgctttagacaccagtaggattcaaccagtaagaaccagcttgcagtctctgctcttcaaaaatagagaaaaaataattttaaaaaattatttgtatagttatatatattacaatatgtataaataaaaaggtgcatgtatctgtgtaactactatttgtctatctatcaatagagagaaaagaatgagattcttttcaaagatgctttataatatttagaggaattcaagtacaaagatgaaagtcagggtttggggcaggttcaaatgtctatgccaggcatagctccttttcaatttgtatttcttcccttgcttcattatctgtttccacccctaccctgcagctgaggatgcagacctggggtactggacaggaccaccttcttgagccccatccctgatgtcacaccacctctgtgacggatggatccttctagagagagtttcaggactgagtgccagcattcttcagctgtctcaggcaggggaggaacctgaggagccagaaagaaccttccttaccgaatgttatgccatggtgttgatcacgagcagtcactgggtcaggggctgttgacgcagaaagagtgcattcgagggaggaacagcacgggcgttccccacagggttcctcacagtaatgtctgagacttagctttgctgctggagaaatattgacccactctttgtgcttcattgtcgtggcttcctggtgagtaaacttcctgtttttctgggcaatgagttcagctttttataaaggtcagagttctaaacaaacaaacaaaatacaggccagaggacctgagcaaaacgaagcatttctcttgggaggctggtcagaggccgcagggctgttgctgcttactattcctcctcctgggagggctgtggacttggcaggagcgccagcccaaggctgtgagcatcctggggagaggtggcatcagcagagttgcatggggtggaggctctgctcttcagcctagtgaggtctgtgtttggagcatctacatgaactgcattctaacctttgctttaaatacctttcagcttatagttcctagattttactcaaattacattagctcatttgcttagagcattttaaaaaaacacaactgcaagagactgggcagaaagccactagaggatggcgtcaaaaagatgctgagaattttacgacagctgccatgcttcattttaaatacatattcagatctgattttaggcaggggttcaatcacgtaatggtgttttgttgaggtctataaatgtgagagttgcaagacttccccagtgccaagttactgggaagggatgcaccagggcagaaaggctggcatccacatttgagcagttctgggtagcagccaggctttgcaaacagggtgccatcagttggcatcaggtccaatttgaggcacctctttgagcccccaccccgtttcctccttttcggtctgtagcatgagtgcttcccagtgtctccaggctcccctctctgggccctttctcgccaactaactgccattctaacttgctttccatcacattagtcttttcttccctacccactctttcatagatactttgccaccctccagtaacagtttgattcagctgagtaagatttttttgttaagttcaatgatgaatctgtattggttgaaacacacacgagggttcgtcctgttgggaacaggcatcactcagtgggatcacacagtgtccagtctgtccttatccttccatgtccagccctgttttctaaaaagggttccctccatgcagttttcgaatccttctccaaaaatcaaaagtcattcagttggatgaaagggaaaccaaacgagcatttacaactctgccactgcattagtattcattcgataattaggtggaaagtttttgcaatttaaatggttggttctcaaatcttggcaaacagaatgatcagtgactggagctcttaggagccaaggaatattccagggtggctggagatgaccttcctcgctggtagagatcctgctagagcagttcatcctcctacaagacaaaacaaaccagaaccttgattgcgatactcatggacagtgtgtctgtgggcctttaatctgttccacgtttgtcatcaagtaaagtacacgtggtccctgattcacaaacataaataatgcatttttccatttgttaaaaaaagtaaggtgccagcagtgggctaagcagacagttcctgctttctttggagcttacgttctgtatctatgggccctgctgcaaaaatatttgggaacaaagcagggagcttatcatatcccctgtgctggccagtgattcccctgaatctccaggcactattgaggacaactgagattcctgtttttccctctcactgcttggtctctgctccctgtgatgaggctcacggccagagttgggaaaaggtccaccttgcgttagaggcagtgcagaggatgggttagctctgctcagcaaactttttctgtacctagtcagataataaatattttaggctttatgggccatgcggtgtctggtataacattcaagtctgccgttgcagctcaaaagcagccacaaatacataaacaaatgagtgttggtgtattccaataacacgttacttacaaaaacaggtggcagaccagaattggcccaagggccagtttgccaacttctggtttagcccgtaggctctagaatcaaatcctagtttagtcacttatttactatgtgacctttctgtgcattggcatgcttaactataaatggaaaaaataggtcaggataactagttctgtttttctattagttataaatagaactaatatcctgatacgataggatattagttgttgtcagggaagtaaatataataccacagtgagaagtcagcttgcactgatccttctcgattcaatggtttgatgttgggtcccgattacaaactgaaaagtaggcacatataaaagatgatttggccaggcgcggtggctcacgcctgtaatcctagcactttgggaggccagggtgctggatcacgaggtcaagagttcaagacaagcctggccaagatggtgaaaccctgtctctaccaaaaatacaaaaaattagccgggcatagtggcgggcgcctgtaatcccagctactcgggagactgaggcagagaattgccggaacccaggaggtggaggttgcagtgagctgagatcgtgccactgcactccagcttgggcgacagagcgagactctgtctcaaaaaaaaaaaaaaaaaaaaaaaaaaaggatttgatgtaaaccacacgaagaatcaacacaagtataatcataatgattgttgcagctaataattcattagagaagtgattatgttaacaacagaaacgtcacagttgattgactactgattgcattcacatgaaggtccagtacttttgttggtgtaatattgccctctgatcttttacaaaatctgggatctgaatcattcacatcttgagctgtacccaggaagttacatgctacattcacatttccaatggttaaaaaaaaaaaaaaaaaaaaaaaaggtatcttctagccacatctttccctcttttaagacagttcccgaagttcttattgtcatttgcatttcatttccatggcttttagtaagcttagtatttttgtttcttgtttatccgtcagttgattctttccctgagcctacttgggctacatctaccttcagagccttggagttgtcctagaatcaagaaaatgggctgagaggtaggggaaggggaaaggtgaggggaagggagttctgggaccagtttctaggcctgcctgggatccagccatttcctatccccagagttacattccttcctttcctcagcgccccttcctcttgtgcagagcctttctcctaagcttggcccctcttccctagggctgtttactctgtccaagaccttcttccccaatcctgcaacctcaagagaaatcaagccagaagggcaaataaccccagccatggacctggctccctggggctgagggcacttcaggacaagtggtgaagaccacgtctcccttctccaagcttcagatttcacaaaacgaaacatacgtttgctcattttgctccagtatcacaatgactacttttaatttgcattttgatggcttttagctgggaatggactttcaacgaactcatttctacctgtagggttgcttatctactccatgtgctgttaacagttaatggagattctaatattaaaaagtcaagcagctttccttaaatgagcctacaccattcaattttgctcaattgtccaggctttttattgtttttgtcatttattatttcgttcatcatttaaaaaacagagcaaattaagaagctaaaagcgccttggccttttcctcctcttactgtaaccgtaacttttgctgcacaccattgctctattccagagcaagttaaacatctaatatttaaaaagccaaaaagaaacttgtagcagaacaaagatagctaagaggcagcacacctggggctttgtctgcgatgggatatttctgttgtcagaatgtaatgaaaaatgatgtcccattagaaagctgatggataatatatcacatattactcatttgagtatcaggacccaagaaaacaagatgaatttatttaaattgcaatgtcccttgaagcttgtatgagctctctaaagggaaatacttttaaagttcttataaagagagaaatttatagccaagtgtgaaaaatgaagtgcagttttgaggaccagttcccatcctgtcccttcctggggagcaagaggtgtgatgttgatggagcagtgatgaaagcagggggaatcatggcaaacacccgctgtgtgatgattagatgctaggcagtttccgtgctgggcatcgtatattcctttcatttgagaagtggtattgcatagtggttagaagcctcagtgttggacccagacttctaggttcaaatcctgccccttttatatcccagttgtatgacctgggacagattactcaatgtttgagcatggtatttttctagaaggaatatgcaatttaaaatagccatagtttcatatccctgctctaccacttcccagctgatgatcttggataagttccttaaactctctgacctttgttttccttgtttacgaagtggagatgataatagagactgccgcataggactgctgggaggattcactcagttcacttacgtaagttgcttagactagtacctggcatagagtaagtgcccaataaatgtttgctaattatatgaaatagacatgatttgcccaagtttggttttgatttatatttatgaaaagttatttatctgtgcaaatgaggtgctaccaagaggtaagagcattcttagaactctgttttgagcattagaaattgttatcaaggacttatttctgagaacagaccagtggattggttgttccaacatttatggtttcttagaacctgaagctaaacccgaattctgctatcttgatgacattttcagcagacaggcttcccagttcatctctgttttcacccactttctcctgacacctggcacccaggaggctggggaaagttgtttgaacttgagtgcatacgtgatcgagagctttggcatctgagagacctgccttttgtccctgctcccaggttgctaatgccaccttggcctgactccgccgtaagcatctgtgctctgccttagaacctcaagtcaaccccctcataattaatctgattttccccagtcatagaccatcgtcatcacacctcgcctgtctcctcagagagtcgagaaagccttggaaattcttcgacccattagacaagtcagcccagaggaacccagtctgtctacctcttgtgatttgaagcacattgtcagctaaataatcacataatcataaattctaaaaagtaaatagctacattttgccttatcttgaaaatcctctagagccacactatcccaatagaatctaaagctagatgtcagcacagtggtggaataggagctttcaccatcattcccctgtagacgcatcaatgttgacaactacctatggacaagagtgtctttgtaggagtctaggaggccagcagagaagtttcagaacactgttggaggaaaaacatccacaaataaacacattgaagagggtaggaagaactagttttactttatctgtattacccctccctcaaagcagcactgctcagagccaagagagactctctcacctgtaattccttctaagggggaaagcaagagcatagtaagtaagcacccagctcccccagccatccacaacactgcccaagagccccacttctttctcacctcacccagattgctgagataatcagcatggctgagagattgggagaggctgagagcaggaaagagaagctgctggccctctgaagtgttctacagactccatcaggaagcccatccacgagctgcttgagacacctcatctactgttcccaaactctacaccccccacccccagactgagtccctaaatgtgcccccatggacagtgaatgcaagcgtattatgtagacagccagctcaactctgtgggattgggagaaggtacacaaacttgagtatttcaggacaccatcctagggaaaacaaacaggaggctcttagcacctaacctagctttgcaggattgaaagaaggcatgcaaagtcaagaattagccctcaagagggaaaaagaaatgtagagcaggtgcatccatagaaaaggattaagaaagtctcattatccatagacaggctgactggtgaaggcatttctctcctgatgccagtcaataaggattggaggaggagatgactgcctccttcttcaaatgtgaagacagcatttgaagcaacaagacttcaaaggacagcacttcaaggaacatgaaaagttaaggagccatgacatcacaaaggaacacaatattccagaaagcaactactaaaaaatggagatctaaaaatgacctgacaatttaattgttttaaggaagctcagagagctagctacaagaggatacagacaacaaaatcagaaaaacaagagctcaataaaaagattataaatcatttttaaaaagaaccaaacagaaattttggaggtgaagaatacagtgaatgaaatggaaaattcaatagagagtgacaacagcagatttgatcaagtagaagaaagaatccatgaacttaaagacagctcatttataattaccaagtcagaagaaaacagaaacaaatgaaaaggaatgaagaaagcctatgggatttatgggacaacattaaaagggctaacatttgcattgtggaaattctagaagggaaaaagagaaaggggaagaaagcttatataaagaaatgatggcccaggtgtggtggttcatgcttctaatcccagcactttggggagactgaggcaggtggatcacttgaggccaggaattcgagaccagcctggccaacgtagcaaaaccctgtgtctactaaaaatacaaaaaaaaaaaaaaaaataggtgtagtggtgcatgcctgtagtgccagtactcgggaggctgaggcacaggaatcacttgaacctgggaggcagagattgcagtgagctgagattttgccactgcactccagcctgggtgacagagcgagactgtcttaaaaaaaagaaaaaaaaaatgtctgcaaacttcccaagtttggagaaagatatggacagtagaaaaggtaagcaagccaggcacagtagcatgtgcctgtagtcccagctacttagagggctgaggcaggaggatggcttgagctcaggaatttgaggctgtggagcagcttcgattgtgcgtgtgaatagccagtgcactgcagcctgggcaacataactagactgtctctcaaaaaaaaaaaaaaaaaaaagattaacaaaactaagagttgatttttttgaaaacataaacaaaattggtaaacctttagctagactaagaaaaaagagagaagaccaatgaataaaatcagaaatgaaggagacattgcaactgatactacagaaatacataagatcataggagactactctgaactgttacacaccaacaaattggataacccagaagatatgaataaatttctagaaacatacaacctaccaagactgaatcataaagaaatagaaaatctgagtaggccaataatgagtaaggaggtggaaccagttatcaaagatctcccaggaaagaaaagcccaatgcctactggcttcactggtgaatgctaccaaacactttttaagagacaaggtctcgctctgttgcccaggctagagtgctgtagcacaatcatagctcactgcagctcaaactcctgggctcaagcaatcctcctgcctcagcctcctgaataggtgggactacaggcatgcaccaccacacccagctaatttgtagggatgaggtcttgatgtgttgcccaggctggtctcaaactcctggcctcaactgaattcctagcctcaaggcttgtcctccctttgctgggccactgtgcccagactctaccaaacatttaaataagaattaataccaatccttctcaaactcttccaaaacactgaaagggaaagaacatgcctgagttcattttatggggccagcatggccctgataccaaatccaggcaaggacatgacaagaaaataaaattaaaggccaatatatccaatgaacagagatgcaaaaattctcaacaaaatactatcaaaccaaattcaccatcacatttaaaggatgatatgctgtgatcaggtgggatttattcctgtgatacaaggatggtttaacataaaccaatcaatgtgatacacaacattaacagaacgaaggataaaaattgtatgattattttaatagatgcagaaaaaggatttgacaaaatttaatgccctttcaaaataaaaactctcaacaaattaggtataaaggaatgtacctcaacacagtaatagccatttatgacaagcccacagctaacatcctgctctatggtaaaaagctataagttctttctttcagatcatgaacaaaatgaggatgcccattctctccacttctattcaacatagtcctggaagttctaccaatgcacctaggcaagaaaaagaaaaggcatccaaatcagaaaggaagaagtaaaatagtctctgcagatgacatgatcatatatatatatagaagaccttaaagacaccaccaaagaacttgttagaactaatgaacaaattcagaaagttgcaggatacaaaatcaaaatacaaaaatcagttgtgtttctctatgctaacaatgaactattcaaaacaatataagaaaacaattgtgtttacagtagcatcaaaaagaacgaaatacttaagaataaatttaaccgaggaggtgaaatatctgtacactgaaaaatagaaaacactgatgaaagaaataataatacctaaataaatgggaagatatcgcctgttcctggattggaagaattaatattgtcaaaatgtttgtactacccaaagtgatctacagattatacgtaatccttatcaaaatgccaattattagtataatttgtttccatagaggaaaaaataatcccagaattcgtatgaagccacaaaagaccctgaatagctaaagtaatatggagcaagaaggacggaggtatcacactttctgatccaaattatattacacatctataataatcaacacagtatggtactggcatacaaactgacatacaaaccagtagaacagaatagaaaacccagaaataaaccccacacatacgtggtcaactatctttgacaaaggcatcaaggatacagaataaagcaaggatagtctcttgaataaaaggtgttgggaaaactggatatccacataccaaaaaatgaaattggatagatgcatttcgtagcatatacaaatgtcaactcaaaatggactgaagacttaaatatgtaaaacctgaaaccatagaactagaagaaaacatacttggggggaaagcttcatgacattggtcttgacaatggttttttggatatgacaccaaaagcactggcaacaaaagcaaaaataaagaagtggtactacatcaaactaaaaagtttctgcacagcaaaggaaacaaagcaacaaaattaaaaggcaacctgtggaataggagaaaatatttgcaaactgtatatccaataagggtttaatatccaaaatgcataaggaactcatataatacaactcaaaggcaaaaataaaaaagaaaacccacagattttaaaatgggcaaaagacctgaatagacatttttcaaaataagacatacaaatggccaacaggtaaaggaaaaggtgcttaatgttgcttatcagggaaatttaagtcaaaattgtcaaaattataatgaggtatccctgcagacctgttagaatggcagttatcaaaaagtcaaaagataagtgttattgaggatgtggagaaaatgatatacactgttggtgggaatgtaaattggcatatcagttatggagagacagtatggatgtctcttaaatacttgaaaataaagctaccatacgatccagcagtcctgattctgggtatatatccaaaggaaataaaaatcactgtcccagaagagatatctgtactctcaagttccttgcagcattattcacaatagccaagatatggaaacagtgtgttcattaatagatgaatgcataaagaaaatgtctgtcacatacatatctcatttatgtgtgtgcatattcatatatatatatatacacacacacatatatacatgtaaaggctcaattgtgtatacacatatatgtatatgtgtgtatgtgtgtgtatatgtatatataattgagtctttaaaaagaagaaacatttgtaacgcatggatgaacctggaggacattatcatattatcatctaagtgaaataaaccagacacagaaacacaaatagtgcatgttttcacttatatgtggaatcttaagaaagtcaaactcacagaaacagaatagaagtgtggttaccatgggttgagcagggtgttggaggaatgaggagatgttggttaaatacaaactttcagctttaagatgagtaagttctggagagctaatgtacagcatggtgaccaataataataatgtgtttttatactagaaatttgctgagtagatcttaaagattctcaccacacacacacaatggtaactgtaaagtgacagatatgttaattagtttgattgtagtaatcatttcacagtggatatgtacacaaaacatcacattgtataccttaaacaatgactaataccattttgttagtcatgcctctatacagggatgccttctgaaaatgtatcactaagagatttcatcatgcaaacatcatagagtgtatttacacaagcatagatggtataacctattccacacttaggctatagggtgtaacctattgcttctatgctataaacctgtacagatgctgactgctgtaggcaactgtaacacaatgctaagtatttgtgtatctaaacatagaaaaggtacagtaaaaatacaatataaaagaaaaaaagtggtacactagtatagggcacttaccctgaatggaggttgcaggactggaagttactctgggtaagtgagtgagtggtgagggaatgtgccagaacaatactgtaagccaccacaacacttaggctacactcaatttatttttaaaatcttctttcttcagtaataaccttagcctacagtaactattttactttataaacttttaaaaaagttttgactcataataacacttaaataacacttaaaacacaaatacattgtatagctgtacaaaaatatttttatctccttattctatgtctatttaaaaatttaaaattttttttctgttaaaaaattttttttttgaccctacacaggtcaggatcatccatatggctgtccctcacctctgcatcttgtcccactggaaggtcttcaggggcagtaatacacatggagctgtcatcacccctgataacaatgccttctggaatacctcctgaaggctctgcctaaggctgttctacagttaacttttgttttaataagtagaaaaaaataagacctgatgtggtggctcatgcctataatcccagcaagtttgccaggccaaggcgggtggatcacctgaggttaggagttcaagaccagctgggccaacatagtgaaaccgcatctctactaaaaatacaaaaattagccaggcatggtggtgagagcttgtaatcccagctacttgggaggctgaggcagtagaatcacttgaacccaggaggtggaggttgcagtgagctgagatcgtgccattgcattccagcctgggtgacagaccgagactccatctcaagaaaaaaaaaaatagaaaaaatatactcttaagataacaataaaaatatagtatagtgaatacataaaccagttatatagtcatttattatcgactgtgatgtactatacataattgtgctgtatttttgtgtgactggcagtacagtacctttgtttacaccagcatcaccacaaacatgtaatgtgttgtgcagcaatgttagtgtctgtgatgtagacatcactgggtaataggaaattttcatctccatgataatcttatgggaccaccatcatttatgcagtccatcgttgaccaaaatgtcattgtgtagtgcctgactataaaacctttttctacatttataatctcagcaaagttaaaaaaaaaaaaaaaacaggaataggttaagttcagaactgggcttgaatttaaaatccccactattaacaccaccactattgatttggtttcacttaaacatcatcttctgtcccataaattagtgctgttatttggaaatgtgtctataacacttcgctcaattttaatttgtatctttattatagctttagagttgttagtgtactagtacatatattaaggcttatagttatctgtacatacatattctactaactctataataaaatttgttaacacatggagcaaaaaaataatctcaagctagcttaacaatggcttctgtccaaactagacccccagtaatattgggatgactgaagtctcatgcagagaaatatgtgtgtcttcacagttcttatatttgtgaccattcagaactatatgaagatataagccaaaagaaaattggtgatcttgaatgagctgttttgtgaggattataagtccagatactacaggaagtatcaccctggattcagattgcctgaaaaatcaaatgtgtatctgtttttacttattcaagagaaatattttgagattatccttcttactaattaacaaattaatatgatccaattaaactataattaaggtacttaaatcaacaaagatgagactctgttgctaggttatatgtggaaagagcaagcaagcatttttctcttttatcagaattagattttcccaaagcctccactgtctttgaagactttatctagttcagaatgctctcttccagttgggggaaaaataaaaccacaaaacacagttcactagagaccctcagataaattgtagctatttgttgatctgatcagccctgccacggttactatggaaaccagagtactttcagatgaccttttagacacaaaacaaaaaaatctatgtgccccaatatgctctctgcttttttgtccctaaatagcttacttaattacttccttaactgtgtgatgttaagggggaaaaaaatctataaaatgcacagcagttgaaagagatattttaaggcttatccttcagctttgtcttagaagcaaagtcttaaactgatataggagacaggttagtagtagaaatcattttcaaacactcattagatcactgccaacagaggttaacctggcattcagctgagcagacccaaaggaagcaagacagcctctgaaagcaactgtacagaatttctcatgagtctgtaagggagggtgcatgcatttatattagagtgctggcagcatgctttcagtttaatttgtctcgaggaaataattttgttgggaaaccaaaaaagattgtgcattctagttgtctgtctaatgaattcctgaaacagcataaaagccctgtgtcttgtagttacagggatggccttgtgggtggatgttgctggttgaagaaatattagttaatatcacacaagcctgttattaaatgttagaggcagctttgcaaatgtccccaggccctggtacccacaggggatgagcaggtaccaagggtgccacccttcatttacaggaactggaaggagggaagacagagccgatgtccactggcactagcatgaacatggcagctaaacattggcacaagtcttcatggctctatctcaagcacctaagaggaaattaaagccccctaaaataaaattaagggacctagaataagggtgacaccaaacataatgctatttgttgttttccccaaaaaacatgccctacagagaattaagattgcctgtccctggagcggtaaatcgcaagggttctgacctccctgggtatcctgaaagaggaagtggcgagcagcttgagctctagatcttgcacctccaagtatgggagctgattaataatgcagaggttcagagcccagcccagcctctgacccagtcagaatattattttaacaaggtccccaggtgattcctgagcccattaaagtttgagaaatgctggtcaagaagatgaaacctgttgactgatgagtaaacaaattcagtctcctgtggtcgtaaagacagcaaggatagacttcatcacccccagtacccatattaaatagcgaagggatcagtgaactgtgacccacacccaaccacctgcttttgtatatacagtctatgagctaagaatggtttcaaggctgggtgcggtggctcacgcctataatcccagcactttgggaggccgaggcaggcagatcgcaaggtcaggagatcgagaccatcctggctaacacggtgaaaccccgtctctactaaaaatacaaaaaaaaaaaaaattagccaggcatgatggcaggcacctgtagtcccagctggaggctgaggcaggagaatggcatgaacccgggaggcggagcttgcagtgagccgagatcacgccactgcactccagcctgggcgacagagtaaggctctgtctcaaaaaaaaaaaaaagagtggtttcaggatttttaagtggttgaaaaaaagaaggatatttgcgagacatgaaaatttggtgaaatccaaaatctggtgcctataaatagatttttattaacacaactacattcattcattcgtgtgttgtccacagctgttcctttgctaccacggcagagttgagtccctgcaaaagagactgcatgggcctcaaagcctaaatgtatgccctctggtcctttacataaaaagtttgtgacctctgggttaatggaataatagggtattcaaactgggagagatgtttaagattgtgtttgttgatggggaaacaaaagcaaaagggagtgtgttcaaagcttgttagtgcaggacccagacctcctgtgtgagttgatgcttctgtctcataccctgtcccttcccacacacccttccctatgacacccccttttctgactcctctccattcatccaccatgctcattaatgcatctcagcccatgcttgtgctccttggaaagaccctcccttctcctccacttccgtcagtcctaggcttttcaaatcctacaagtccctttatgtggttctctggcctcttaaaattgccttgacttatgcagtctaaagactactcacttgccagacacacctgtaagatgtgtcaccttcctgattccagagtaagaacctcaggccctcctctgaatactttgaagtctaaacatcaggcccatgaggagtccacccttcacctgcacttttttgacagcccagaggaaggtgtctgagccaacatctttatgaggctggttggaggccttcaggggagaggccattttagagccacgagaacctccctttcttcctctagcagttgtgtaaaactcacgtgtgtgacaaatctggttgctcttgaagatggaccagtttctttcccatacattttatggttccagaaatcagtaattctggacatttctaactggtggatgctgcatctactctgtgtcaagcactgtccctggggctagagacagaaccttgctcttgggaacattgtggagtagtactaagggatatgagaccttgtaccttatctccactttctggaaacgacccctgaccctcatagtggagggaagcttacaccctgtctcctaaacagtagctagcctagatcagcgggagtctgacccaggccacaagtcagttctttgtccacgtagcagtatctccagctcttgagatgctgagtaagcctcactgctgaaaagattatggctcgcctgatgtaacatggcttttataggcagctagaaccacagaggcctcagagaattcaaaatcacagctccctacatggggtccaggaacgtgtggccaaggtgctcatggtgttgtattttggttttagtttgttttcagggatgaggcctctttgcccattaggactgtcgccatgatgtacacatgatggtggcacttcccagttcatcaggccgaccaagtggggccatagatgtccttgttcaggaattcagggaactcggtggctgtcgtgtcttcagcacttaattgaaaacgaagtggttaacatttggcactagtgcagcttcctgccatttgccactttcaccttgagcagaggtgttttgcttcctcatctcccttcccagcatccaggtgtgtggtccgggaaggattccctgggacctcttgcagatgtgtagagcaagaggtgctgtgcgtatctgggctgggtcacttcagcctttcctttgatttttttttcccagagaagatttgggatggtttgtcatgtccaagtgtgaaacagccttagagttctttctaggtccatttgagtctaagaataactacccagtggctgccggaaggctgtgaagccacatagcaattgtatcaaggtgtctctgctaaatgttttttgtctccctgtagaaagaagcaggtgacctattgcagatggcagttggagataggaacctcctaaagtcatgccatatacttctcagggcatcccagctactcaatacagagtaccctatgcctatagatatccaagcaaagatcaggcaaccctctgagaaagatgtaggagaaatgcctgattaaatttcctctaaggctctgtccaataccaagattgcaataagggtgtttttgttgctattgttagttccctttaatcttgatgtggattaagatcgctatcctaaaatagagtttttggggttggaacaaaatggcctattttaggaacaatcataaatggatttgtgattactgacttttaaaggcccataatgataaattggaatagaagataacccatacctggtaaaagagatgcaaaactcatgatttgactagtttctcattttagtagacaaagccttactgagcacgtaggattggtttgcctctgatctcctctgttcaggttcagggctgtgatgacccattcaggctgtgggattttggttcagaaatctgatcatctgatccctctcaaattctctcctggaagccacctctcactgcttatgaagttgggggattacccctatgaatccttgtagagaagtctcaccttcatgaatccttgtagagaagtctcttttgagatgatttctttttttttttttttttttttttttttgagatagagtgttgcttttgttgcctaggctggaatgcagtaacacagtctcagctcactgcaacctccactcccgggttcaagcaattctcctgcctcagcctcccaagtagctgggactacaggcttgagccaccacacctggctaattttgtattttagtagagacaaggtttcaccatgctggccaggctggtcttgaattcctgacctcaagtgatccacccacctcagcctcccaaagtgctgggattacaggcatgagccaccatgcccggcctcttctgagatgattttaacttatttttctcacattagtacttgagaaaggaaagttatccagttaagataggtttttttttttccctttttctttttcggtggaagttgaaagtaaaaagaaaagcaaaccctggttgtgtggcattcagtcaactggagcttggttaactcactgcccaccagcttatgtttcgtcagtcatcttgggcacttccaagatattgaagagccttctgaatcatcaagaaaaaacaaaatcttgttactaatagttttcatggtaagcgggtttggtttcatcatcatttattgaaaaatggcaatctgtatataacattactgggcaccttgctatgtgctacctcaaacgagtcgattcgccaaatactccaggaccccgtcatgtgaactggccgatagcaaaacacatccctgaatgtagtggagctgtttgatgtgagaccactttcagacatggaaatgccacaaggaggagagaagggtcctgtcctcataaagcttgattctaggcctttcactattcaaacaaggaagagttacttcctacccctccaagggtcaaatgagacctgcacctggggtgcctccggagcagagtgcactggaaggttcaccgcaccttctctcctgaccctggtgctgtgtctcggggtcaccgtctgtctgctgtgcctgcctgcatcataattggaacctgtgctgtgttgtactcaatctcgttttctcacaccactaattgtgtgtagcacttcctgtgtgtaacatttctcctactaacctggcagtttttctcctcctcctgtcttttacagggctgtcatgtccgcttcttaaaggtagttcttcctctgctctttcctcatccactttccttccacaaaacacttgccttggtttttgtggctcccgggcctcagcctgcagccatgctctccacccttaaggatgcaccgcgtgttctggtagcttgaatctcacacctacttgtgtcttagtctgtgtgctcccttccaagcagccacggccctcccatgaaaaaaaatgccatgtcttaatcacccagagaatagaccagtctcccctcctcttcagattaggttagtttaaaattttacctgctgggcacggtggctcacacctgtaatcccagcactttgggaggccgaggcaggtggatcacccgaggtcaggagttcaagaccagcctgcccaacatggtgaaaccccgtctctaccaaaaaacaaaaaaaaaaatacaaaaattagccagtcatgatggcaggtgcccgtaatcccagctactcgggaggctgaggtaggagaatcacttgaacccgggaggcggaggttgcagtgagccgagatcgcaccattgcactccagtctgggtgacagagtaagactccatctcaaaaataaataaataaaataaataaataaataaataaaattttaccaagcaaatatcaaaacctcctatcagtgattaaagttcaagtctgtattgaaagcatccatccaatgaacagaaagagtgcatctttaaatggacagctcattttcctttctttctgttaatatctttcaatcacatatgagttaagattcattttaagttttataggcatacatctgcattagcatgcaatcagtatggtgtatttacactacatgagtgtgttcatatggatgatgtagtgtaatatatcataggctgaaatcctgtaattgttctgatgttcttaatgcctgacttaatccttctcactcttatttcattttttctcattttttaatgttttcccaactcaatcgttgcaatctaatcaaccattctatccccaaactatggaggggaattttgcaacttgcatgtaaatggttttaaaaacctggtctattattgtcatttctgatagcgccactctcttctgggaagctggttagggccacacaccagctgtgctctcagcgtattgcctgtgttcgtaattaaaatcagcccaagattgtcgcagtgcttttatgttcgcattagatcaaactggaaaatttaaaccctcaaatgctcgggtggaggatttgcaaggggagaaaccctactccccgaccccaagctggaatccacatctaatgctctctcaaaaacactgtcctaaagacagcatctaataaataatgtttttagagtttctcatctctagaacttgtatctcaccctgcagatgtgcctgttagaggaaccacaggagatttgtgacctagagatactggaaatgagaaagaaaaaaaatattccttgaggtttcctaagtcttgcagagtgtggtaaatactgtgtgtgaaaactgcctttcaaggcttctgttgttactgccccccctccaccccgcccttgtctgtgtttgaaaaccctgtcccatgattcaatgcagggtgttgactttggatacacatctccagaggctggccacacctgaatacactgagcctctgtgcaacttcttcctgtggagtaaaaccctccagcattctcagaggaaagaggcacctcttgatcactccaggaggtggaaacagttcctgtttaaaaaccaagtaaacccctctcattgcaccccctgctacttcagaggaacacctccattctgatggaaggaactcgtacttgggtcctggaaccctatttgggacccaaacctctcccacttgtgtggcctgacgtgcctgagtgctgtttgtgtcctttttattatgttgaaaactttgttattccaaagaaacatctgaatcacagagcttagtttcccagcatgtcggaaagctgggtgctggtgtaaaaaactcagatgtggctgaaaagggaagtaatgagaggggagaaaaataagaagaaagagttagggtgaggctttcacctccctgggttcttgcctggctcctcctagctctaatgaagggctgtccctgtccccttctccttaaagactgtccctcttctcccacctgctgggcaacgtggctgtcacctcgtcattccaagaaggcagcagggtgtggcgaggaagtgccacactgcctgggttcaagggttcaaatcccagctccaatatttcatagctgtatagcctggagccatgcagctcatctctcttgcctcagtttctccaagtctaaaatggaaatggtaaaaggaccaacctcctagggatgttgggaggattaaatgagtaagtatggaaggtgcctagaacagtgcctggctagatttgtgtttgctgcagtcattactcagccttttctctgccttccatccccaggaattatgaattacagagttttccctaatggaggtgtcactgtgcattgctggtttccaagaagccattgccaagttaaagtgaaccctttgttgtccttttttttttttttttttttgagatggagtctcactctgttgcccaggctggagcgcaatggtgcaatcttggctcattgcaacctccacctcccgggttcaagcaattctcctgcctcagtctaccgagtagctgggactacaggcacgcgccaccatgcccggccaatttttttactttttgtaaagaaggggtttcaccatattcaccaggctggtcttgaagtcctgaccttgtgatctgcctgcctcggcctcccaaagtactgggattacagtcgtgagccaccgcatccgacctcattgtgctttctaaaccactcccgggccccagttgggagaccccggttgtacattaggtacaaataacccatcagataggaatctgctccccgtaccccaccctactcccacctgcagcagtgaagcaaggccatcttgaattcatttaagaacagagatgagaagtgtcaagtcaacaaagtctcttttctgacatgttttgtgttggtgcttattatgtttcctgtgtggttttgttatgaggacaagaaacaggctactctacctgagaaagaaaatgtcacccgcatgttggaaattcaccctgacccaggcagtgataatagcgtgccaccgctcgctcacacctctcttcaaagtggcttccttggcttggtcatgagctaatctttaccttgtggctttttctgaaaatagacttgtcaacactcagtccgagtctggcccccagtcactggttttctctgttgacaggctgcaaagaatcatgcaggaagggctctgtccatgaattcccaatggtcatgggtggtcagccagctcagagctgatggtttgggtgggggcaggcaggacacagccatagtctcagctcttactaggggtattcgttttgtgactcacattcccccaggtgctcacagcctgtagatacccttagggtcacaataattgtattaatttagactccctggctctctcctggcccattgacaaaacctctgttcacttccaaagcccagcagttgcagctgggagatcccaggagtatctcgtgcggtggtgaagtgatccgatcacacacctttcctctccggtgtgaggccctctgctttgaggccacttgcatcccagccatgttcccccccacccgctgcttcctttggggagaatgcccccttgtgagtccacgcccccctcaagctgccaggcctcatgcatggggccagagagctagggtgcaaataccatgtgtaaagggaaaagtgtcctgacctcagctgcccttgtgccctcaggcctgtgcccaccgttggagacaggaaacacctacctccaccttgccctcaggcagcccctcctgctggagaccagctcctcagtcctgtccaagtcccctgagggcagctgggaagcccctgtctttttaggagaggtctcactgttccaccccctcgtctcttcccccttcctggaatggaaatttgtcttctgacgctgccacctggcagcaggcgatggctgtggcgagactactcagaatggcagcagccaccagccccgagctctgatcactccctcaccactgcaggatggcgaggctcccaagcctgcaggacgagaaagggagtgttgacccattttacagatgaagaaacaggcctcagagaagtgtgcagtgcctttactggtgtcccagaccgctgctggcagaccccagatcccatgcttgtcaccttcctgagcgcctagtgagctgcctgacacagagggcccagagaatagcccagaacagtgcagctgctgctagccttggaagcaggtgtcccattgagctataattaggccccttggttttaaaaactggtgtggattaaaaaggctcagtgagggtaggatgaaatcaatgattatggaaatattgtgctaaatttaatgacagtcggccctgctttcaaattgcttgctcctgtcagagacattttataaaaattttccgttgagtagttgagcagtgtatccagcatttcggggataggatgtgttttgttttttggtttttttttttttctctgtgaggatgcccagtcatcctgtttttcctttctgcagcagctgcacagccatggagggaaggctctggaaccttcttccttggggaactgggttttattgccagttatagcttgggtgcgttttttgttactgttttttattgacttcaggagctgctgttctgtgctcgcttagcttcaattggattttcccagaagtggctttttcattgaactctgccctcgtgtaactgtcgttacttctcactattttccaggtcgttctttgtttctaagataaacaccgtggctccctcggaccactccagggccccctgcagccctcactgcctcccttccccccaggccctttcttggatctgtggcttgcagagtctgcacccagtcaagggtttggaaagattcgggagacacagaaaggcctacaactgtttggatctttgttttctagaaatagagcacccagagatcttaaaacccacttttggcatctgtagttccgttggcactctatagttccgttggcattttgcaaagtcctggcacttacgtgagtgattcaggtcatctactataaaggatacagttttttttttgcatctgcgtagatacaattttgtgtcttgtttgtgccatcttgccccatttactgggacttcacctcggtaaggcagactagtgaatcttaggtggatctctgctaaaagatcccagccaaactgcagttgcttcagaaactgaataccacaagagggcagtaaagatttgcaaatgaaagattccatgacacctgcacacaacaaacagcaatcaactgttgcctggatgtctttacattttagtggacatagagatgagatcaccaccttgtgctccccattgcttcttggctttagaggatcttcagtgtgctgcaaagaagtcaagggtttcccaagagctggatggctccttcagtctattcttgcttgcactgggccccagcccattttctatctccccgggtttttttttttagcaccagagaattacccacttcgaagccatgttgctgacagtctgaaaaactatttactttgatgatgtttctgagttcatgtgattcttgaccctgccacagccaacccataaagccagtgtggtggtaattccaaaggggagcattcgagcaggaaaaggaataggtttccaaaaatgattaagtgcccaaagttctcgaacaatgctatgtcatggctgttgcagtgcgcactgggccttcctctaagccgggcatcagacgcaagtgtgccatcagctagctccctggtgggagaaaaacattgttgcagatggaaaaacttaaggtcattggtggggaatcctcatgtaagcctggagatttagcaattggggagaacgcggtacaagggcaaaccgcctttccaggaggtgtttagcaggtgagacaaggcgtgcaccaccaagattagcgatcctaacagatgtgtcaattatcaacagacaaatctgggaaacagggaaaaatttggttggctgcaaagaaaatcacacaccgggatactagaggtgaatattatgtggtatgaaaagaaccaagcacttcgcagtttccacatctggcaaagtgccaacacgtcagggtcccacgtttctccttggagaatggctcagttgccatgacaacggaggccctctcgctgcctgtgaatttattttaaccgtggcaacagccaaagtgggtgtgtccatgaaaatatttcttgttaagaaaacgattgaatgtgttgcccttacattttgctctgctgaatacatacttcattcaccaccattgtatggctgcaaaatttccttttcctgtgctgcctggcatagcaagcattgtggaagagcctgaatagtgatttaattctagtgctcttgagattcttaattgtcgctgttgtgatagattaagaagatacagacattgtactgaaatctaactgcaaatgaggatgagtgatttgagaacctgcgtgatacagggcaagggtcatcgaactgcaatccacagcccagaccccagcggctgcctgtcttcaccattaaggctttattggaacaccttccctcctttactcacttttgcagctttcgagctacaatggcagagttggagagttacaacagagacagtatttggcccacaaagccacaaatatttactatctggacctttacagaaaaagtttgctcaccctcgatgtaggaggaagagcactaggttcaaaggctggagttctggattcagagctcaggatggaaaactgatttagacatatcgcggtgccccctgggctcattctcctcatctgtaacatgggcagccttgatgagactatccccaagttgcttttgaattctaaaagctctgtcatcctcctgctgttagtcaaagattacagcccagatggggcaaccttagcacagggaaacgtacgggatgatccagcatctagtttcagggcctctgtagagaacagagcgtccttctcttcctccaccagcactgccacgaagcggcgcagaggctgtggtgaagttagctctctagacctcagcatcttcatctgcatcctaggcaggtcagactccccagggacccttctgtggctgacagtctgtggttctgaggccctcgctgcagttgccagcaggagaaagaatgactcatgcctgtgatttgctggtcacctgtgattcccgcctccgggagaaaactccaagtagcaggtgttgacccagttgtgtgggaggaatcacccaggcccttatttccaggttgcacttacagatcggattgtgcaaccagaaaaatgccgtcagaaggaagtggggtggcttgggggactgacttactaaggatcactgttaagctctccatacaaattagctccccttctgtcttagtccactcgggctgctatagcaaaataccataaactgcatggcttacaaactgcatatgtttctctctcttagttctgaatgctgggaagtctaaaatcaaggcaggtgaggtgtctggtgaaggctcactttctgattcacagatggcatcttctggctttgcccacacatggtagatgggatgaggagcctctcaggcctctttttattaaagtttttattatttagagacagggtctcattctgatgcccaggcgggagtgcagtggcacaatcactgttcactgcatcctcgaattcctgggctcaagcaatcctcctgcttcagcctcccgagtagctaggactacaggtgcacgccactgtgcctggctaatttttaaaattattttttgtagagatgggggtctcactgtgttgactaggctgttctcaaactcccagcctcaagctatctttctgcctcagcctttcaaaaatgctgggattagaggcatcagcctgggatcacacccagcttccaaggcctcttttataagggcactaatcccattcgtgagggatccaccctcatgacctagtcaccttccaaaggccctgcctcctgacaccatcatcttggggctaaggatttcaacatgtgaatttgagggagacacattcaaaccatagcaccttccaagaccactttctgtgttgtggaagaaaagatgtgtttttgttttgacatctgaacataaaacacatatacacagccacatgtgagaaagaagtacagttaaaaattccaactgtgaatttagacacacaacccaaaagaaaccaagagcctgccttcaggaattaggctgccttgactctgggcttcttcctcttctctttgactattcatggtgagattaaaatgtctgtccttgtgcagctgggcacaagggtacttgtttgtgacctccccaaaaaggtcacaaacaagtaattaatgtttcattcatccaggaatctatcctggggacttcaaggatgcacacatatttagaccacaaaattgttcatctgcatgtcattgaaaacagaactaggaaaaacctaggtgtctaacaataaggaatggttacatcagctacagtagagccgtgtagtaggatatgatgcagtcactcaaatcatgtggcagaagagtgcttataaccagaagttcacaataagcaaaggggagaagcaggttacaaacaatctgattctatctgtatcacataggaaatcatgaaaagaaaggattaggaaaatgtccaccagaatgttattaatgattacctctgggtaataaaattataagattttagtatatatgctgccaaaatgagtataaaattttagatgttttaggccagccgtggtggctcacatctgcaatcccagcactttggccgaggtgggtggatcacttgaggtcaggacctcgagaccagcctggccaacatggtgaaaccccgtctctactaaaaatacaaaaattagccaggcatggtgacatgttcctgtaatcccagctactcaggaggctgaggtgcgagaatcgcttgaacccaggaggcagaggttgcagcaagccaagatcacaccgctgcactcctgtctggaagatagagcgagactccgtctcaaaaataaataaaaataaaattatagatgttttaaattttgttctcttttttctgatgtatccatgcctgttagattttctaaaatgagcaggtatacttttacaacaagaggcagccttgctgtagaaattattttaaagcaacatttctgcctcttaaaaatgttatatgaaaagctgccttccccatatactctactcattgcttctgcaaatatttgaggaccaccatgccccaaacaccatcctaggcactggagctgtgccggggaacaaaacagacgagccgtgcgtgctcatcccagtggccgaagaaagtaacaaacaagtagagaaatacaggattggtaatgagaagagagggagggagtatgcaccacagaaaccggtgcagggacaatgtcagaaggagtagggagcctcggggctaaagcatcctttgagcagagatagaagggagtcccgtgcctatctgggtcagaggaagtgcccaactgcaaaggccctcaggcggcagcgtgcttggcgtgtcccagcagatgaagtattgagccagagaacagcggacattttatttactctaactgtgctacccaggaggctgtcatgcccattaagtagcatcattttaacctgttgccccgttaccgagtagaagataatagatatcatgacttggagcttattagaaatacacaggccatattccactaacgataccgtgaaaaccctcagttcctttgtggctttctgcttcgaaacacttgatctctcttaactaacgttgcagtgggtgcaggtaaaggcattaccttagaggtatgatgctgtgctgggcatccttggttatatatggcatggctatttctgttaaccatgccctgttacatggaatagcaatgaatcaccatcagtgttgttttgccagtgttgttcagattagctgtgaatacagaggactttcatcgttgtacaaaaaatggtaggagaaatccacaattattcatttgttcctatggttggtcatcgttggcctgtccgtggaatcttagaagtagaaagaagcttctgttgtcatctctccacacgttgcaactgtctttgataagtatattactcaaagccttattttcgagaatgctaagagatcatgtatttttgaagacatatttacaaaataggtgagaatgaacacatttaaagtggaatgtagttacgttactggaaagaagtcccaatccagaccccaagagagagttcttgaatttcatggaagaaagaatttggggcaagtccacagagtaaagtgaaagcaagtttactaagaaagtaaaggaataaaagaatgggccgggtgcagtggctcacacctgtaatcccagcactttgggaggccgaggcgggcggatcatgaggtcaggagatcgagaccatcctggctaacatggtgaaaccccgtctctactaaaaatacaaaaaaattagccaggcatggtggtgggcacctgtagtcccagctactcaggaggctgaggcaggagaatggcgtgtatccggaggtggagcttgcagtgagccgagatcgggccactgcactccagcctgggcaacagagcaagattccgtctcaaaaaaaaaaaaaaaaaagaatggctactccataggcagagcaacccccaagagctgctggttggctatttttatggttatttcttgatcatatgctttaaaaggtgtggattattcatgagttttctgggaaaggggcaggcaattcccagcactgaggggtccttccctttttagaccatacggggtaaccactggatgttaccatggcatttatagaccatcatggcactagtgggagtgtcttttagcatgctaatgtattataattagcatataatgagcagcaaggaagccagagggtcgctttcctcgccatcttgattttggcaggttttggctggcttcattactgcatcctgttttatcatgagggtctttatggtctgtaccttctgagaacagtcctgctgacctcttgttttatcctgtaactaagaatgcctgacctcccaggagtgcaaatgcagcccaacaggtctcagcctcattttacccagctgctattcaagatggagttgctctggtttgaacacctctcacaattagacattaaacagtacttcagaggctgcccaggagttctatgatgatgagatggacccaccgggagccctggagtaatggttcagtttctgattcttaactgtagatgaatctttggacctgtattcatactggagataaatcagcaccccttgtaagaatttctggacagagggctattgtattagaggtcagaaatttctatttttatggtctgtctgattttccatatagtgtatattcattatataaaattcaaacatagcagagtgtctatggtattaagttaaaccctttgaaattgctgttaaggtgggttagactgtcacactgtcacagcttagcagctgcaaacttttaacctattagaaaatgaacgtctccagccatccagcccctcatagatatacaatgtaagtcatttgtcacaaccaccctcaattttaatttgaaaaaacccctaatagggagctgaatgtggagagcttctcacattacacatggatagcttcagacacagatgtttttacacatgtaccataacccccatgtaggcgaatttgggtttgcaatattcagattcattttgtatgatttgctttacagaatgccactgcaggagctctttgaattgttaatagcttcagtgattgcaaactattgtgacttttcaagaatgtatctgtggtataaagtgagacgtgtcagtcatcagtaaattttcaaatgaggagggaacactgcctggtctcacagcctggtcttccaagtggcatcacaatgccaaacttgaaccaaacgtgaatatgccattttttgaggaacctaaaaatcctggattctgggttgttgaatcatagccaataaactgtgaggtactttagtcccattttgaaaaaaagagcatgctacagcttctgcatttaatgtcacttcattctattcacaacattacatattgtagttcccatttttatttccttttaaaaatttgtgccattttattaagtcagggtcttttcctactgcagtcttaacccagaccccttagagggcttcagcaggctttccggaagtcagggtggatagctagagccaagacccattgcctctcctgccccccttaggagggtgtgggagcccacggggatgtgcctcaacctcacaacaggtcatgagctcctgcaaagcccatttgtagcctcacacatctctgcaggtcacaggtttctggtctgtgagttagcccacagaactctagcccaggcagcatgcagttgctcattgaatcccagaggccttcagtgtacagtcacggagcaggtgcatgccagaagcttgaaggaaagtgcagtctcctgcactttgtctcctttctgggtcaaagcaaagaagaccagagtaatgttgggtgcggtggcttctgcctgtaatcccaacactttgggaggctgaggcaggtggatcacttgaggtcaggagttcaagaccagcctggccaatgtggtaaaacccatctctactaaaaatacaaaaattagccaggcatggtggcatgcacctgtaatcccagctactcgggaggctgaggcaggagaatcgcttgaacccaggaggtggaggttgcagtgagccgagatcacaccactacactccagcctggtgaacagagtgagactccgtctcaaaaaacaaaaaaaaaaaaaggaagatgacgaccagggtggagggaataaagcatggggtgctacactagagtccttttgcaaaggataccttatttcaccttcagtgcagtccagagagagagcccagcatagtccagggacacagtcttcttactactatattacagataaggaaccgggggctcagagaggcagtgtcatttgtccagagtcacacagcaaaaatgggtaagattaagatttgatccgagctctttggaatccaagttcagggctctttccagagttgcccactggttttatataataattgaagactgtggacggtggaaagggtctcagagacgagtgaatttgacagggatgttggaacttggagaaatgtcccaactgtcttagatcagcatttctcaaccttaaatgtgcacaggacccacccaaagattttgtttaaaatgcatgtttggacttagtagatctgggatggggcccaagagtctgcatttctgccaagcctctagctgatgctgctggtcctaggaccagtgcccagctacttgggaagcttaggcaggagaatggtgtgaacccgggaggtggaggttgcagtgagccaagatcgcgccactgtactccagcctgggcgacagagcgagactccatctcaaaaaaaaaaaaagaactgaacagacatcatcagagctgaaaggagattcctcctggtgcaggggtggaggacagtttcacaggaggatggcagcactgagagccatgggggtctccagcctgtggactgctgctcagagcctggtcccccaccgctttctttacctaacttggaaatgagtgagatggactcaagatttgggacacatcagcaggagcgtttctaatgagttaatatctgcttgaggtcagcagcccagtgcatgctctgctctgagcattcattcatcttcaggggacattctgtgtttctgcatttcatcctctgcattcagaattttccatttgctcaggcccccagcagggcgtctggccacgttgggccgtgtttgtattgctggagtaaaggatgccagcacacttactcttctgcttcctcaggttttctgaaatctctgcagttaggctgttagcttcagctttatccctagacgtatattgattttatttgcactcctggtgaagtctgaattatagtcatgacaactagagttatgtcaacaatatgcaagccaggaagggcaggtctcttaattctgctgggaggccagttgccaaacaatacattaaaaagctcagagaaagaaaaatggtcagctcagggctcactgttgctcttgagccagagatcccagctggatcttgggcaagccagacttctcagcagaggaatagcccttcagagaaacccttccaagggcatggtttcagcttgctggcctggctaactagtctcgtgtggcctctggggagggtcatcatgtggccaaccaccctaaaggcagagagccctcccagcacttctctgtggctgtcccagcatgaacagtgattgcttgagagaaggagttcagattatgtatgaaggtgcaaatgcatggagttctgggctgcttgtctgcaccagctcacctgactatcagctgcctttttatgttagtttgtcatctggccaactagtgctggctacaagttggcctctgtcagttctgtcagtcttagtgcttaatgagcacaaatgtgaatgaatgagagagagaactctgagttttgaatgcatgtgcctgatatagtgcttggtctcaagatacaaacttgagtaagacttggtccttacctcctaggatctcacaggctagtgaggaagacagatcaataaatccaagaagaagaggctgggtgtggtggctcacacctataatcccagcactttgagaggctgaggtgggtggatcacttgagctcaggcgtttgagaccagcctgggcaacatggtaaaaccgcatgtctacaaaaaaaaaaaaattagctgggtgtggtgatgtatgcttgtagtcccagctactcaggaggctgagatgggcggatcacttgaggtcaggaggttgaggttgcagtgaaccatgatcatgccactgcactccagcctgggcgacagagtgagaccctgtctagaaaaaaaaaaaaaaattccaagaaggaatgtgtgttaagttccccagaagctgacgtagccccatggttttgagaagttcattcctgaagggatcccaggagacatgggtggggagtagagatgggagccaggtaagggtaggacctagccaaggttgtgttctcaagctgatgaccactgtgggcagctggagctcggtcttcttgtgagctggaagaacattctggaacaggcttcctgttcccataactcgggcacctcgggctccctctgcaggagtggtctgaatggaaccctcaggtgttcgcaggtgtgcaggacagaaagctcaggtgtttgcaggtgtgcaggacagaaagctcaggtgttcgcaggtgtgcaggacagaaagctcaggtgttcgcaggtgtgcaggacagaaagcgcaggtgttcgcaggtgtgcaggacagaaagctcaggtgttcgcaggtgtgcaggacagaaagctcaggggatacgggtggggccctgtctgctgcaggttggaaattccagagaaaccaaaaggaggcacttgagttggactttgaaggtgaacagaacagcaagacccctgccctcccagacttgcagtcaggtggcaacggtttccgggaagaaagctaactgggagaaggaaggagtgttggggtttcaggaagaccactgtggaggatgactgtgaacagcagaagagggaagggcggagctggcgtcccaaggcaggagacaggtgggagcttgcggcaggctggcatggctgggaccgaggcggagggagtggtgggaaataagccgagagacagagcagagcgagtgtcctcctcagccatcaaagcactcagccttctctctgtcgtgtgggaagccggtgaatccaggacaggaccactgtcttttttttttttttcgagacagggtctcactctatcacccaggccagagggcagtggcacgatcttggctcactgcaaccttcgcctcctgggtttaagcgattctcccacctcagcctcccaagtagctgggactacaggcgcccaccaccacgttggctaatttttgtattttttggtagagacggggtttcaccatgttggcaggctggtcttgaactgctgacctcaggtgatcctcctgccttggtgtcccaaagtgctgggattacaggcttgagccaccgtgcctggcttctgctgtcattttagcagtagcccgccagcgagagcaacgggacatctttggggaggggttttgctgcccgtgggctaggggaggtccccaaacgctggtgggacctcgacctcagctggtgtccaggctcttgatactgccacgggaaggaattcaaggatgagtcagaaaatagtgaaaaatatggagatttattgcaaagtgaccagtacacacttgagaaagggaaaggcaggcatactccagagagagtggcgtgcaagggggtttggggcctgctacctttatgggcttctttaaggggtgggatattcctgaagattcccagaaaaaggtggagatttctcagaaatgtggtgccacctgtttttacactaaatattggtgttcctggaacggccgtggcactggtgggtagaggattgaggatgttaatgagtggacagtgaggtcccaggtgaaactgggtcaaatccagcaccatgttgggtccagttggtcttagccagcttggcccacatcctgatgtttagggtcttgtgggcccctagcttatgcagttatttcaacatttttttttcttttttgctagtcccgtgaaactgctgcctggaattttctgttctcctgctaccaccttgtattattcctgtttgagttttcttgaagaaatagcagttgagctgggacctgaagaagtgggagaggtcagccaggctagggatgggggagaaacggcaggccagggaaggctgggtcttcaggaagacagaggaggtgctggccaaaggtctggaggtcaagcctcgcgctgcatctgatcttgccctggcgccctgcccacctggaagtcctatatggttcctcgtccccctgccctcaggcatcccccacccccagtgatgtagctgctcggatatccactggctgtctccctcaaccccagcattgattagacccagactgaaagtgggacttgctcaaagccggcccagacccctgaggttgccgtaccgtggagtttcctaccataacagagctgctttcaaaaactcagcattggatggctctgtgtcctttggcagcaaggcctgcaggtggcagcgtggagatggctcagggagtgtgttctgtagtggaaacagaagtgctgctcttgattgggggagcaagggcgtgaagatgctgggtctgctctgatctcagggctggcttgggctggggagaaatctattctgaccctctgggccaggccactgagaagctacctctctgatatggacgtggtcagcctgccctggaccccacacaccggtctgtctccttcccaaacagctgcctgttctaccagcctccagaaactcagctctgcttccggctgaaaagaatctgcccaggcagagcaggaagcgtgtggcgtcctctgcccagctccaccttgtgcgagcaggtgtctcctttgtggatattgctctcaaacctggtgattgatttgagacctgaggccaaggtcatattgcaaataagttcagaagtacttgaatgtaaaaatgcttctgtcagcctttagcctgactgtgagcagtgtctcatgcttataaccagactaatatgataacatgaaactcacaaggccgtcgttaggttatgtctgcagttgaggcggtagatggcaaagtgtgtaaaaaggccccctgcctatctggaggctcatcactgcatcagcccacatcccctgactgtggtggtgacttgtcaaaggaggaaggcggaatgactgtctgggaatgtcagaggagtccagcatagctgggtagaactgcgtgctacagttggaaactgggcattcgttggtagtatgaaccgcaacttcacccaggtgaaagtagtttttaactgtttcaagcatctcagatcagcaagtcagttgtgtttgggtgttttcagatgttattgtgaatcctgagaaaatacgattaatctgtgcctctttctggtaacttttttcttattctaagtcagaagtgcagagcagggtggcatagtcggtattctcatctcaaatttgcacttcctatgtattcttttaaatttagacacaaccaattgggtgcggtggctcacacctgtaataccagcactttgggaggccgaggcagatggatcaggagttcgagaccaacctggccaacacagcgaaaccccatatctactaaaaataaaaaaaaattagcttggtttggtggtgtgcacgtgtaatcccagctactcaggaggctgaggcaggagaatcgcttgaacccaggaggcagaggttgcagtgagctgggatcgcaccactgcactccagcctgggtgacaagagtgaaactctgtctcaaaaaaataaaaattaaaaattaaatgtagacacagcctaggaagtttctcaacttagaatcattgccggggccagtttttagaggactgggctggccctgccgaagtgggcaggccagtatgtgtagcatcacagttcatgttttatctttatgggccttctacgtttccagtggccccaaattcacaggtgtttccactacatgctgccaacaaaggcagagctcagccgtgtttcacactttcagtctggaagcaaaaatatcagggccatctctccctcatgttttaatgtctctggtcaaatgggggcactcaactcatcagagcatgttcacaagccctgagacttgatccctgtatgagcgagttattctttttttttttttttttttttctgagacagagtctcactctatagcccaggctggagtgcagtggcacaatctcacccactgctgcctccgcctccccagtcccagttcaagcaattctcctgcttcagcctcctgagtagctgggattataggcatgtgccaccatgcccagctaatttttgtatttttttagtagaaacagggtttcaccatgttggccaggctcgtcttgaattcctgacctggtgatccacccacctcaccctcccaaagtgctgggattacaggtgtgaaccaccatgtctggccacaagcaagttattgttatcggagaaaagcatcacccaacagcacagcatctgataagcacatttgggcttcagttctgtatttgttcagccagagagctgagtgcatgtcctgtgccaagcactgttagagttgggaatctagacacagctggcagtgtcacagggtgaaccccaaaattggggttcagcctaagaggccacatgggttcttggctttgggcgggagggaattcaagagcaaacctacagagtaaagtgaaagcaagtttattaagaaagtaaaggaataagagggtggctactccataggcagagcagccctgcaggctgctgattggctattttggtggttatttcttgatcaaatgctaaacgaggggtggattattcatgagttttctgggaaaggggcagggaattcctggaactgaggattcccctttcacaccatgtagggtaacttccacatattgccatgacatttgtaaactgtcttggtgctggcgggagtttcctatagcatgccaatgtattataattagcatacgatgagcagccaggagacctgagactgctttcattgccttgttgattttggcgggttttggctggctttgccacagactgttgtattaggggttctttgtgacctgtatcttgtgaaaccagtcctgctgaattcctgtatcagcaggggctcctcctgcaaatgcagaggctccccaagagagcacaagggggctcaatcagtacttgtgggatgaaggcatggtggtgctccaagagggacgacggatgattcctcggaagccttctctgctgctgatccatagtaaagccccttgagtgccttccttatctccttcaccatcatcttggtaaccaccaaggtgttgactggagtgagttcctggaaagagctccagagctaaggtctgctgcactagggagggaggtgcaccctctcattaagaatgggcaggcgtggtggctcatgcctgtaatcccagcactttgggaggccgaggtgggcggatcacctgaggtcaggagttcgagaccaggctgcccaacatggcgaaaccccatctctactaaacatacaaaaaaattagccatgcatggtggcgaatcccagctactcaagaggctgaggcaggagaatcgcttgaacctgggaggcggaggttgcagtgagctgagatcgcgccactgcactgcgcttcagcctgggcaacaagagcaaaactccgtctcagaaaaaaaaaaaaaaaaaaagaatgtatccaaggcaagaatcattgccctagggctcagggatgtggctgtggaggtctagccagggaccagggtcctggacctgtcagcagctgacgcttcttacaactagctccttcccgtcaggcagatgttcaaaattcggagtcttgtgctgggagactcagcccactccaggcttctccagggctccttcggtgacagtgagacttcccgtgggtttactgaccttcctttttctgctgagcccttttaccttttgcctttgacatggactctgaggccctggtgagagtcgtgagggcagggccccctctagagcttctaaaaactcctctggtagctcgcccaccaggcagtgaccagatattcttcaggcgcaaagggcgccttgtgctccctttctttttttttttttttttttttttttttgagacagagtcttgctctgtcgccaggctggagtgcaatggcgcgatctcagctcactgcaacctccgccccccgccccccggttcaagcgattctcctgcctcagcctcccacgtagctgggattacaggcacgcaccaccatgcccagctgatttttgtatttttggtagagacggggtttcaccatgttggccaggctggtctcaaactccagacctcaggtgatccacccgcctcggcctcccagagtgctgggatctcttcttatgcacatcaccatgtctttttgtgagttcaactcttgatttaaaagaaaaaaaaaatcaaaaaaaaaaaaacaacccaacccctgttcttactgtgcatttgaaaatagcgatgaatcatcccaatggctttgccattttaagcagttcctctccagagaacattttcctcccttttggtgtgggtacaagttttcctttatgcagattaattttaaattggaaaatctacaaatacaaaaagcatcagtacacagtttatttcctttattatgttcatggacccgaagcactgtttttcccaagaagtcgactttgacatactggaattacaaccaaccagcccttcacggatccccacgcatcaattctaggttgactgtgtaaagagttgtctcttaatagggagagcagttttctgctaccttgctgactttccctgtagggtgagtgtagctgctgatatctgaacaggtactcaattctcaccctttgttccttttctcaccccatcccacctccaagcaaacattaaactcagttacaacacggtggtttctgtcactctttccccagaaaaatgacccacgtgtttcccatttgtgcttgttatttagaaagccaaacttggccctgctggcaacaaagtcatcagtccctctgaagacaggaaacaaccttccaacaaccttgaccgagtgaaactcacggacttcaatttcctcatggtgttgggaaaggggagttttggaaaggtaagaggacagtcgtctgcaaattgcaggggcttctgcagagaatgtcgaatcagttttgttctcctcgtagtttgcagaatagcacattagatttccctgtgattcaaggtcaggagatcaagaccatcctggctaacacggtgaagccccatctctactaaaaatacaaaaaattagctgggcatggtggtgggcgcctgtagtcccagctacttgggaggctgaggcaggagaatggcgtgaacctgggaggcggagcttacagtgagccgagatcgcaccactgcactccagcctgggagacagtgagactccgtctcaaaaaaaaaaaaaaaaaaagatttccctgtgatttgtacagtcatccagaagaccaccaggatggctaaatggtagaaaggagaggtttattggtggtatcagtttgcaaacccataaaagaaagtctatggtgtgaaatgaaggtgccctctctttgaggagagaaagggcaggttgggttttatgcctcacagggtccatgttacacagtagagtcatccatattcaacaggtttggggggaaagcttgacttatctgtgagggaagcctagcacaggcacaatggatgaacatatatgtaacatgcatcttatgttcactttggggtggggacttagcattaaaatgaggtggaatttgcctaggcatggtggctcatgcctgtaatcccagtactttgggaggccaaggcaggtggaccacttgaggtcaggagtttgagaccagcctggcaaaaatggtgaaaccccatctctactaaaaatacaaaaattagctgggtgtggtggtgtgcacctgtgatcccagctactcgggaagctgaggcaggagaatcgctggaacctgggaggtggaggttgcagtaagccaagatcatgccactgcactccagcctgggcaacagagggagactccgtctcaaaaaaagtaaataaataaaaaaaggtggaagttggctctttagatcaaaaggtgaaccacaggacccaaaaacagtttgtgtgcaggctctgcaagctgctgaaactggcttcaggtctgcagttgcatcacagaaaagaatgtttgtaaggccagttctctgtccagtccaagtcatagtgatctgagttgtcaatcaaagttaggaggggcctgatagctcctactgctagggagtttagcgagagtggtttatcttgtagctgtagggatttagaaatttgccatgccagctgggccctgaaccctcaacccatagataactatttccttaactttaatgttaccagaaaggggtcctgatccagaccccaagaggagggttcttggacctcaagcaagaaagaattcagagcgagtccacagaataaagtgaaagtcagtttgttagagaagtaaagaaatgaaagaacagctactccataggcagagcagcagcatgggctgcttgactgagtatacttagaggtatttcttgatcgtatgctaaacaagggttttattattcatgagttttctgggaaaggggtgggcaattcccagaactgaggcttcctccatcttttagactatataaggtaacttctgggcattgccatggcatttgtaaactgttggggtgctggtgggagtgtcttttcacatgctaataatgcatataatgagcaatgagggtagccagaggttattctcatcgccatcttggatttggtgcgttttggctggcttctttactgtatcctgttttatcagcagggtctttctgacctgtgtcttgtgatactagccctgctgacctcctatctcatcctgcgactaagaatgcctgacctcctgggaatgcggcccagcagatctcagccttatttttcccatcccttattcaagatggagtcactctggttcaaatgcctgcgacattagggtccatcttagtcgctaaagaggcatttatttggtctctcagatcagagtgcacagtcctcacctggtttctacttccttaaaagcaactgcatccaaaaagctatagtgggttcactgtgttgttactatttctcagtgttcagaacagaagggatgctcagaaatgctggttgatgaatagttttcacaactaaaaattaaatgttcacttgtagtaagcaaatacaatcattaagagatactgacatggggtcttcagcaatttgcctgtatctccattcggtttctgtggccccacatttcatagacgcaggaactgatttcaagtctaggttcttgacttgagagattataaatgtcagtcagctttcactctaaggatactcctgaaaaatgtgcattattccagactaatcctgatagagaatgttgagtattcattttagcagccaaaatagtgccattatgtggcagtggcctataccatttacaaatcttggcagcattgaagttttgcaaatgctggagggactgaatttgtagtgatgtgtagaatttacaaatttgcacataaagtttaatatttttatgttccacattgacaaaggtgcacaaactgtcactgagccgtcacctggcctggttccttccctctgccccccaagatatgtgcttacaagtgttcaggttgttcttgacgtgttctcaggtgatgcttgccgacaggaagggcacagaagaactgtatgcaatcaaaatcctgaagaaggatgtggtgattcaggatgatgacgtggagtgcaccatggtagaaaagcgagtcttggccctgcttgacaaacccccgttcttgacgcagctgcactcctgcttccagacagtggtaaggaccctgggaatccctgcgatgcagtacccagctctcagagctacgcctcagcccaaagcttcttagcatccttgttcctttggagaaggctggagaaaggtgtgttgtgatgtcaagcagaggtgactggggaccacctcccacctctctcactggtagatttggggcatgccttctctgtgatgtcctctgcttggcattcatgccatttaattcggcaaacatttctttttctttttctttctttctttcttttttttttttttttttgagacaggatctcactctctcgcccaggctagagtgcagtggcacagtcacggcccactgcagtctcaagtagttgagaccacagatgtaccccaccacactcagctaatttttgtatttttagtagagacgggggtttcaccatgtttcccaggctggtcttaaactcctgagctcaaacgatccccctacgttggcctcctaaagtgctgggactacaggtgtgagccactgtgcctggccttaattcagcaaacatttccatgaaaggttttcttcatgcctggtactgtgctcagactttgggatacaaaaacaaacaaacaaaaaaactcacagtcttggctttttttttttgagacggagtcactctctcttccccaggctggagtgcaatggtgcgatctctgctcaatgcaacctccacctcccaggctcaagggattctcctgcctcagcctctcgagtagctgggattacaggccgctgccaccacgcccggctaatttttgtatttttagtagagatggggtttcaccatgttggccaggccggtcttgaacttctgacctcaggtgatccacccgcctcggcctcccaaagtgctgggattacaggcatgagccaccgcacctggccacagtcttggctttttaagaccactggttccactgccaaacatggcattggagcataaggagacttgattttgtaaaagagcatgttcttgttcaatgccacacaacagggactggcaaactgtggcctattctctatggcttgtgagtttaggaaaggtcacaacaaggaaatccaaagagtcatatatcgtgacacgtgaaaattaggtcaaattttaaatttcagcatccataaacagctgttttgggacatcaccacactccttcgtgtacctgtcatctacagctgcttttgcaccatgaaggcagagttgagttgctgcaagagacactcacagcctaaaatattaatacatactgtctggccctttgtggaaaaagtttgctgagctctgtcgtaaagtaaaactaaacagaggacaaaaaaggacattccaaagcactaatcagtccgttgcagggcttgcaagtggcctacaagaaacagacatggccgggcgcggtggctcacgcctgtaatcccagcactgtgggaggccaaggcgggcagatcacgagatcaggagatcgagaccatcctggctaacacggtgaaaccccgtctctactaaatatacaaaaaaaaaaaaaaaaattagccgggcgtggtggcgggcgcctgtagtcccagctactcgggaggctgaggcaggagaatggcgtgaacccgggaggtggagcttgcagtgagccgagatggcgccactgcactccagcctgggcaacagagcaagactctgtcttaaaaagaaaaaaaagaaacatagatgtttagatgccaccatagtgagacgttgccaaagctggtctttccactcctcagaggctgcccatttaaaatatgactccataatcagtagctgtaattgatgcgattattactattttcaactgcccattgatcagagattgactttctgtcttatgcctctttgaaaactcttgggaggaacctctcagtgcttttgtgttttagaatctcaaaatggctttgcagccacccggagcctctgggtgtgtagcagtggccgcggagtcaggcgccggccactacgtgtcagcctagcgctggcggcacgttgagcttcctgctcccagccgttcccactgactctgaatcaagtcacgccagggagagatgagagcagcatgctcggaagagacaaccacagctctgaatcccagcccagagcctgtaaccctggttaccctgattaagctctggaaagctacaaaacaaagaaatgaagatgaaattaaagttcataacaggaaagctagagactggggctcccagggttgcttcctggctattagcaccagcttcatcatttttttctccctgtgcagcactttaatgtttaatatcctctgtgaaatggggatgttttctagcagagagcagaggtcattatttcactgttaaacccctccatcttcctatctgtcccagcataatgtcctcaggaatatgcagatttatttgggtctatgatacatgcccatcatggggccaacacttagcctaccagtgacagagaaaatagaaaaacagtgtttgggcatattacagatgcaaaagaacatttgattagcatctccatctagagtcccctgtcccatgtccagtaaatatattgagcatgtgtaatcctaagcctgagagatgtgttttcaggagtatccatttaaacacgatactacattagtatggcacgcctcccagacactgcaaaccagcctttaaacatttggaccatggagaagcactagttaaaatgaaataattgccttatgtggattcctcacaccatcccttacttagaaatttattatatgtataggaagatagggaagaatgttcaaggccgttactataatagcatatgtaacaggaaggcacgttgatggagagccattatttcagggttatgtaatgactttatacttcccaaggccctcatgcagtagggtttattacttattctttctttggaaaaaaatgtgaaagagctctaaactgagcacatctgcccatgcagtccccatttaactaatgagaaagcaaaacacaacctgtgaagagcaaaggaagccacttggctggggaggagccctgctcatgtgttgaaccttggtctgcaggatcggctgtacttcgtcatggaatatgtcaacggtggggacctcatgtaccacattcagcaagtaggaaaatttaaggaaccacaagcagtgtgagtattattttttaagtcctttaatttgaacaaccaagtcctaccaactggaaacttccttttttcccccccgcttgagattgggggtctcactctgtcactcaggctttgcctcccaggctcgggtgattctcccacctcagcctcctgagtagctgggactacaggcacacaccaccatgcctggctaattttctgtttttggtagagatggggtttcaccatcttgcccaggctggtcccgaactcctgagctcaagctgtctgcccacctcggcctcccaaagtgcggggattacaggcgtgagtgagccaccatgcccagccccaactgggaacttctgctgggtgaaatgggaaagtgggattctgcccagttttaggttgaatgttataaacctaaacatgggaggcggagggcagatatactggtaggatccatctaagatggttcctaaggagcagtttattctatttccagtatttccaataaactggagatgttgccatatcccatcatcacccaggtccacccttgttgatggagttattcttatctgttgaacaaatggttatcacacacctgctctgcaccaggcactggggttgcgaaaggaacgaggtgctccctttccagagggagtttacactccaccctggaggtggagaagtcacctaacaattaatagtgcgttgctgtaactttagagacttgcgcaggataccaggataacacgtaagcccctaaaaatcggggagagggaagtgcaaccccacgaaatgaccggctcagaggtgggggaagagccttccaggaagagatgtgaacagaggcagaagcaagtccagggaagcagccttgcagctcagcaggtgtgggagatgctgtgagattatttgaggggcgggggaaggggggaacgtggtaggtggggctctgggtgaagagcctggtaaggagcctggctgtggaggagggaagagggaaggcactgcagtggggcttgcaccatcagattcagtttttgcagagctctctgggggaagaaggaagcatgaaaggaaatggtagaggctggtgcaggcgctggtgagaccctttatagataagaaggaatggagctgtagttagggctagaccttggagccaaagaggaataagtgtctttgaaaaacaccctggaggaagaaaagcagaacttattgactatggaggagagaagagataaacctcttccagtgagaccccatttcaggcttgggtcggggcagccaccaaggaggaggtggtttgaggggggagattcatgagctcagttaagaacgttttattggaacgcacctgcatgatgggatgcgggagtcggcagcacaggaggaagacgtgggctccaggtgaagatgagagattcatctgaggggtgtggggagctggaactttggtgctggaaaacatcatctcacctctcaggggccaggaagtctcaggaaacaccagtggagcaagcctaaacaaagggcgagtttagttccgcagtgaggaaacctcgggggcatgtaccctgatgaatgaagtcagcacctgttaataggattctggctgctgtgccatctaagagacacattggaagaatttttggcctgcgagggattatgcaccctagggaagattaactgaaggcagaatagggaaatctttggttgcaagctttaaaagtgtgaagggggatttttctgcctttattgattgttccttttcagttttcagaaatgcctgtccttttcttctgtcttatgttgtagttataaagccttaaaatactcagattgtaaaataaagcttggtcacacaggactgtaaagagcagatagcagagtcaccctatgttataaagtaacataaaggtgtctggtccaatatcctttcattatattatttgtgttgcagaaaagtttagaaaagcatgaaaaataatgtaaagatcacctgtagtaatcccatctcttcaccctccccctttctgtactcttctagccttcagaggtggcccctcgttaagggtttggtcttgatcattagagattttttttcctctctgctcgtgtagacacgtgtgcttattttgagcctcctgcatgtgatatttccacaggcacagtcttgtggcttcttcgacttcaaagactcctgaatgctatgcagatttttaaatattcgcctccttttaatctgagtttcagctattaatgtattaacaattttgaagtgatggtagttactgctttttattatgaattatttaaaagagtaaactcagatatgaatctctccaacactcgcaaggaatgaaaacactagctaaagagttcatcacccactatactttgccttccagggagtaattgtattgtattttcaaacaccagtgtattctgccagtgaataggaaaatggaaattttctttacgccatactcctgatatagaatagtctaactggtatccactctttaaatgattgtatgagaaattactctgcaggcaataagctacttgtccaccttccccataagagaataagaagccggtttcattggttttattagctgtctcattcacggataagctggaggacgaagtgatggagggaggaccgggggttggaagaacacgatgctggtctctgagagcctctgggtctgacattcttttctctctttgatgcttgaatttgagaatgtaaagtatacaggcatctaaggaagcaagtgagaaacctgaagcccgttttcttttgcagattctatgcggcagagatttccatcggattgttctttcttcataaaagaggaatcatttataggtgtgtattgaagccctcctaccagcagctcagcagagaggttagctgggcctctgtgggcatgtcattctggaatggtgacttaagacacagagttgataactccccaggaggaacagagacctgctgggacccaccttcctcctcaccctggaggcaaatcagagccaccttctgatttctagaccgcaaagactttatatcttgtttctactttttccacaagaaaacacatttttctctccattgacagctccttccactgccttttctttggaatggaggtcagggagcaatggaaactgaattcctgttatagatgttcagcagaagaagaacacagggaactggggagaggcaaggaaaaaaatctattgaattaaattctgcctgttagtagctgtgctgaaagtctggtgccaaagaaggaagaatttcttccagtattaattgaagcataattagaaggatatatggcacaggcagaatggaagggacatgtgtatgacccagtgaagtggttctaaacccgtgattttgcaaacctggtcatgtgtcagaccccctgtgtgggacatgaataaatcaaatgattgagactttcccagacgtgctcaattggaatctctagagtcacagacataggcaagattgagaatcactagtccagtcgtttagtaatccattcagtatgcatttaagcacctgctgtagcctaggcacaatattagtctctgaagatatcaacacacattgacttctgatactacagtccagggacttatagttaatattgccattgagctgacaggtattcagatatccttctatttcaccagttccaaagcaaaccatgttatgtcatgggaaggactctgatgttaacccggttccttgcagggatctgaagttagataacgtcatgttggattcagaaggacatatcaaaattgctgactttgggatgtgcaaggaacacatgatggatggagtcacgaccaggaccttctgtgggactccagattatatcgccccagaggtaggaaccccagtgatcgttttctcaaccaggactcccaaactgtaaacgcagccctctcatgggttatagggtcactggcgaatcatgaagtcagtgcatggtcacagccactaaatggactaaactggacaaaacagactaaaatagaggaaataggagagcccattgcacatagtaaggttgtgtcttgcttcctggaactgttgtttgctccatgtgagccagttgcttgggaaaatgtatttgttacatggtcatggtcaaaatcatttaagaaacactgttggctgggcgcggtggctcacgcctgtaatcccagcactttgggagcccgaggtgggtggatcataaggtcaggagttcaagaccagcctggccaacgtggtgaaaccccatctctactaaaaatacaaaaagccagggatggtggtgcacacctgtaatacctagctactcaggaggctgaggcaggagaatctcttgaacccaggaggcagaggttgcagtgagctgagatcatgccattgcactccagcctgggtgacagcaagactctgtccccccaaaaaaagaaatactgttgagtggagggaattacttgtgaaaatactctgcctggaaggcggggtgagacgggggttgcagtgatggtgtattagcagcatcgcggtgatgactgttctaaactgcatgttgtctggtctaggaagaatgtgtcagtgtggttctaagcaaaatggttccaggacttgtatcttgacagcagcggctgtgctgctctgcttttgttataacacttacagaggattttttttcctgttttatgaaacatcccacatgccaatgatagaatgggttgtcactgtagtcactgtagagccaactttccatccacacacagtcctatggatgccacagttttttcccatctgtacccagcatggtggagaccaatggatccaaagctgagctggcttcagctcttcacagagccctcagatgagctgttggcagccggtctcacatttattcaacagattaccccatgcatttatctcagagacagtagggatagtgaaaaaggcacccacaagctcagaagtcagacccatgtgagcttcaatctggaatctgttatttacagactgtgggaactcgggtgagttacttaacgtctctgaaccccgtttcttcagcggcaccttagggataatatcctccttgtagaattgctgtgtggactgaagtgcctaatacaacattttgcatctagtagaccctccatagtcattattccaaaagggaagctgctttttattcctttgtgaagaccttgtagttttatgatatttcaagacagcgtggacacatagacttcatttagaaacttaaattctgaatcgcatggccagaggtgatatgtgatcttgctgcataacttactgggattttcccccaaaagaactccctcattagtacctacagacatgaggtgaaattaaatagtcttatttttcaaatatgaggaatagtcagggtactgtcagaaatacaatctcttgatgtagtatttattctgaagcctgttactaaatgacaggtattaagcaggctgtgattatgagccattcagccttcattgaacaattcagcagatgatgtaaaagcttagtgatggggaatggcagcttttttaggaataaaggtggcattgaacctcatctctattaagaccaggtctctcctgttccgacaaatagctccttgtgttcagtaacacctcagctatctaataacaccaggaacaacagtgtccagtagagacaaaattttccatatcattaaggtttgtccatttgagtgtcttgtctttttttgttgttgcggttcggtatcattcacggtatgagttcctgttgccactgtaacagataaccacaaactcagcagtttaaaataactcagatttattatcatgtggttccggagatcagaagtccaaaatcagcctcactggactaaagtcaagctgtgggcagggctggtttcttctggaagctttaggggagaacctgttgccatccatgccttttccaacatcaagaggccaccacctgcattccttggttcgtggtgtcttcttccctcccccatgcaacgtagcatcttccaatctctctgtcttttccaactacaaccctccagcctccctcttctcctacaaggatctttgggattatatggggcccacttggataatccaggatcatctccctagctcaagatccttaatttgcctctgcaaaatcctttttaatgcataaaggtaatagattcacaggttccagggataaggatgtggacatctgttggggagaggggacttagtctatcacacttgttatatgttggagaacctcctcactgtcctcaacagggacacctaaacacacttctgtcatgtcttggtaacttcgggcctcttcatacacagagaatactctgttcttgctctagatactttcacatctgaagccttcattcccctccttacatctactgtacaagcaataatagaggaagtgaccaccttctattgtctaccgtgtgccaggcacatgataaactttctcttggctgggcacagtggctcactcctacaatcccagtgctttgggaggccaaggcaggtggatcaattgaggtggaagttcaagaccagcctggccaacatagtgaaaccccatctctactaaaaaatacaaaaattagccgggtgtggtggcaggtgcctgtaatcccagctgctcaggatgctgaggcaggagaatcgcttgaacctgggaggcagagattgcagtgagctaagatcgtgccactgcactccagcctgggcaacggagtgagacaccgtctcaaaaataaataaataaataaatacaataaaccttctctcatttaatcctcatgacaagccccacagggaggtagcatcagatctgtgtttcagatgaagtgacagaggtggttagtaacgtgtctaaggccacgttactgagaaatgccagaattaggctttgatcccaagcccaggtcacctccaaacctttgcactgctcactacactaaactgctcgaaacttgagcgactcacgtatccagacagcactctgcgtgcttactgtgcttaagcatggtgccacgagggatacaaaaagacatcagatggcccttgccctccaagtgctttcagtttataagaagtgacatcatactgaccagcaggaatgaaaatctatatgtggattccagtcagctttcgttgaaaacatcaggcaccactgctttggaaaatcaccttaaggttgtttcaccttttttgttgccttgctttttttttttttttttttttttttttgagacagagcctcactctgttgcccaggctggagtgccacagctcactgcagcctcaacttcctgggctcaggggatcctcctgcctcagtccataggttgctggtagtacaggtgtgtgccaccacctgtgcctagcctgttccagcttttgctagcattttttcctcataagtgttcagtaatttggcatatttggccacacgaatacttacagtatagagaaagatcagataggttcaaggtttcaaaatgtgtggaaaggttaaaataatatttcgtgtggaaaattcaaaatgtgtggaaaggttaaaatagtatttgtcctctgtgcaaatactcctgtcaggcagagacaaaatcattatcttgcatggcattctccttaataggcaaagcggaggcttaagtatttatggctatttgttcaaaaaccttgaaatcgattaataccttagcgtctccttaggcagcgaagccgagctgaggcaaaaaatgtcactaacagatgagagtttgaagttgaaatggacacccacagaaggagcactcatcagaaaatgattcctaaagctgacacagagggtcctctttgctttgacatagaaagaattcttcaaggtcaatgagagtccttgagcaggccaagcaaaggcttcatttggatttaatccatctctgaaacttagttattctgggcgtgtgtgatccagtcacaagtcaagtagattccagcagccaagaatcaggctccagacactagcattgcgcactcttgcctggaagaaagagaagcaggaagagtgtctgcttctggcctgtgtcccgagaaccccctactgcagtgagagcaaagcttttcattttatttattttatataattttgttctaagaactttatttttttaaagacagagtttcgctctgtcgtccaggctggagtgcagtagcaatcatagctccatgcagtctcaatctcctgggctcaagtgatccttccacctcaacctcttgggtaactgggactacaggcatgtgccaccacgcctgctaattttaaaaaaattttgtagggatgggggtctcgctgtgttgcccagactggactcaatttcctgggctcaggcagtcctcctgccttggcctcccaaagcactagaattacaggcctgagccactgtgcccggccctgaagtgaagctttttcaagtgtgccatgtagagtcttcctcacagcatcgctatggcgggggctacgttagaccacacacaaaggacatcacccgtgatacactgacttctctgcaccaacctccctgagcacttctgacttgccacatgttagtatgagtagaagttcagtgacttgcccaaggtcacatagctggtaagagcaaaggtgggatttggatccgagatgttctgaccggagcccgtacgttctttttacctattgcattgtctccatagatatgggagaaaaagcaggtgaaagtgagcactcagtttgggccacgttttcttggccactcacttatctcaacgtgaatcagggacctgagtcatgatcagagatgcagtgaatgacgcagaattgcattccagctgttatccccagggagatcccttagaaaccaagggtgatccagccacacgcaagcccctccccagcacgtgggcatcgatctgttggcatattcagggtgccccccgagtgctgggcactgttccaggccggggggtgccgggccagaaagaggagcccagaggagagctgggaggagggccttggggctggaggcagctggaaatcagtgactgcagcccaggaggactgtggattttgagaggtggacagggcagtattctcagcagtaacagatggtgcatccaacacggttgaaatttccagggaagaagcttgcagacgtggttgcctgacctgcagccagctgcctatcagcagatgggcatactcctgggaggactgggggcttcatgggtccagagagctgaagagccattctggggtcacagcttctgcgttcccgccctacaggaatgccagcccactgatgcctgggacagcagccagattcctgtatttttatgtaaaatacacctaattgttccaagttggccctaacatatgttttttaacatgtgtatacaagtgaaattcagccaatgggctatcacctatgacctgtcttcttgaggtcaagagtcctattaatatttggggggagcatattaaagatgggaggaataaagaccaaaggatgtccatagaggtggaagcactagacagccgtctcgttcttggaccccaaggagggcaaatgttcatgaagtcagggtggccagggactgaggaggtccagcagacgggagtgggatgggcagaagatctagccactgggacttgatgatccctgagagagcagtgttggtaatgatgccgggatggggtgagcgtgagcatcagcagcgcagcaggaggaccttcctttgaggacatctatggtaaatggaaggaaagaaagtggacagtcactcccaggaaggcaggctgaaggaagcatcatttacgtggcagaaacttgagccaaagtttctaagccaaaggggaaatgccggagagagagagggagggcgggaaggagggagggagaaagaaggaatggggcacccgtggtaaggatgcccttccctctcagcttcaggaggaaggggaggggcacacaggagacctcacggtggcaggaaagctgaaaccccctccctggccagtctgcatcttcagagggtgacaccaggacgggcgggtattaggtatcttggctctgaattggaaccccctccctggccagtctgcatcttcagagggtgacaccaggacaggcgggtattaggtatcttggctctgaattggaaccccctccctggccagtctgcatcttcagagggtgacaccaggacgggcgggtattaggtatcttggctctgaattgggtatcttggagaagccaaagccttcacaggggccccaagaccctttagcacctgcctccccgccccattccctccctgacctcctccccctgccctccacccctccggagctctctagacccattgcactagctccctttccactctccaatttgccagacctctccatcctcaggccagttcctcttctttttccttccacccagcatgtcccaccccaggcatctgctcagagatcaccttggggaggccccctgccctggtgaccctatttgaacctgcaaacctccagtcccatccaggactgctgactcctgtccctgctgtttttcatggcactcatcccccttggagggacaaagatgtactcctgaactgatttttcagtctatctcaccaagctccaccacgggcagaatttcatctggtgttggctgctgtgcccctaccccagggtctggagccgtgcctggcactcagtgtgtacttggcatgggtgcctgcacgctgcgctcctggatgtggccacctaggaatctgcaggggagacaccgcaggaggacagagatgaagccttggagactgagaggggtggaactctttagccaggtgattggaagggtgacttccaaggccatcacaggtgttgggctgatggtatgtgacagtgcagagaagggccacaccacctcatgtcatcggctgaagagatccagcaggttgggggacctgagtgaaggtcaatgggacatcatcccaggtcccccagacagccccagctgaccccagagacttctcctggcctctggggaaaggattgtagagagggatagaaaataagagtatctaaaggttcaaagagaaaataactcatgtggtatatacatgcagccgggcagtcaggcagtaaattagcactcaccaccaagaagaaagggggagaatgagatacagggagagaaaagccaatcagcaccagcaatggctcctctgagatcagccgcttctgaaccatgggccccgcaccagcccagcatgggcaggagcaaagaaaagcacttgatgaaagaaacagaatgataaaccaaagggcggctttctttctatcaaaggccaatttccctctatggagggtcatggtccagtgactccagcgttgcaagagagaaaatgaagccgccgctttccctcaaagaaatatttaaagagccaaagccaggctttcctttggggtcttctttaagttgtgcgattctcagatcttttctaggaattatgttggttttattatctcatatattgtattgtctgcctgcagctctttaactgtctcataattctccccgccttggagtttaatcagtttagcctcttctctagagcactgggcaccttctgcgatattgtggtctatgaaacaaatgtggcccgctcctttcttctgagcctccccacttccaatcctccctccagaagtaaccagctcctggtggattcgctgccccttcgcaaatgcctgctacatcccagaccagggctgagcaccttgtttattttgtttaatcctaagtcaattctaattcctggatggtgaaactgaggcacagagatttgttaattttccccacctccccagttcaatgcagacttggttttgaacacaggactgagcagcttttccctgcggtgactgttaccctgggaggaagggcctgcagacatcagctccaatgctacccaagcaacatgtcactccacatgtgccagtaagctgctctcacaggcctgttattggctttcagagctcagataatgctctgttagatttttactcctggtatttggtggcatgctttaattagccctttatttagggatttgcttaaatcctgtaaaagtgggtcagagatttctgagcttatttcgcctctttctttgtaacattgcccaggcgatggcaggatggaggtgggtatcatgagagattactaacatttgttcatttcttgctatgcgccacgcacttaacgcctgttatcacatttaattcttacaatagccctctaaggtaagtggtattattcatgctttacaaacactgtaaaggagacttggagaggagacgggacctgctcagggctcacagatggcacatggcaggggcagaatgctggcccgccagcctcagagcacaggctggcgccctgatgccatccacggccagttgccacctcagtgtatcacttattgccctgtctccaaatcatatctgtagagatccactagactttgagacttcttggttctggaaaatcttttaatccagctaataaagctcttacgacacaagttattcctaactcacacttcattcctttaccatacaagcagttattttgttctgatgcataattaacattttgcacagcttctctgctgaccccagaggaggcctgagatgagcagggtcctataggtgggtgctgagctgggactcctgcccagcttttccctagcacctcctatgcccctgccaccctcagagggagagaccagggacaagggctgctgcttccttcctcccaggaagcatggctagggggggtctcaggaaacttacaatcatggcggaaggggaagcaggcacatcttccatagccagagcaagagagagagcagggaggtgctacacactttcaaacaaccagatctcatgagaactctgccacgagaatagcactaggcggatgatgctaaaccattcatgagaaactgctcccatgagccagtcacctcccaccaggccccacctccagcactggggattacatttcaacatgaaatgtgggtagggacacagatccaaactgtattataaactctggctacagtactgctattttaagaacttggggtgacatctgtataatagggtataatcacagcatcttcctgaaagcccaactttgagggctcagtgagtctggccataatgacttagcctgcctcagagggagcactccggaaagccttgtccattatttggcagttgtttcaattatctattgatgtgtaatcgccccagaacataatggcttaaaacaataatcacgttgggctgggcgtggtggctcacacgcgtaatcccagcactttgggaggccggggtgggaggatcacctgaggccaggagttcgagaccagcctggccaacatggtgaaaccccatctccactaaaaatacaaaaaattagctgggtgtggtggtgggcacctgtgtagtcccagctactcaggaggttgaggcaggagggtcacttgaacctgggaggtgggggctgtggtgagccaagatcatgccagtgctctccagcctgggcaacagcaagactctgtcaccaaataaataaagttaatgctgcgattcttggagccagggcctccatcaggacccggcaggtggactccttgctgctgcagggacatccctaccatggctctgctggggctggagggcccaaggtatcttccagctattggccaacgccacatgggttctcctctacctggtccttctttccatgcagccacttgtcactgagcttcttgacatggtgctggctactaaaaggccaaaaacagaagccacaggctgctgaagtctatacctggaactgaactgtgttacttccaacacgttctgcaggtcaaagacagtgaggaccaggcaagagggcccctgccttgtgttttagagcagagctgagcaaactttctctgccagggactagataaaaaataggcttttcctaaatcttaattttagatttttaccaagaggcaaaattgagcaactgttcttgccaaaatcattttacatttaaaaatgtaaaaagcatgcttagctcacaggctgtacaaaaactggatttggcctacaggctatggtttgttaagccctaccttagtgggctctcctctccccaccagtccccaggctgggctctccttatagggttagagtctgcagggccaatgcccactcacagcctgctctccgaccccttttagacaacaacctgggtactcagagcctggaattcccttccagggcctcttgccaagatccatccttcctgtgaacaccgccctgctggcgtatgcactcctgtggccagtggaggagtcagtggatggctgttttcaggggcagtgggacgcagttagacatgcaggttggggtgctatgatggaaagggcctgggaagagaagtggggtggcccatgtcaatagtacattcttaggcctccacatactggagtggaatctcaggggtccatgaattcttaagtcaaacttgtccttccaggttcttgggaaatgtaaaggactgaattgcatccccacgcccccaccccacaaatccgtgtgctaaagccctaatctccagtgtgactgttctgtagagataaggccttgaagaaggtaattaggggagaatgaactcatcaaggtggcgctctgatctgataggattagtgttcttacggggaggggaagaggccacaggagggtgcatatggaataaaagccacgtcaggacacagcgagaaggaggcagccagcacggcaccaagagaggcctcaccagaagcccacctgctggcaccttcatcctggacttccagcctccagacccaagagaaatttctgttgtttaagccacccagtctgtggtgttttataagggtagctcaagccaaccaatacaggaaggtacttgtgtcaaggggtgggaaagagcatactgtatttaaccgtctgttggcttgatttgtaatactcctatttagataaaggctgtgtgagtcttagttattcttgtcccggctccctcaccccacatgttagagatggcctcatcctaggtcaatagggagttgtgggttagggccaagtagattatgttataaagcgagatgtattttatatattcatatcttttttcatatatatgttcatatatatatgtatgtgtatgtattcatacaatcaacatcgttgtcactcttatcaagcagaacaggaaggaggaataaaggccccagagggcaggggcaccatctcagatgtctttgtcccattcacagctccttcttacacagagcgggcaccatgtgcgacagtaaagcaagagccaggatgaatcctggccccatctgccacctccccactgtgcgtgtgactctggtcacctcacttgagcttgctgtgcctcgacttctccagtggtaaacgagggtacgacctagcacggtgctggcttaaagactgtgctcaggggtggctctgattcacatttgatttatagtcaatattacattcttagtgcatctcaccattaaggaggttcctgaaaaactcggtgggggaaaagagaggatctgaagaggtgtttgatttctttgacgtaacaagaaattaaagaagtttgctgggcatggcgctggagaggtccggtgggccaagtcgattagatgatgtggggtgggccatgtcaatattacattcttaggcctccacatactggagtggaatctcaggggtccatgaattcttaagtcaaacttggccttccaggtccttgggaaatgctaaggacggaattgcacctgtcagatcagggccccaccttgatgagttcattctcccctaattacctccctcaaggccttacctctacagaacagtcacactgggggttagggcttcagcacacggatttggcggcgggggatgcaattccaaggtcgggtgacccaactcaattagataatgtttttctagacccagtcgctccacagtcaccttcccgatttctgccaggatcagctagccttaccgaagagctaaaaagagattcatcccaaacaagagcttccttggaagcattccatgaagacttgaaacggtgctgcctcccaccacctgacccagtattgtcagtgcctcctctgaggatcgcagaaaatcgcaccccacgcccccccagtgcacattccagacttggagaagcgcggcatggggtggcggtggggagaacacctttctgccagatcaaaagcccagcactttattcagagttttatttatggctccttcagaaggttagtccagtcacgcctccttaataaccgcctcatcacacatgattcaggtgtcctggggccacttcacgctcctggcttcctggcccaaagcccaggagaccgctgaaccccactgcctggcattatttgcgggcgagacaccactggtgaagtgtttgtcttttcttatggcttattttattgaaggttgttcttttagtcaaacaccttttcagttctttgtgtttgctgagcacccagggctgtctcacccagccttgaattgtttccaggcaccttgcaagccagtattgtacagttcttttctgcacagaaaaagtacagacttctggtttccagtccagcatgttaggagcttagacgtcatcgttccatcctgacaagtgaaaagctggactggaaaatcaacaattcttcctagagccattggcgcctcccacgtgggagacctgggttcatttcctgaccagtgcaccagcattggtggttgagtggtagaattctcgcctccctagagccattggaaaaatgaggtaacagggcaaaccactgtccccaaaattagacagacaggcagatacagataattacaacttaccagaacagaaacctccctggctactagtgctggggtgcaaaaacctgatccgtaatcggcaaattgctggaggctaagtgtggacaagtctgagaatcagtcacgggggctccacgcgttttggagttttccctcaggaagcgctgccgggtcctcacagtgaatgctggagaaaaatcgcctcatgcttctggcagggagaggagaaaagtaataaccattgtgaaatatgccagagcatcccgttcttcttaacaagggcttccctcaggagacgctaatgtgagcttaatctcctggggttttatcagaccctaacctacctagaagaagggacatccccgattccaatcccttccacccatcctctcccacccaagaggagaggggggagaccaagaagcacttgtgaaggtcacaatccacaggcacaggctccccacaagacagagacctcatcgtcggaccgtagcacacttcccctctccacacctcaccaccacatcactaaaggttcatgtactacagttcctttcacccagtgtgccatgtccagccctcaagaaaacaattacagcacactaaatggcaaaaaaaaaagaaagcaatttgaagagatgaagcaagcatcagatgcagactcaaatgtggcaaggatgttggaatgataaccaggagttttgttttttggtttttgggtttttttttgttttggagatggagtcttgctctgtcacccaggctggagtccagtagcatgatctcagctcactgcaacctccgcctcctgggttcaagcgagtctccggcctcagcttcccaagtagctgggattacaggcatgagccaccatgcccagctaattttttgtatttttagtagagacagggtttcaccatgttgcccaggctggtcttgaactcctgacctcaagtgttccgcctgcctcagtctcccagagtgctgggattacaggcgtgagccaccgtgcctggccataaccaggaatttttttaaactatgattaatttgctaagggctttagtggaaaaaagtagacagcatgcaagaacagatgggcagtgttaagcagagagaaattccaagaaagaaaagatgctagagatcggaaatactggagcagaaatgaagaatgcctttgatgggctcatctgtagactggacacagctgagtctggggtgactgagcctgaggatatggcagtaaaaacttccaaaacggaaaagcaaagactgaaaaaaaaaaaaaaatggaacagactatccaagaactgtgggacagctacaaaagatatatgccctgggaacactggaaggagacgtaagagagaaagaaacaaggaatgtttgaagcaattgggacagagaatgtcccctgaattaatgtcagacaccaaatcacagatccaggaagctcaaatgacacaaagtaggacaaatgctcaaacaaaacaaaaagctaggcatatcatattcaaactgcagaaaatcaaagaattctgagggaagcccagagcggggaaagcaacacgttacctaaagaagggcaaagacagtagagtgaaatatttaaagctttgggaggaaaaaaaaaaaaaaaaaaacgaacctagaattgtgtaccctgcaaaattgtccttcaaaagggaaggagaaataaagactttctcagacaaaaacaaaggaaatgtgttgccagtagaccagcctggcaagaaatgttaaaagaattttttttgttttttgggtttttcttgagatgtagtcttgctctgtcccccaggctggagtgcagtggcgccatctcggctcactgcaagctccgcctcccaggttcataccattctcctgcctcagcctctcgagtagctgggactacaggtgcccaccaccatgcctggctaatgtttttgtatttttagtaaagacagggtttcactgtgttagccaggatggtctcgatctcctgacctcgtgatccacccgcatcagccttccaaagtgctgggattacaggcgtgagccactgcgcccggccaaaagaagttctttagagagaaggaaagtgacataggtcagaaacttggatctccatggggcaaggaagggcaggctttgcagatgctgccaccacccatagccccctgcaccagccgtgggcagccccactgtgttcttcaacatgaggccgcatctctttcaagctgtttgcagactacattccaaaaacagcagaaaatttttgtgctctgagcactggagagaaatgatttggttataagggctctttgctttcacagaatcatgccagggtttgtgtgtcagagtggttacttcacacaccatcaaatttccaagaaaatttactggtatcaagaaagaaatttgatctacgggaagaaatttgatggtgagcacttcatcctgaagcatacaggtcctggcatcttgtccatggcaaatgttagacacaatacagatggtccccagtttctcatctgcactgccaaggctgagtggttgaatggcagagtggcatgcatgtggtctttggcaaggtgaagagaatatcgtggaaaccatggagcactttgggtccaagaatgccaaggccagcaagaagctcatcattgctgactgtggacgactcttaataaatttgactcatgttctatcttaaccaccagacattccttccttagctcaggagagcacccctccaccccattcgctcgcagtagcctctcatctttgtgctcttgctgcagttccttgggttccatattttccttattcccttccatgcctagctgaattgcagagttaagtttatgattatgaaataaaaactaacaagagcatcagagaaggtataggtgaaagtaaaatacttttagtattcttgatctaacatgagtttttttcaaaataataacatattctagtgtgtgtgcatatcctatgtataagtgaaatgaacgagagcagtgatagaagggataagagggaagaattaggattattttgttatcatagctactttcactatgcatgaagtgttacagtgttatttgaaagtagacttgggctgggcgtggtggctcatgcctgtaatcctagcactttgggaggccgaggcgggcggattacaaggtcaggagattgagaccatcctggctaacaaggtgaaaccccatctctaataaaaatacaaaaaaaattagccgggcgtggtggcgggcacctgtagtcccaggtactcgggaggctgaggcaggagaatggcgtgaacccgggaggcagagcttgcagtgagccaagatggcgccactgcactccagcctgggtgacagagcgagactccgtctcaaaaaaaaaaaaagaaagtagacttggtttcgttgtaaatatatattgcatattctagggcaaccactaagaaaaggaaaaaaggaagtcactgatatgctaagaaaagaaacaatggaatcatatgaaatgctcagctaaacccgcaagaggcagaaaaagagtgggagacaaaaaaaaaaaaatggacaagggccacaaatagaagacaataacaaatatagcagtgattaatccagttatatcacaaataactttcaaagtcattggtctaaatgcagcaattagaagattgccagactagatcaaaaaacaagacttaactctatgcaagaaatccactttaagtataaagacatgtagattaaaagtaagtggatataaaagatatatcatgctaatactaatcaaagaaattaggagtcactatattaattgcagctagagcagacctcagagcaaggagagttatcatggaagggcattacataatgataaaggggtcaagtctccaagaaaacatagcagttgttaatgtgtgcgtctgacagcagagcattgaaatacatacggccaaacatgatagaactgcaggtagaaatacatgaatccactattttatttgaaggcttcagtgcccctctatcagaaatagacatatcccgcaaggagagaatcagtagggacggagttgaactcagcaatactgtcctgtagactctacttcatccaacaacagcagaataacatacattcttcacaagctcacatagaacattcaccaatatagaccacattctgtgctgtaaaacacaccttaacaaactgaaaataatagaaaccatgcagtgtcttctctcagaccacaatagacctaaactaaaaatcaataacaaagatagctagaaaattccaaaatacttgaagattaaagaacccttctaaatagtgtgggtctaagaagaaatctaaaaggaaattttaaaatattgttaaataaatgaaaacgtagatacgacttatcaaatgttatacggtgcaattaaagcagggcttaggaaacttatagtattgaattcatatattagaaaagaagaaagatctaaaatcaaccacctaagcttccatcttaggaagctagagaaagaagagcaaattaaatccacagtcagcaaaagaaaataaaaactagagcagaagccaatgaaatagaaaatagaaaacagggaaagtcaacaaacccaaaaggaagttctttgaaaacatcaataaaattgataagcctcaagtcaaattaagaaaaagagagagcacaagttactaataaatgaaagaggacatcactacagatcccatggatgttaaaggatgataaacaaacaccagcatggaaaactacagactaatacctctcatgaacatagatgcaaaaatcctcaacaaaatattagcaagttgaatccaacatgtatagtaggaattagcttctgtttgcagccagtataaacaattgcaaacactgctttcatttgatcctcttctgaccttttttgggaggggtacttaggctgttctgctgtttgcttcccattcttacagggaggtaaaaaagggtggctactctaaatagattttaaagcactttcattggtgtaattactattagagagatcattttctgttttctccaattgtacatagagccacaatttttgtctaaatagaaaatacataggctgggcgcagtggctcacacctgtaatcccaacactttgggaggccgaggtgggcggatcacaaggtcaggagattgagaccatcctggccaacatggtgaaactcagtctctactaaaaatacaaaaattagccgggtgtggtggcgtgtgcctgtggtcctagctactcaggagcctgaggcaggagaatcacttgaactcgggaggcagaggttgcagtgagccaagatcacgccactgcactccagcctggtgacagagcaagactccgtctcaaaaaaaaaaaaagatacatagtttggactctagactctttgtttttaatcttgtggtaattttctttatttttctttacttatttatttggcggtggttgttgttgagatggagtctcgctctgttgcccaggctaaagtgcagtggcacgatcttggctcactgcaacctctacctcccaggttcaagcaattctcatgccccagcctcccgagcagctgggattacaggcacttaccaccacacccggctaatttttggacaggctggtcttgaactcctgacctcaagtaatctgcccacctcggcctcccaaagtgctgggattacaaatgtgagccactgtgcccggccagttttcttttttttttatataatgcactttgtccaaggatttcaaatattgtagtcatttcccatgtgacatagtaagatccttgatcttggatatcgtatcttagcgtatttgtctgttatcccagttagtttggtaatctgtgatacctagcagagtgcccaacccatagaaatgtacagtcagccatactcagtgggagtgagcaaaggagagggccaaggagggtgtcctaataccataagaaaacagagaagcctgaagttttgctgctccagtaaaaaatcaatttaattgcctaaggggagatttttaaaaatctgtttgattcacttctgtaactgattcacttctgatttactatgtctggtacacagtaaattaatatttgctgaaagaacgaatggaaggtttattgtcgcttaagaattttcaggtgccaacaatcatttgagtgtttaacatataccaaaatgtttcctctgtccccctctgagccaagtttagtttatttccttgaataactttcacccacctgcttatttctggtaggccagttcttatttctaatgttaggcagtatggagttatgtatactcagctgcagtaagcacattttaatacacataatgccatttaatccccaccacctgcttgtcaggtgggtgctgaaatcccaagatcacagctgaggaaatggaggctcagagaggctaaccaacttgcccaaagtcacacagctcctggcctccagcagttgggttcggagctctctcacctcattctgcttcccgcttgtattctgagctttggctatgccattggaaaggagtttaattaggaagtatctcgattgagagctgggggtgtttcacttctcccctgctgcggggctttctgtttatgacgctctggtctctgttctgatgctttagaaagaggacacggtcaggagacctgaggcctctctcttcctgaccttgctgttaaccagcccaatgacctcagcaagccactgtgccactttgagcctcaggagcctcttcagaaccctgaaaacaccttttttattttattttaatttgttttagacggagtctcactctcttacccaggccggagtgcagtgcatcatggctccctgcaacctctacctcccgggttcaagcgattctcctgcctcagcctcccaagtagctggaatcacaggcatgtgccaccacgtccagctgatttttgtatttttagtagagacagagtttcaccatgttggccaggctggtcttgaactcctgacctcaagtgatcctatcgccttggcctcccaaagtgctgggattacaggcatgagccactgtgcccagcttgaaaacatttttctaaatcatccctccagacttagcaatccagcaattctaacagcccttttgattttgcactttagaggtaggcagtgtctatggagtggtcttggatcagatccactacttctccaacacaaccttgtgtctgccccgtgcctgaggtcctggtgctgggtacagaagtggatggcccagccccaaccagggagaagtctgggttgagtaggggcagacagtctcagtagacatgacaaaggctccaggagttgtgggtcccacagtagcaagtggaggagacagttatcaaacccaagatcccagctgtcagatcagaacacccagaaaacgttcaggcctgtcttctttctttccaaatggtgctgtttggacgcgtcagacagtgctttgaccatgttacatgtaaagagtgcctctggggtcctgtgttctatccttgggaatggatgatgtttttcaaaacaaatgtaatttttccatcaaaatgtttttgttttttgaaaaagaaaggatattctttgtttccctgaaacagtaaaaggacttgagtgtgttttatgcataaaggccaccgttattttgtaatgacagcttgggaagaggcttttgtggccaggccttttatttaagattgggctctaggggtttgctgtatacatacagcacaaaaatgaagagtgaaatcccagttcaagtgcagccgagaacaggagagtgaatctccacacacgtactttataggtccgtgggttccttcaagaaaaagcctttagagccaagagctcctgagtgaaggaggcatcttggctgttttgatcctgttaagcatttgggccccttttcagcaggactcatgtaaactgggcgagtacccaccatagctgtctagggaaccccactggatcaaggccttcagtatagaaaaagggtcagaagtatggatgccaaagccgatgaccagggttctaatccaagcgttgctgcttgcaagctctgtaacattggacaagctactgtgtctctctgtaccttatttcctcacctttgcaatgggccttatgaggattaggtgagcttcagagctaaagagcctggctctcggcacatgcctactgtggtgatgttggttacagctactgtcaatattgccagtggcatctaaaaccttcctgtgccgtcctcaagctctcccaggctggagatttcagaagttagaaagctcctggagtcccatcctctctgggaggcatttgaatgtgaagccctggtagagagtggaaggctgggtggccttggagtgacatccttccagctgctgcaggcccttggccttgtacaagacaagaagctaccccctggtccctttcatgccctggtcctgtgcccgggctggaagaaagctcattcatatctcacttttacaagacaggcagccatttgtaacatcctgacattcccccaagcagttggctcttgtaagtataataataatgatctaaatgacaaatagcagtaaaattgaatgacagtggccttgttgggggtctgtctttgaagccacagctcaacctcccatgtgcagcagggaaatccgccagctctagcccttcttgccaactctgcctctccttttgtgagtttctccattatgggaaaccagattggcgtcacagccccttgcctggggcttcaggatatcaggcagccctgggcttggctgtaagcccacattggcccacaagtgccagagacacctgctcctatccccataggggacagacaagagagtctcctcatccattccatggtctctgagcctggtcctcagcccaaagctggctccctagaccaatgagagccagagaaccagaatgggccataggagccggtggaattcagagggtctcagccagcactgtccaacaaaagtaaaatacaagccgaaactgcgtttagcagccaagtttttaacaagttggaaaggaaacagatgaagttaatttattaataaaaacatttaatgaaggccaggcatggtggctcacgcctgtaatcccagcgctttgggaggccgaggcaggcagatcacctgagatcaggagttcaagaccatcctggccaacatggtgaaaccccatctctacaaaaatataaaaattagccaggcataatgatgggtgcctataatcccagctactcgggagactgaggcgggagaatcgcttgaacctgggaggcagaggttgcagtgagccgagatcgtgtcatcgtgtcactgcattccggcctggtcgacagagcaagactttgtctatatatatatatatatatatatatatatatatatatccatatatatacatatttgtccatatatatatatttgtctttatatatatatgtctttatatttgtctttatatatatatgtctttatatatatatgtctttatatatatatatatatgagctattttgcattttttatactaagtcttcaaaatatgatgtggatttcacacctacagcacatctcagtttggactagccacatttcatctgctcagaaaccacaagtggccagtggccactgtattggatagtggctctagacagctgaatagggacagtatagccaacatcctaagtcgtgtgtatctgaatgtttatcttccagtggggctctctaacactattttcccttttacagtgaggctttggttaaccagaggtatttattaaccacaactgctcattgagagaaagatatgctttattccaaaaatgaatttgcagcggtgaggttgtgccctatacctgtaactgagatcttcaggacctcccgtgttatctggtacacaacaagccaaaggtgacacgtttctctgggaaaaaatgctctggctagattctaaaccccatcctattgttacaattgaaggcactgcagtgttcagagtgactttgtaatcttggcccagtggctgagcaggcgggctctatgcggctgatgaggatgagtgctgtcacgagaaaaacgagccttggcgcttggcattctgcttttggtaagccttggaggaaggagagcgtgttatcagaaggagtcatgggaatttaatgccttggaaatagaaaatgaagagccagctgggagccaacttgttgtagaacttaaagcaaaaccaatcaggtggccatggcctttaggattcatgaatccttctgaccagaaacagggctcccacacccttgcctgttgatggctttccaattcggacatcagtttccatcacccaagcagagagatgtggttggcaagactgctcagatatttgtagaatataggataggaaacaaagtataacctcctttgttcagccctcactgatcctttacctgatacacacagcaacactgttgcttcagccctgccactgttaaaaacaaactcactttgggaggccaaggcaggtggatcacctgaggtcaggagttcgagaccagtctgggcaacatggcaaaaccctgtctctactaaaaatacaaaaattagctgggcatggtggtgggagtctataattccagctactcaggaggctggggcagaagaattgcttgaacccgggaggcagaggttgcagtgagcagagattgcaccattgcactccagcctgggtaacaaaagcgaaactccttctcaaaaaaaaaaaaaaaaaaatttaatgaaacaccaagtaacataacatacacagatggtggggactggctttaaccaagttaaacatagtttaacatagttacaagagcaaattttattcaagtgcttttgaaatatagttacttaaaacaactgaaatgatgctttccaataaatcatcttaatcctctgggccctttgattaatatttcattaatcccagtatcaatgtatttgaaaatacattgaaaagataaaattatatctttaaaataaatgtgtcagtattcagttccacatattaattgattggctttgagcaagtctttaaacttagagaacctattttctccctataaaatgagaatatacagtaagacctcacttaacattatcgataggttcttggaaactgtgacttcaagtgaaatgatgtataacaaaactaggtttttctccctcatcagcattataaggaaatgatgttatttgaggacctgctgtatgttgttttgcttaaaatcacagtttccaagaacttactgctggtacggagtgaagacggactgtaataacaactctgcatcatcagattacacaagatgtgtgtagtgggtacaacctgcatttggtgcccagaaggtggattttcactcacccaaagagaatttctgttgcccttctacttggtcaggacaggatttgtagaaaagctgagattgtgtgattcacttacatgaaggaggaagtttttagaatggacaactcttgctgccacagcaatccctgaaatctcagtggcttaacacaaccaatatttccttactgctcacacacagtctgatgcaaatcaggcaaccctcctccatcttgcaactgagccatctggaacaggtggcccctagaatcacagtgacaggaggcaaatgggcttttaattgcctcaacccaaaagggcaacatcacttcctctccctgtccattggccagaactagtcatgtggctccaaagcagaggagattatgaaatgtaggggagcacatgggctgtttggggaatactatctgatgctgaaggtttgctcctatcattctaatttattctctgatatggcaatatgatagcctattaagcgtcttcccactgacttgttttgttttgttttgagatgaagtcttactctgttgcccagtctagagtacagtggcacaatctcagctcgctgtaaactctgcctcccattttcctgcctcagcctcctgagtagctgggattacaggtgtgtgccaccggacccagctaatttttgtatttttagtagagacagagtttcaccatgttggccactccggtcccaaactcctgacctcaagtgatccgcccgcctgggccgcccaaagtgctgggattacaagcgtgagccaccatgcccagccatttttttttttttttttgggggggagagattagggtcttgctatgttgcccaagctggtctccaattcctggactcaagtgatcctcttgcctcggcctcccgagctactgggattacaggcatgagccactgtgcctttcccctattcatttttaagtttgctttctggggtaggtttatctttatcattaacctaggttttacaccactggaattgaagtgaaattatccccccactgcaattagtccattttcacactgctataaagaactacctgatactgggtaatttccgaagtaaagaagcttaacaagaagcatgactaggaggtctcaggaaacttacaatcatggcggaaggcagaggggaagtaagcatgtcttaccatggcggagcaggggagagagagagagacaacaaggcgggaagcgccaaacacttttaaaccatcagatcttgtgagaattcactcactatcatggagaacagcaaggggaaatccgcccccatgagccaatcacctccctccaggaccttcccccaacaggtggggattgcaatttgagatgagatttgggtggggacacgatatggtttatggacacaaaccatattgggaggtaagtagtggctttcaggagttggccgagcagttttaatggatttttttcctttgcttaagggtgtaggttaagtgtactaagcatgtgctaagtggagaatggataagcagacttgatactgccactattctcaaggaaatggctttgtttttgttagtttgaaatgagaatccagtgtataaatcagctcttgatcttttagactgacgggctgtggaagggacaactcatttcagttaaaataggcatttccaggctgggcatagtggctgatacctgtaatcccaacacacctatgcaacaaagcaaaatcctgtctctaaaaaaattgttaaaaaattatctgggtgtggtggtgcatgcctgtggtcccagctacttaggaggctgggtgggaggattgcttgagcccaggagttgaggctgcattgagctatgattatgccactgccttccagcctgggcagcagagcaagacactgtctcaaaaaaaaaaaaaaatagtattgccaaatagccagtatgaatcagatcttaattttcctgtgtttaatactttgctttggattgaactgttagagaagtacttcagtagctagctgctgagttacaaatatgttgatttttttcctatgcatttatcctttaacattctagtcccccaggaccatcttgagaacagtgtggcctgctgcacaagcttttctcccttgcaaattttgttggggaaagccacatttcccacctagcatcacagagtgtgtttttctttaattttataatttgcagctctacaaagactgtgttgataggagcaaggtgtgtgagacaataattatgtttgtggaaccttgtcacattttcttagactattattttagagaacagccctaagccaagacattgggtcttgtgatccttttcaaagaaaatcgttgggctcgttaatcctttgattcaagtcttttttaaaatgatattttccattttgactaattgaagatttcccactaagataaatggaagagacttatcatttgatcaaaattatagcagtgcttgatgtttgcctactaccctacagttttcaaacaaaatccatttacattcactcatttaattatccccctggtttttctggataagcagagtttcccatgggtggaatgcttccattcttgggaatactttatatttcctctcagatttatacatttctagttggcacagcttctgccgttcagatgcaggaaatagagaatgccactagagaaacagatggaaagacaagaagcagatccaagtatgtgtaagttcatttgttcattcatgcatccagtcacttatctatttattcattattcattaaacaaagttattaaatatactatggcagtgtctcccataggaggtaatatgataggatgtttaaaagtagaatgctggagtaggaaatcttccatgtaaacatttgttcagacacttgctaattttaagtttttcacaattttttaatctaggcaattgggaaattatatagtcaatctgtctttatatggtatagcagttctgtgttttctgttctaacttcaaaaaaacaaacggaaacagaattgcccagtgattacaatggcaccagcctagatcagccagcatttagctgactcccagatgtgtaagcacccagccaagatcagcaatgccccctgactggccccctttaaagacttaaacgtagtcctaaaattaatatagcaccttctttctgatccaggtagaagtacgtgtctaaatgtttctagccctatggtagtgtctgccacggcagcagtagcaatgggagcagctgtgttaaggaagagtgagggttccaacttttctgctgatctgggaagtagtggatgtggagggttgcagtgtcagagaaaaagcagccagtagacctaggtctcttggtgaaggcgatgagtttgaggagttccttgccaaaggctgggctggcttagatgaagatgcacgtgtctgggaagataactgggataatcttaaggccagaagtttgagaatttggaaaacgggcacttgtttactggtgggagtgagcgtgctactgttttgagtaacctggcaatgtgtctttttttttttttttgagacagcatctcactctgtcgcccaggctggagtgcagtgggggcgatcttggctcactatactctgcctcatgggttgaagcaactctcctgcctcagcctcccgagtagctgggattacaggcatgcaccaccacacctggctaccttttttgtatttttagtagaaacggggtttcaccatgttggccaggctggcctcaacctcctgacctgaagtaatccacccacctcggcttcccaaagttctggaattacaggcgtgagccactgcccctggccagcaatgtgtcttaaaaagttttacttttgagttagaagcatttattttgacccaccaattctattgacaggaatttattttgcagaaatagtcaaaggtcttgccaagatactcatgatatattattaaataaacaaactgaccacaaaatagcaggctcacataattcagtttttaatgcatatgtacacacatatcacacctagaaaaaaatatggaaaggttttatatggaaataacattaatatttctggatagtgatcataaacaattttacttccttatttctttttttttattttttttgagacggagtctcgctctcttgcccaggctagagtgcagtggtatgcagtcttggctcattgcaacctccacctcccgggttcaagcgattctcctacctcagcctcccaagtagctgggactacaggcaggcatcaccatgcccagctaatttttgtatttatagtagagacagggttttaccatgttgtccaggatggtctccatctcttgaccctcatgatccacccgccttggcctcccaaagtgctgggattacaggcatgagccaccacgcccgccgcttccttatttctttagcttttcattttcttcctaattgttctttaatgagcatgcatggcttctggaattttttttaaaagcacaaaaagattatttttaacagaatggttttacctggtaatggaaaatataatgacattggtatcagggagataaattcagtccagtccttttgggagagcaatttaccattgtatcaaaggttataaaaatatgcaactcctttgatgcaaaattttgtctgggaactggaatgagatgtatcatccccgggtaatagactggagactcatttcttggggtttcttatgtgtgtattttccaagttttcagaaaagaatgtgcagaacaaaggttgtaaaagaaattagagactccttgtaggttcctatgtttatatcattttcttgtcaaggaaatgagctacaaaggtgccagatctaatcttgtttacccttgttactgcccacacttaaactgttggtgcttgtgtttctcatcctacatgcagaaatattagtaatacattaaagaaatgaaagtgggcagacatgcagaaagttttatgtccgaggacatttaattagacattctgggccattaaaaaaaaaaaatcccagaacatttcaaagtaaaagttgtaagcgaaatggcagaatggttatgctgagtacctgttagtgtgtcttgaccttgaatcctggcatgtgatccatgggtctgggaattgtgtgcagcaggtacacagcgtacctgagaggtaatgaagccagtgttttaataagccctgccatacttagaaattcaaatccatgttactcccttccacgaagggaggttatagaattattctagtacttctgatagccacaaaggtagaaggaagtgtagaatgagctccctgtggacccatcaccaatttcaacagctgccagcatttgccaactcatttcatttatttttctcccacctcatttattgaagtgtttttttttaatttaagatatgtcagttcacccataaatactttatctcttttctatttcacccataaatatactcatttctaactgataagcacactttaaaaatgttttaatagtattattactttttaagagacagagtcttgctacgttgcccaggctagcctcaaactcctgggctcaagtgatcctcctgcctcagcctcccaagtagctgggactccagactcacaccaccacacccagccagaaaacatgttttctaactagtcaacataccattatgccacctaacaaaatgaatggtaagtcctcagtatcatctgacatccagattgtatcttaattttcccagttgtttcaaattttctttgttgcagttggctctagatactatatttgcttactatattttatgtcttttaaaaagtgttttaaaacttctgtttttcaatagactgaatgtatatcattgcacttctctgtgcaacacaagaaaactataatgtttccttatcatcatccttactattatactcttagtaaagccctgttacatagtttgatcatcttatatgtcagactcaaactctgaatgacctctggcttttcctttttttttttttttttttaattaaaaaaattttttttaatagagacaggatcttactatgtcacccaagctggtttcaaactcctggactcaagcaatcttcctgcctcagcctcccaaagtgctgggattagaggtgtgagctgctgcacccggcctctggctttttctcaaaattaaatccacctcagtgtccacatactttctgccagggaggataattaaaactaccttcagacagtgctgtggcatctccaggtggattcagaacaagattccccaaaccagccgtgggcagtgaatcacggggtgatagttctccgtgtgtctgatttgaagggtcctcttcccttggcgtaacatcaaagacagatcttagcacctcatctgcatgaactgagtgtataaatgcctacctgcttgacttacctgttctgacaggggctattggacttaccactaatgtaattgatgtgtttgttttcacacagataatcgcttatcagccgtatggaaaatctgtggactggtgggcctatggcgtcctgttgtatgaaatgcttgccgggcaggtaatgttttgctacattttcatgtttgtttattgctgtgttatgtgaatacttcagctctggttgggcctcgagagcaagacctgacgttttagtgcagctggtgttggcgtgacttccctgacccaggcgaaagagggagaaacgcccccttcaaagtggatcacgttcagtatgcacagaaattatctctggtcatagaaactccaaattgaaagctacaacctggagtgtagacagtgtcagtttcacgttatgaaatgtacatgttggccaggcgcggtggctcatggctataatcccagcactttcagaagccaaggcaggcggatcgcctgaggtcaggagttcgagaccaccctggccaacatggcgaaaccccatctctactaaaaatacaaaaattagccaggcgtggtggtgcacatctgtaaactcagctacttgagctactgaggcatgagaattgcttaagcctgagaggcggaggctgcagtgagccaagatcgtgccactgcactgcagcctgggcaacagagtgagacggtctcaaaaaagaaaaaaatgtgcacgttgatgacagcagtggcctctaagttttcagtatcttaaaactggggttgggttatatggttccctgcaagtttgtctgcaaagattgccccagctgctgccaatgtgtgtaattagtattattatttaaggaagaagacagttaccttgaagaagtgttttaatagtttctccccatctcctcctatctcacccttggcaattcgttgtaattttcactgaagtccagtgaggctgaacatccagttaaggaaggtaaattagctttctcttatgatgtgacatgtaccagataaccatgtgccttattgcctaacatggcactttctaatataatggccttaatatctgtgtcatcagggtgaatcgtactatctgccacttctaggcctggcccctaagacatcctttatgactgtcctcatgctctaggctgaaattaggaggaattagtggagaaatctgagaccctacaagatggtggtgctgatggatgcgagaagcctgagtctttgaatgaccctgtggtcagtgcccacccccacataggacacttccgtggcaaagtcccatgtgggggtggggcactgacccacaggttcattcaaggacacaggtttctcctgtccgtcagccctactaccttttagggtctcagatttctccgctaattcctcctcctttcagccgagcacagatcagttacataggatatcttaggggccggcctagaaatggcatgtatcacttctgcctaggttccactggccacttggccccagtgggacacaaagaggcaggaagtatagcatatctgagagctcagcaggggaagcaggcttggtaatcacgaagcaggcttggtaatcacccagcagatctctgccttatactaaacatgattctgccgtgggcagctttttataattcccagcactcacatgctagtgccaagacctgtgactctccatagccagaagccttagtcagagacaatggaaagagatggccatgctgtgcgacagagccacccccaaagacatctttgtttctggggaaaaagtcttcccttcccacatgttacgtccattgactcatttattcattcactcaccacgtatttattcactgaatgcttacaatgtgcatggccataaggatgaacaaaacagacgagaatccttaacttcgtgaagcttacagcttagaggaggagagacagcagacaggttagataaggaaaatgtataacacagcagaggtaagctaggaagaaaagtaataaagcaggaaagaagatagtgttgggggaggttgaaattggccagagaggataaggttaagacctaaaggaagtatggggttgtctgtgtgcatatctgttgaaagggcattccaggcagagggagccaccacgcgaaggccctaaggccagggaatgtgcagccacgtttaagaaatggaagctcccagcagggctagagcagaattgagctagagagggagggagtaggaggcctgaggccagagaggaagaggctctggatcctgttgttagcagtggtgcatccccatgaggctgcagcaacctcagttcttgcctcctcagaagaaagaatttgactgtggggcatcaggtagagtgagagcctaagacaagctgtttctgttttgttttgttttgtttttgagatggagttttgctctgttgcccaggctggagtcggtggcgcgatctcagctcactgcaccctccgcctcccaggttcaagcaattttctgcctcagcctccttagtagctgggattacaggcacctgccaacacgcttggctaatttttgtatttttagtaaagacggggtttcaccatcttggccaggctggtcctgagctcctgacctcgtgatccacccgcctcagcctcccaaagtgctgggattacaggcatgagccactgcacctggcctaagacaagttttagagaggaatgaaagttcatggaaaagctttcaagcaggagcaaaaggaagtaaagtacacttggaagagggccaagccggcgacttgagagatctagtgcactctttgacttttgacttggggttttatgcattggtgttcttccagggtcttacatctcttctcccctgattcttcccttgggttgggctgtctgcgtgcgcagtggcctgctagtgcttgggaggggcggcatgtgcagtgtgtttactggagttacgtgtgtgctcagctgaggcattcttcccttaccagtcagatgtcctagaaggtggtgtaccagttaaactccgccatgttgccttttcatgcgcgtgcttgagcccactcgcccaactcctgaaatcttattgggaagctgctgctcaccagtttcaggtgtttccctttattgggagactgcctttccttggtgctggctgcgaccaattattattttacagagagagagttaaccacctgatggtcgcctgacattcctggtgggtagggggagccctctcctgccctgcccatgtccgaacagccacctgttgtaacactgtgaccatgaacgtcatctccagatcagcggctttgcctctaggatgggaggctgtggatgatctctcctttatgtgtctttcattatatttcctaaatactgaaatggtcttgtagacattgaaagacataaagctttagcctgcatttgatcattatttctcaatggtgttaaggcttgactgacatcaaaagagtggtttattatttatttagttcccctccccccaccccaaatcaaagcattcctcttaggccaaatacgtccgggtgtaaacacagaaaggcagttcgtacacagtcaccatcagtgagtcaatggctggagaaacaggagttgtctgctcctcaagttaatttccccctctttaaaatttttacagtaaaattcggctctgaattacaggccccctaagagtcctgcttttcatgaagtcacaaaaagccaagtccccctcttgatcccacttgaatgttcagctcttgagtctggaaaacaaaccctgctttcattaagagtcacatttgcatatgctaacatgcaaaaggggctgggcggaaacgaagccaggatctgtttccgagggcgctttacaagaggtcacgtgagtagactcttggccagcaggagacaagaatttcagaacccaggtctgcaggaaagtcctcctccctcccgcagcctggcttctcccctctccaagccttcctgggatctcattcactaggggagaactcagggaatgctttcttctggcagagaagtcccctttggggggtgcattttgaagctctgccacactggcctcagacctcatttgcaaattggcctgaggtgatttacaggccttatttaaaggtttccctactaagctcacgccccctggagagcaccaggctccagctctcaatagttctgcaaactttctggcctgtttccaatatttcccacactgcttctcagagccacttagcctgccttatatgcatactttcaggtctccatcatctctattaaaaacggtgatggctgggcccggtggctcacacctgtaatcccagcacttcgggaggccgaggcgggcggatcacgaggtcaggagattgagaccatcctggctaacacagtgaaaccccatctctactaaaaatgcaaaaaaaaattagccgagtgtggtggcgggcgcctgtagtcccagctactcgggaggctgaggcaggagaatggcgtgaacccgggaggcggagcttgcagtgagccgagatcgcgccactgcactgcagcctgggcgacagagcgagactccatctcaaaaaaataaaagaaaaaaagaaaacggtgatattctttaaagatgacaccttagaccaggtgcagtggctcatccctttggggcccttgggaggccaaggtgggtggatcacttgagtccaggagttcgagaccagggcaacatgacaaaatcccgtctacaaaagatgcaaaaatgagctgggcgtggtggcaagtgcctgtcatcccagctacgtaggaggctgaggtgggaggattgatcgagcccggggggtcaaggctagcagtgagctgtgatcatcacaccactgcactccagcctgggtgagagagtgagaccctgtctccaaaaaaaaaaaaaaaaacaacaactccttaaaggcactccacattctggtgcaatggcaggcacagataacagcctttgttcctctaaatctccacctcacccgcctcaaacacagtgttttcattcaaatccccttcttcatctttctctctgactcctcaatgcaaatttaaatgtattcctaggctgtcactcagctcagaaaggataatgaaggctctacccagtattatccacagcccctccaagcttcagcaatcccagagacccagcaaacggaatagatgttgttattgaaaagtaagattaatgataaagtcgttgacagggttttggtctaagtttgtcctctttaatcgcagagggctgaagatgagcaggaaaaaaatagtttattgccattttcttctcatttgctttatttattgtcagcagccaagggggcagttaagaataaacagcctcagtctttattcagttcctggactgcttgacaaatacaatcacttttggggcataaatagtgtttacccagcactctaatgagcaccttgtgcctgcaagtgttctcggtgatcgtcataaagggaccagccctctccttatgcccttttctccctgggttatttatgctttgatttcactcctactgaatcagtaatcgccacttcatcttaacttcggcctgaattgtccaggggagcatgcctagcccccagcccaggtttccgtgatttgcaaataagcgtggcctccatgaccacttcctagctgagatcacaccagtgcagtgaggtggctcacagctgtgattaggaatccttttttgcaaaatgtgaaccatcactcctcatgtgttggtttccacaaatcacatattgttaaagtgggaaggagcgggtgagaggggatagaacccattcagaaaatgtttacaccaacccaagacttttcaacaggtagcttagcctggaacattgagtccaaatttgtagaaattaaaaaccatgggaatgggggaaagaggcgagagaaggcatccaaaatggtaatgtactaaagcacctgagtgacacgttacccccatggtccccaggctaagtggctggcagtaccagaaaggaaaaggaatagaattagtaacttttcaccgttcccttgccttcaacgccagggcctgagagcgagtgattacctgtcagatgctccagggagacttgagcctagagagacttaacaaaggccgtaaatgtgttcacatttttttaggctgcaggatgccacacctgggacgttattatggggatgtgattcagagaagaaaacaatgatatgcacaggtgtctctagtagcgttagtgatgagggtacatgctggaagcaattgtaaatgtgccatggaacagtggatctgtcctgatgacgcatcacctcaatggcattcaactcatgggaacactggcagcaacaaagaaaatgtatttgcaacagtcggtgaaaaacaaaaaaactccaaattatgcatcataatttgaaaataatataagaggctgggtacggtggttcacacctatagtctcagcactttgggaggcccaggtgggtggatcacgaggtcaggagtttgtagaccagcctggccaagatggtgaaaccccatctctactaaaaatacaaaaattagttgggcgtggtggtgcacacctgtaatcccagctactcaggaggctgaggtgggagaatcgcttgaacctgggaggcggaaggttgcagtgagccatgatcgcaccactgcactctagcctgggtgacaggcaagacttagtctcaaaaaaaagagaaaataatataagaaagcataagaacccacataaaaataagcgcaatttttgtgtccaggtaaagggaatggggatgcttttttcgtagacttcccttccacaccatattacataattttcgtttaaaatagggcttcaggccaggcgtggtgacacacacctgtaatcccagcactttgagaggccaaggcgggcagatcacttgaggtcaggagttcaagaccagcctggtcaacatggtgaaactccatctctaataaaaatataaaaaattagccaggcgtggtgacgtgcacctgtaatcccagccactcaggaggctgaggcaagagaatcacttgaacccaggaggcagaggcttcagtgagctgagatcgcaccactgcactccagcgagtgagactccatctcaaaaaaataaaaaatataaaaataaaacacgggctccagggagcttttctgaatgtgctggtcattactgctattcaccaggtactcccagtcttcctccctcctggctcagtaggattgtacttcctttctcatgtgtatttgtggggtgtcagggagcaacatatgaccagcaccggccaatgagatcagaggggaggtgtccagggtggggctggaagcgcaggtacaagacatggcagagctgctgctccagcctttgctgcagcaagactgtgatggcagctgctccatcccggtgggtccccgaatgcaaccagcagaggcctctctgaccctcaacgtacaggtagcataagcaggaagtgaaacgggttgtcttatgctttggagatggtctcggttgtttgtttccacagcaggacccagcctatccttactgataccggaaggcacagttaagataccaatagtctacatcttgaagtaagccagtcacagggacgtgtatcgtatcaccccacttacatgagatgcctagagtagtcaaatcatagcaacagaaagttgaatggtggctgtcaggggctgagaggacaggagaatggggagtctcttttgtgagtggagtttcagttgggaagatgaaaaagttctggagatggccagtggtgatggttacggagaaacatgaacgtacttaatgccacagtacagtgcacttaaaagcggttaagatggtaaattttgtgagagagagagagagagagatatatatatatatatatagtgtgtgtgtgtgtgtgtgtgtgtgtgtgtgagtgagtgtgagtgtgacagagtcttgctctgttgcccaggctggagtgcagtggtgcaatctcggctcaccgcaacctctgcctcccgggttcaagcaattctcctgcttcagcctcccaggtagcagggactacaggcgcactctaccatgtccagctaatttttgtatttttagtagagatggggtttcaccatgttggccaggctggtctcaaactcttgaccttgtgatctgcccacctcggcctcccaaagtgctgggattataggtgtgagccaccacacccagcctgtgttatatatattttatcacaattaagaaaaaatagtctctatctttgcaacagaggttatatatattttatcacaattaaaaaaaaaatagtctctatctttgcaacagaggaaacagactaggaaaaaggatgcctttgatttgatggtattccaaagctgggaggaggcacttaactactcctcttccctatacccaagaacagcccccttttaccttcttcaggttcatgccaccttcaaccagcaggaatttggggaagcaacacagaagctgcatcggccagcagctgggaaggagggaggcagcctgattcccatcaattcattagagctggaaaaccatgccaggtctctagcgcagaggccagtcgctctctacgggatgacttgaaacatctcaggcccccagggctgccccacccccttcattttcagaactcatcactgcatattgtgcaggctgtgaatcagccttctaaaatttaccccaacacccttgccctcattagagtcttctttacatgctgggtggggctgtagccgagtaccctctgcctcacttcacccctaccaggagcagtgttggatgtcacccttcacagtggggcaggcggaattgctcataatggctaagagccccaggctccaaattcaggatgcctgggttagcacctgtgtcctgagactgatttgcggagtgagcagtgccacccaagccgtctgcacagcacgtgacatgcagagagaggctgagaaatgaacgccactgtggtcactttcgctgctcctaccctcatgcccacgatgctcctgccttattgggtaacatagactcacagcggtgaaaaacgtgaggagcagagacatgtcccctccctgacatgtggtgacagagaatccctaatccttggggccacatcaaggctggaatgcacaggctctgtcacgggtgtttggtcttgtggctttgttacagcttgggcatcttattccaccaggcaagcctaagaggcctctgagaatccttccagccctagactaagaattcacattgagttaaacagctttgttcactgcaggacttctcagggcctgtacaatttaaatgttaaagcaaattgccagagaggggtagaggatgcaaacttggacccaggaagatgctgtaggattaatgttctaaggaatattctttggggagtgtcagtatccagccttcagtggggcccagagaagacttgacagtaaaagtcctcctttcatctatagaatcgaatccctgatacagccattcaccttcagaaatgagcatacgtggggacagctcacctggcaaagctggttcccatgccaggagacaattaagtaggtgtggtaggccagtgccctgcacagaatgttccccaaacgattcctggccttccacatttgaaggtggggtggctgcagctgcattgacctaatcgtcttcaaatgaggagaagcttctcactaccctactcaagacagatttctggggaagctccacctgtgttccttagagaacgtttctcttaggcctttggtttgcattgtctgtgacttggcccctgcagcgttcctgcagctaagattcaagcacctccagagaggctgattgaatcttgctggcgcctttgtcactgcccaacaaggtgcaccccatttagcccgcttcgggggcatgcagcctacacggtcgcacagggcccaagcccacaagagctctgtgcatttggtttggtgctccgctgtcgcatctggaaattcttaataatttttcaatgagggactcccgttttcattttgcactgagacttggaaagtatgtgtctggccctgaccacaggccctcttgggccatgtggtgaggtgccagtcagtgacctggaagcagagcctctgccccgctccctgccagggcacatttacattgcagagagggtcacacagccagttcaggagccttgagcccctgcagggtgcaggccacgccctcagcagaaaccacaccatgtttttgttttggaaacagagtcttgctctgtctcccaggctagagtgcagcagcgcaatctcagctcagtgcaacttccgcctcctgggttcaagtgattctcgtgcctcagcctcccgaggagctgggactacaggcgtgcgccaccacagtcggctaattttttgtgtttttagtagagatgaagtttcgctgtgttggccaggctggtcttgaactcctgacctcaggtgatccacccacgttggcctcccaaagtgctgggattacaggcgtgagccaccacgcccagctactacatttgttttagttatgaaaatctccttcgccaaaactcagccaggtttatggatcactgattagggaaaatgagaaatgttatgggtatcataaaatagatgtccagaagaagcaggctgcgtgctgttaggcagggaagatacggtggggtggacacaaggatgacctgcactgtagctccgtcacagctctcccccaccactgcctgcctgccctgccctctacagatgaaagccacacgtccccctgatggcacaggtagctgtccctgctgacacaggtggccgtcggcagcctgcaccccctggtgggtgcccccccaagctgccctgggggcctctcaggctccatgttgctcctgctggtggaagttgctgtggccagctgcccctgccctgttctgagtccctcacaggcaggctcattttagctctcttcacccacctgcagcttccaccaaattgaaccttccttacaccaagcacttacaacagaaaaagaggcctatttatttgtatttccagaccaaaaaatgttgagtggtaccagacacccaggcctctctctgtcctcccactggggctctctgtagacttggcatctttccctcagggcacgtggctcctgtccaggactgggcaggggactgaggtcaggtctcgggtgttggatgaacaggttgaggtgatttgtgggtggtggttgaggggagggacctacttggctcaacggctgcctctgacttgggagaaaatgtttgataagaagggcatccttctgactactgcgaagttacctgtgatcgaggattcagttcaaaattaagccaaacaccatcactgtgtgacctgcccgtgtcagccaaagtgactgactcctctttcccacgagaaaggaacatctcaagattaaacaagaggattctgtacaagcgctggtccttgctctgcctttctgacgctaagctcaaggttacgcagccaaagggggagcattacggaatttcccatgaacgctttcctcctgtgccatcccgccagagtgaccgggaagtgatggatccctcaggactacagacatgctggaggaaaaagttcaaagggcattgtgagctcagcctttcctcctagaaggtgctcaaggcccctcccaagagagttgctctgtcttaaataataatactgctaagttgccttcattcggcgcttattgggtacaacataaaatacaaggcactttactcccagaaaccccatcttacaagttggagaactgtgtttttgtttttgtttttgagacggagtctcgctctgtcacccaggctggagtgcagtggtgcaatctcagctcactgcaagccccgcctcccaggttcaggccattctcctgcctcagcctccccagtagctgggactacaggcgctcgccaccatgcccggctaattttttgtatttttagtagagacggggtttcaccatgttagccaggatggtctcgatcacctgcccttgtgatccgcccgcctcggcctcccaaagtgctgggattacaggcgtgagccaccgcgcccggcctggagaactgtgttttaaagaacgaagtcatttgcctgtggacacccagctgggaagttagtagagctagaattctggtccagatccacctgactctaaagccacaaggtcccacggggccaccgtgccttcctctctcagcctggtaactgtaaacccagtcaaagcggatgagggaggagtccaatggaagctaaggtcccatcactgctgctgtgcagctggaaggccctccctcagagcagctgcttgttgggtcagaggcccagtgtgaattactgggaacatcctcttaggccacgttctcaagtccccttcaccccaaatgaaagtgttggcattttctaccggccacccccaccttctgaccacaaagccatctgtaacctaacttgatcgtaattagatttttagcacataattacaagattaatggattaatcataatttatttgcaaatcattaaaaacattactcaaaaacactttccctaaagattgtttgggttgcccagggcaagataattaacgagacagaggggaaaaaatgaaaaacacacaaccgtcaatctcattaaagatgatcaaataaaccgtcaagttagctgagcaaactgtgcagcctgtggtggggctgagaaacctggtctgttccttggtgctgaattggctcttcaggcaccatgtgaatgaattactctgcctaaatactttcccatctttctttttttccggaacagcctccatttgatggtgaagatgaagacgagctatttcagtctatcatggagcacaacgtttcctatccaaaatccttgtccaaggaggctgtttctgtctgcaaaggagtaagtcgatttggataccttttgtgatcatggaccaagagctttggtaggagaaatactttccccacacttctaagagagatggcagaaacaccacaaacccacaccactgcattttggccatcgagggttggggcttggtgtcatgccccaagataaccagcaccccaactttggacagcatggattagtcttggcctgttttgaactctgcacaaaccgaaccttgtagtgttgctcctggcctggctgctttcactcaatatggtgattgaggatttagttcctcctttcatattgctatgcagtgttccactgtgtgaacacaccatcgtttccttatccattctactgggcagggcacagtggcgaaagtgaaggccaagagaatggattggaatcccaatacttcctgggactctggcccagtcacctaatgactgtaccgcacttttcattctaatccatttcataaaattgtggtggggactaccagatgtcatcagagtcccttagaaagtatgtgctctcgtctcctgtcttacttggtgtgacttagttctttctttgctacacttttcttgagctatagcatacatacagcaattggcacaaatcatcaatatgctgataaatgaatcttcacaaaatgaatccacccatgtaattgcacccagctcaagaaaccatgtttccaccaccctggaagccctctcctgtcccatctacagtcactaccccgccccaagataacctgccccccaactttggacagcatggattagtcttgcctgttttgaactctgcacaaactgaaccttacagtgttgctcctggcctggctgctttcactcaatattgtgattgaggattttgtctgcattgctgtgtggggccatagttcctcctgtcatattgctgtgcagtgttccactgtgtgaacacaccatcgtttccttatccattctacttctggtggctatttggattgttcctgctttggtttgaggctgttacaaacagaactgctgtgaaccttctggggcatgtgttttggtgaagatatgcacacactttggttgaggaaatgctctaggaatagagttgctggtcatgacttgtctagttttgaatggtcaagagttagatcacaaagctattttcaggcttagtaagatggagtacaatatacccttaacagtatctggtgagtgtgatcatttgtgaggcatttgtcacgtgtcatccaagagcaaggcacttggaagagatactgagatcgggaggaactggcttctgccttcagagagttcatagacagtgtttgtctctgtgtcctgcagtgggcaagtcggaattaactagtcgccttccttgttatagcatttatttttctaatctatgagtctttgattgataacattttggcccagacaatacgtagacatatgatgcttattatggcatcctctgtgatgctagactgtgatgctttcagcacacacaatttttagtgattgcatgcttttttttttattactagatacatgtatagcatggtgtctccaaaacagacaacgtgtgagatgtctgtttaaattcttcttccatttggccatgggttcagattgcttccttgttcccttgtcttgaaaaccaccataggaagggctattcttgccaatgtcatttttgtgagttggcttcacttcgtacaagccactgagtgtcttggtcagctctctgagatgctgtccaggcgtccacaaagtcagggctgtaggcagagctaggcaaatggaaggtgctgtctgtgggaagcccttgacatccattgttctccttttctccttttcctttctagctgatgaccaaacacccagccaagcggctgggctgtgggcctgagggggagagggacgtgagagagcatgccttcttccggaggatcgactgggaaaaactggagaacagggagatccagccaccattcaagcccaaagtggtgagtccagaaaagcagcctgttttcggaaccccatgtccccaaattctgggagtatcccactcacctcttttcttggagagaggaggccggtgcccctggcttgtacagggtgaggaaacgggccaggtttcagccttgtcctcagtcctgtggcctcagcagccgggattcctgctgccttcagagagtaaggaccgataaggcagggaggggaaccctgtgcacacttcatcctccagctggacagctgcagagcacccccgcacgactagggagtgagggcagctgtgctttaggtctggactttgtggactcgcacccagcagggccgtattcacagccttcagtcctcagcaggactcaggcttcgtgtctgtctctggttttcctgggtttgcctggcaccgaagggagctctgaagcacaaccccgtcctagccagcaactaggcagggcctgggccccgccccctcttccaccactgcctccactgcggggagtgagtgtcagccaccaattctaatgttgtcagcttttttcacactctccctgtttgattcccatttttttcatttatttaaacactgtatgccaggccctgttctgagtgccttacgaatattaattcactcaatcatcccagcagccctgtgagatgggtactatggtccccagtttgcagtggaggaaacagtcacagagaggctgagtaacttgccagaagacacacagctgatagatggtgaaaccaggacgagtctttgtcctcacctactgcaccatcgctccatctcagcaactgccctgacgctgatgctgtgggccctaattgttgattgcggccagcaagtgcctttcatgtttatatctctagaggtaaactgagagcctttaagaagtcagcctgctcactcaccacctgccactttgcagagcctccaagggcgtcctgtttctaagggccgggcggactgtgccttccagctctgccaccatcttggccagcatcaggcagctccccattgtgcctctgcccggggactgcagagagctgctttatgccacagtcagtttcagaagcatcgccctgttggtttcgctcaaatgtgtctcctctgacaggtgccccatgagcaggccaggggacccacctggggtggcacagttgccaactgggtggcacacagccttattcttagagcagcaacttcctcaccatgtgtgcctctgtgtcctctaccccaagaataaaactgctgttggtgagcccactggattttatttttcgaagatatttttagcacacactgaagaaaaactaaaattaatcaggtcagttgacttcctcctgaatcatcgtttcaaataaggcccttttgtatctgacacccccgccttttctttagtcagccctgcacactgatttcaggggggtctcacgggctcctgcccctcaacatacaaaacccggtctggaggtttttgggggtggggagagtgattaatggtgctgcaagtggtctcagtagaaaattctgttagggattatttttttttcctcttctgcctttaatatttatttgttgtcttaaaatatgaaggttatgcaacagcatcttgaacacagcttagtttctttataggaacaacgtagagatgcgtactgaccccgccttgagggttgggcaaaatccaattacctgtcagtcactttccagaaagcgatgagttgcagcaaaaccaaccataaaacatgtctttttctatttattgccacgttatggcagaagagagtgtttatttgcatagtctcccacattttgtggatactcggccctaagctcggatatagggaagacaacagggcgacttggctccgcaggcaagaatgtgaactgttctctgtggtccacggaaatcacaggaagcaaaattgtacccatggcaggcagctgagttaggagcagtgtttatttatattttattcctggagcgctactgtttgctggttttttttttttttaaattattatactttaagttgtagggtacatgtgcacaatgtgcaggtttgttacatatgtatacatgtgccatgtcggtgtgctgcacccattaactcgtcatttagcattaggtatatctcctaatgctgtccctcccccctcccttttgtttgttttttaactgaatgctcgttaaaattaagaaggaaggataaattgcccctggctgtgaagaaatagcccctgaactcacaaacggaggcagaaattgtcgacccaggccctaaaactggaggtttcatgcaaaaggccccgcttggtaaaagctctggccagaaggaaggaagagatttctcaggcagaagcccgtgttctgctggaaaacctgtgcacaaaagaggaaggagctagaaagaatacagacagacaggaaatggacccacagagggaacaacgacagtgaagatagaagcacgtggctgcagggagacccgtagacgctgtgttcaaaagcggagagcgtcaagggcagagagataaatggggcaagctctggttcctggaagggcagcgatgtgcctcttgagagctgtttcctgtagtccttgccccgtgccaggcagccgagtgaggctcatcgcagcatgtcatgcaagggctggcaccaccgccttcagcggtctctgaggactgcactctgttcagtggtgacacgctggggcagagacaccacgccaagagccattccagtggctggagaggacatttagaacagcaaaaagcaaccaaagtcgaagctgcacaatacgctctggttaatacaaacagcaggagagaactagcggcgtagaaaagttattctgggatgtggtgttccagcttccttggtgaaaaatgtactgtagtttcctgatccagagctaactgaaaagtgaaatgtgtttacagagctgagcattctctaacgggtcattttgttatttcaaagagagatgtagcaatgccagcctaaatagtgctgctggagaaacgatcaggcaaatgtcacacagctagcgactctcaccgtgagcccatttctgagtggctctcgcctctcagcagttcttataatcctggctcaccaaccttttctgtcttggtgaagtctgcctgatggttttttagcaagcgctggtgagtcagtttccctgagacttgcaggcttaaggacaggtagctgttctcacgtgcggtgatgctcctggctcccatggaattaaacctttgcttactaccaaataccagtagcgggacttcaggttctcacagttatttgcaaactgcttctacagatcagattgagcttgtaggatcaggagtctatcatctttgttttattaatttttaaattttttgaacctccaatgaaagagtcttccagaatcactgacttccctaaggagggtagaagcattccactgctggacagccacagagcttatcagggaatcatggttcctctagtgtgctgtcttaatccctcttcctgactgccagagtgacttgactgaagttaacctttagaccgcagtgccatgcaaaatgcgatcccagcgcaaaaagcatctcacaatgccgtgatccatcaggaggttagcacgggactttccatctcacggcgacattaagatcaagatctgcagtacagctgtgggctggattctgtataaggtcacacgtaaaggagaacagaaagaggagagtgaccagcatcgagtgtgtgggacagtggccatctcccttagcagtggccaccttccctggcagtggccatctcccctggtggtggcagggtcccatggcggtggtcatctctcctggcagtggcaagcctggaggctgagatgtgagggaagaacctgcccctgtggcagtcaacagtgggagagtcctgtcctggacagagccatgtctgtccctaaaaagctaccatgtgccaccgtgaagatgatgattttctggaagatgggacaatcacttctcagggatcattttgtaaaaacaaaagcaaagacaaccacagacagcagtgctgtgagccctggacacaggcagccaacaactagctcttcctctttatgagcaaaacacaaaacgagctggtttcggggatctcttcaaggaagcacaatgtgaagcatcctctgctccccggacatgaggacggtcagctcattgaggaccgtcagctcagtgaggaccgtcagctcagtgagggccatcagttcagcctgatgttctcaacaacaaacccgagtcatcaaaaagaggcctgtaggccaggcgtggtggctcacgcctgtaatcccagcactttgggaggtcgaggcaggtggatctcctgaggtcaggagtccgagaccaacctggccaacatggtgaaaccccatctctactaaaaatacaaaaattagctgggcatggtagcacacacctgtaatcccagctacttgggaggctgagacaggagaatcgcttgaacctgggaggcggaagttgcagtgagcccagattgcgtcattgcactacagcctgggcgacaagaatgaaactccgtctcaaaaaaaaaaaaaaaaaaaaaaaaaaccggaatgttcagaagagtctaggtaaggagaaattttaagtttaaaacagatgtcgcctctggaaagggtaatcttcagtgactgaaggagcagtggatgtccaccctacctcccagcgtcaggtgagcgtggaggcactgtggggaggagggtacagccagcagcttggcccagcaaccagaaggctcaccgagggaaggaaagcactttcggctttgccagaaaaataaaagctccaggattctgatccaccgtcactttgaattttgtagctttttattctgatttagaattaatgtgaatgaaatggccaagaacagccttcaaatttccactcatcctgcttgtaatcagtagcagtttatacaaataccaggagcataaggttaattgatttttctttttttagttctagccgttggcaccaaggagcagaatagctagttcataggcaagccagaatcattcactgtacttaaatggttattagagagggagaaattaatctataatgttaacacaagaaatgtattccagagtggttaggcagagcacattggaaatagacctttcacagatggccattttttttgtgaaattactttaagtattctgttttttaaaaggcagaaaaatagaactttcttcaggacattgtctccaatgacccacagcaagagccaaagagaataagaacattgaggacatccctgtagtgagaacacacaatcggggttccttttcccagtcaccacaaagtccttcatttcccagtgccattagcttgtttagagagcttgatgatcatttaattatcgaagctggtgcaaggatccttttttttttttaattttattttgaaataatttccaatttcagacttgtggaagggccaggaaagtaatttaaagaactcctgtattcctttacccaggttccctaaatgtgaacattttagcatgttcgtgttatattgttttttttgttttttggggggggttttttgttttttttttttttgagacggagtttcgctctatcacccaggctggagtgcagtggcgcgatatcagctcactgcaacctccacctcccaggttcaagcaattctcctgcctcagcctcctgagtagctgggattgcaggcacctgccaccatgcctggctaattttttttatatttttagtagagatggggttttgccatgttggccaggctggtctcaaactcctgacctcaagtgatctgactgcctcggcctcccaaagtgctgagattacaggctgacctcggtatcattctttttctatatctctgtctgtgtgtaggtacagacatacacatctgttaggttggagcaaaagtaattgcggtttttgccgttacttttcattttttttgccattacttttgcaccaaccttaatatatacttatttttttctgaaccatttgagagtaagttgcagagttaatgcttctttacacctagataattccatgtgtatttcctgaacataaggacatctcctggtactatgttcttttaataattactccagcaagctaggtatgtagtgcaggggctctgcaggtaaaaggaggagggagggtccctggcatggctgtgtcacagatcagataccataggcagcttgggccacatctcatcagttctctagggtggcaggcagcttcattctcttggcctttctgttgggccagtaacaatgatgccaattaaaattgagatctcaagatgggaaggtttgtcaacaacatacaaacactaaccagccattggagactacagaagtcacatcatgctgtatctaggtttgatttaagcctctaaactagtctaagacagcaccttttacttggctaattagaggcaagcagtttttcctattctttaatcattactctctcaaatacttttctgcttagcagagaaattggaagaaatgagacatttaaactaataatataaataagcatcactactgcaagcctctgggagcttcaatgatgagtgacggcataaatacagaccctgtgtacatcaaagtgtatgaattgacaggtttccattgttggcagtgaaggtttccaacaacgatggccattacaacttttcttggaaaaagagctttaaatcctctaaatctggccattaacataaagaccaaatggagtacatgtttttattccatagattacagcccatgataagccagaaccttcaccctcatacacacgtggctctcacacctacaggaatcccctcatttaatgtgtggcttatggcctctgtctatcagcaaactcatcaacggaatcagccttcctccagaagagagttttccctttctgagataatgctgcagtgctgtaggtgagctgagtactgtttaattttgtcagagaaaccaaagactatatgaagttggcaggaggtgaaaggggtcccaatcccttagaaaaaattactattaacatgctctctctatatggtgaaatgaacagttaagtggtagagaagggcataaatgaaaagatatctccccaactactggtcctactcttcatgatcttttctgtaaccttctagaatgtttctgtatgtataaacgtatacacagatgaggttgtgctgtgttaaacacaccttgcgtctttcacgtagcaatgtatccgacaggtgtttccgcatcagctcacgtgggtttatagcattctttgcgtgtccattcccgattctggacttgcaaggccaggaactgactattctccaaatcctctcctttgtccgttcttattctccagactttgtgtaccaaaatgcactggcttcagtgggcctccaggtcttcggtgagcacgtttccagaaccttgggtgactaaatgagcaaactaaccccactttataacccttaaccgtgtgcccctgcttgtgttggtcatgcacgtagcccgttccctgagcatgctaatcttcagagaaagggcagaccaatggccagacccctttgctggatagctccttagtatggacattacctcccaggaagcccaagtgaaatgcaccagcccatttctgctgttatttaacttaaaagaagacgctgtgcaaccacaagtcagagagctgtgcagatggtggcgatgcggttgctaaggcgctccactgtaccccagcactgggacctgaatacaagtgagggttcccctacgatgaagtacctcctgcatttggtcatcgtaaggggtagctcccacctcgttaggtttcctttctccatagtcttgcaacatccctttactctttatttgttctgcatctttcctcttcttctgggttttgtttggttttgctttttaacagcagtgttttgagctactcatatttcccataattcccatagctgagaccatggggttgtattctacatgactgagacgccgaggtaaagggcaggggtgagaccaacacgtgtattgctcatgctcagaggcctctcccaggtaagaatcagccacgaagccaactcctgcattgcatctcagtctcccccacaccctatcacagaatgaaaggggctgtgagcaatgtgtttgccacacaaggctccagtgggggcacactgcaatcccagattccacccagagtccgtgtcattcatgttttgtaacatctttaccaatgcctgatttctcttgggtccgttgcattcattgaagtttgaccaaatgggtaggaatatcaaaaacgacaaaggagttcattcctgaatccagagatcagaaagagggaggtagcttattaataacgttccttcgtccctcagagatcgatcacatgccttttacatgctagtgcttgcttcgcagggtgtaccctatgtctgtcctgcctcctcgctgaggaagggcctcatgcccactagttccctggatcctcacaacagcctgggaaggtggatggtcacatcaccatcttaccttcgcagagagatgcactgagtttgccaaagctatatacattggggctcttgatctctggccacatccttctcccctctgtgtccccactttcccttgggtgccgacatcgcctggtctcagggagttcagcagtcacacgctgactggttgggtctgaccaccccagtgccctcttcccctttatctctgtcccatacccatcgtgtggtacgtcacatcccagagggcaaaagcctcagtcggcaaaaggcgcgggtgacctttggaggtggagacagtgcgcacccagcccagttttgctcacaaggtataaatgttacttttagtggccatgtgctgttgggtggcctacagctctgaggccatggacagccacacctgcccgctgtcacagactgctgtagaggctgcccttccaatggaggtggtgatccacctgcctgcctcatccctgaggagtggcgggaggctgcctgcagtcatcttttactcattcacttggcgttcatgcagtcatgctaggtgccccctcagccctttagcctctttgcttcttcttgctccctgctcagctccaagatggcacccgaggccattgcccatcaagctcatggtgatgagtaaggttagatcattgatagtaggaagaatctcttccacattaggaatgcagtaccttcttgaatctactgcttttcctttctccaaggatccaaaaatctctggttttccttatctttttcagtaggcggtggtggtggtggtggtggtggtggtgatggtgatggtggtggtggtggtggtgacggtggtggtggtggtgacggtggtggtggtggtggtggtggtggtggtggtgacggtggtggtggtggtggtgacggtggtgacggtggtggtgatggtggtgacggtggtggtggtgatggtggtggtggtggtggtggtgatggtggtggtggtggtggtggtggtggtggtggtggtggtggtggtgatggtggtggtggtggtggtggtggtggtggtggtggtggtggtggtgatggtggtggtggtggtgatggtgatggtggtggtgatggtggtggtggtggtggtggtgatggtggtggtggtggtggtggtggtggtggtggtggtggtgatggtggtggtggtggtgatggtggtggtggtggtggtggtgatggtggtggtggtgatggtggtggtggtggtggtggtggtggtggtggtggtggtggtgatggtggtggtggtggtggtggtggtggtggtggtggtggtgatggtggtggtggtggtggtggtggtggtggtggtggtggtggtggtgatggtggtggtggtggtggtggtggtggtggtggtggtggtggtggtggtggtggtggtggtggtggtggtggtggtgatggtgatggtggtggtggtggtggtggtggtggtggtggtggtggtggtggtggtggtgatggtgacggtggtggtggtggtggtggtggtggtggtgacggtggtggtggtggtggtggtggtggtggtgatggtggtggtggtggtggtgatggtggtggtggtgatggtggtggtggtggtggtggtggtggtgatggtggtggtggtggtggtggtggtggtggtggtggtgatggtggtggtggtggtggtgatggtggtggtggtgatggtggtggtggtgatggtggtggtggtggtggtggtggtggtgatggtggtggtggtggtggtgatggtggtggtggtggtgatggtggtggtggtggtggtgatggtggtggtggtgatggtggtggtggtgatggtggtggtggtgatggtggtggtggtgatggtggtggtggtggtggtggtggtgatggtaatggtggtggtgatggtggtggtagtgacggtggtggtggtggtggtggtgatggtggtggtggtgatggtggtggtggtgatggtggtggtggtggtggtggtggtgatggtaatggtggtggtgatggtggtggtagtgacggtggtggtggtggtggtggtaatggtggtggtggtggtgatgagggtagttttccacattaacatcttgcaaaacaagtagttcaagatcttctccagtttgacttatagtagattgtctatttccagggctacttttgctaagagctgtggaaggctcatttataatgcattggcagaccttctatggtggaaaaggagacgatgtttctcaccaggccgaatctggagtagaaatagctgtgctgccccctgcctcttggtgggggaaggggacttctctgtggtttgatctccctcagaataaaaagttctcctgagtctcgtagctgatctaaccctcaggtcatcctgcagcccttccaggctttcttccggtttcttgctaagacacacccatggctcatttctgtcccgtggttgatgtggctgaacttcagtggttcagtttctactgttcgccctcggcctgtgcctgcctcttatctctccaccgaagtgaaccaatttaagaaaagctttcatttgttaaagtgagatttctccctctttgagttcagggaaaattccaaagagatttacagtgagaaagaagaggaaggtgtttccagcagtgagcagttttgagaccagaagccacacagcagcactcagtgtgactgcagggcagcaactgggttgatctaggctccacaacttcccctttagctctgcagacctcagcacaggcggagcacgagcccttaaccaggaagggatttttgccccattttatcacagtacttagctttttgagcagtgggcaccctcaggagtgacccttctctggacaccagctttggaattggatgtcctcaagcctccctctccaggcttctcagtggggaggtttctgtggtcccctttttagagcttgggaaatctccttttagtttgctttttaatttttccttggcagtaaagccatggcttttggaaacgtcccattggacgatgattcatgaatgccataaagacaggactaaaaggaaagggtcagacctgtgcactctttttgcagaacacattgataaatttagagcaggacagacatccagcctagacgtctatctgtgcagccctaaattcatcaacgtgtcctgtgaaatggggagagaacattttactttgctttgctcatccttttagggactcagtccttttattagattttttccagaaattccttcttgctcatctttgcatggttagtgagtatcaagagaagcacagatgatctctcattaaaggagcacacatcccagcctctgggagccctgactgttgattcacttgaattcttccaggcaataagcattgatgaatcaggttccaaaaggatgttcccaatgccgactctactgagctgtcacacttgctccaaatgcttttgccttgtgacttctgccgcttctccattctccgctctcacatacggctgctcctgcctgattccctagtttggcttcatgtctgccctcactctgatcttaggacctactcagcctcacacagtagtcttgttatatccctgagtttctcagcagcaggtactgttgacatcttgagccagtcattctttggggcgggggcagtgtcctgggccttgcaggatgttccacaccatccctggcctctgcccccagatgccaggcttgtcccacccaagtcatgatgaccaaaaatgggttccctgggggaagaatcatccctggttgagaaccactggtataaccagaggagggctatttctttggctgttgtcatctgaatgtggaattccaaggaaagttggtttctgtttgtttaactgatgaattaagtacagactcccgattaatttctaggaagaaacagcatgcccttatttatttttcaaagagcctttctccgtgtttgcaaatggcctgtgcacatagggtgatgtgaattgcagattctgcctctgctgaccttggctttgaggtactttgtgctcttccaaggaaatacaccatggaaacgtggggtgtgagagtggaagctttgccagcccacatgtgggaggcaggacggatgtgacagtaagcctcatgtctgtatggctccacagagtaacttgaaagcccacaggcagcccctgcctctcatcccctctgccccaccacacacatcacccacatactcaccattcattgtggtgtgaaatctccttgggtgaagagtagatggttgcttattaaaatggaaataagcccagaggctggacgcggtggctcacacctgtaatcccagtactttgggaggccaaggccagcagattgcttgagcccaggagttcgagaccagcctgagcaacatggtgaaaccctgtcaatacaaaaaatgcaaaaaatagtcaggtgtggtggtgcgcacccgcagtcccagctactcaggaggctgaggtgggaggaacggttgagctcaggtgttgaggctgcagtgagtcgtgctcccaccactgcacaccagcctgggtgacagagtgagaccctgtctcaaaaaagaaaaaaaaattaataagcccagaaaggaaagctgtttgtcataaagaccttactttgaatttatgacatgctttccacctcaacaggtacttaggagcaggttttatttgatgaaaagtaggtgggaaaagggtaatgaaagtagcttcgtcgctgggcgtggtggctcatgcctgtaatcccagctactcgggaggctgaggcaggagaatcacttgaacccaggaggcagaggttacagtgagccgaggtcacgccactgcactctagtctgggcgacagagcaagactccatctcaaaaaaaaaaacgaaagtaggttctcaagcacacctcctagaagataaagtgtgaaaaaagagctgagaaagcacagcccgtgagactcaactgccttataaaaacactagcagcacgtgctggcctctcgcctcggctgggttctgtgcaaaaccccatacatttcaccttcctgacagccttgggcaggaggtgtgattgttctcccagtgttacagatgagcaaacttggtggaccccacttcacagttaatccagagctattctctgttagagacccaaggatgcctggttagtttgaaatgtgtgctagctcagagttaattcatattggccctgtggtgctagcagcaggtccaagggcagtaattggcagcatcttgaaaatcattcttaggatccttagtgaaactcccagctcttcctgcttcagagtcaccctgggctcccggggacttcaacacgccactacccttgtgggtggctgacaaggtgaagagaacactccttccccacttttggggtcaggctaccaagccgtgctgcctaagcggctgtgtgtctcagcgaccccagtgcaacagttctgcctggagtggaccctggaggagaggaacagccgagacagcaggcctctccctgcctccccagggcgccatgcaaacatcctccagcctgagaccaccctgcaaataagctccagtcagtcacccagcctgcccgctggccagctctgtctaggtgtgctaaatcctagctgggccaggtgcaaatctcccagccttgccgccacacctacctcatatcgcttgaagcttaatttaggggctggggttgctggagcagcccagtaggaaggcaaggataacacagtttttacttcactacaaatattgcggcaaaaaaacagatgtggggcagtaactcaccccgtcgcttggtccaggggtaactgcctgcagccccagccgacatcctggcctttcaacacggagctgtgactgacggccctgcgtgcgtggcttccgtgctctcagctccgcttgctcggtgaggtggacgtgaggggacaggggctgtccccttgttgctgcctcattgccagccgtgcaattcccacccagggcttctgttcggggtgtttcagggtttacagttgggtaactcgttgttgtctgctgtgcctggcttttcaatccaataggcctgcaagtcctccgagattcctcctcctaaccagcccggagttccccagggccgtgcccctccccagagagggccctcggagagctgctcccgcattgtcatgttgactgacctttccttctttttgtcttttctccacagtgtggcaaaggagcagagaactttgacaagttcttcacacgaggacagcccgtcttaacaccacctgatcagctggttattgctaacatagaccagtctgattttgaagggttctcgtatgtcaacccccagtttgtgcaccccatcttacagagtgcagtatgaaactcaccagcgagaacaaacacctccccagcccccagccctccccgcagtgggaagtgaatccttaaccctaaaattttaaggccacggccttgtgtctgattccatatggaggcctgaaaattgtagggttattagtccaaatgtgatcaactgttcagggtctctctcttacaaccaagaacattatcttagtggaagatggtacgtcatgctcagtgtccagtttaattctgtagaagttacgtctggctctaggttaacccttcctagaaagcaagcagactgttgccccattttgggtacaatttgatatactttccataccctccatctgtggatttttcagcattggaatcccccaaccagagatgttaaagtgagcctgtcccaggaaacatctccacccaagacgtctttggaatccaagaacaggaagccaagagagtgagcagggagggattgggggtgggggaggcctcaaaataccgactgcgtccattctctgcctccatggaaacagcccctagaatctgaaaggccgggataaacctaatcactgttcccaaacattgacaaatcctaacccaaccatggtccagcagttaccagtttaaacaaaaaaacctcagatgagtgttgggtgaatctgtcatctggtaccctccttggttgataactgtcttgatacttttcattctttgtaagaggccaaatcgtctaaggacgttgctgaacaagcgtgtgaaatcatttcagatcaaggataagccagtgtgtacatatgttcattttaatctctgggagattatttttccatccagggtgccatcagtaatcatgccactactcaccagtgttgttcaccaacacccacccccacacacaccaacattttgctgcctaccttgttatccttctcaagaagctgaagtgtacgccctctccccttttgtgcttatttatttaataggctgcagtgtcgcttatgaaagtacgatgtacagtaacttaatggaagtgctgactctagcatcagcctctaccgattgattttcctcccttctctagccctggatgtccacttagggataaaaagaatatggttttggttcccatttctagttcacgttgaatgacaggcctggagctgtagaatcaggaaacccggatgcctaacagctcaaagatgttttgttaatagaaggattttaatacgttttgcaaatgcatcatgcaatgaattttgcatgtttataataaaccttaataacaagtgaatctatattattgatataatcgtatcaagtataaagagagtattataataattttataagacacaattgtgctctatttgtgcaggttcttgtttctaatcctcttttctaattaagttttagctgaatcccttgcttctgtgctttccctccctgcacatgggcactgtatcagatagattactttttaaatgtagataaaatttcaaaaatgaatggctagtttacgtgatagattaggctcttactacatatgtgtgtgtatatatatgtatttgattctacctgcaaacaaatttttattggtgaggactatttttgagctgacactccctcttagtttcttcatgtcacctttcgtcctggttcctccgccactcttcctcttggggacaacaggaagtgtctgattccagtctgcctagtacgttggtacacacgtggcattgccgcagcacctgggctgacctttgtgtgtgcgtgtgtgtgtgtttccttcttcccttcagcctgtgactgttgctgactccaggggtgggagggatggggagactcccctcttgctgtgtgtactggacacgcaggaagcatgctgtcttgctgcctctgcaacgacctgtcgtttgctccagcatgcacaaacttcgtgagaccaacacagccgtgccctgcaggcaccagcacgtgcttttcagaggctgcggactttcttccagccattgtggcattggcctttccagtcttgggaggagcgcgctgctttggtgagacacccccatgcaaggtcctcagagtagccgggttctaccacaaacagaaacagaatgaaagtagctgtcagtccttgtagagagccgctctgtttcctcccagaagcatctcccagctaagctcgcattatttttctcctctggctgtttgcctgaagttcacagaacacacaaccatgaaaggctttttgaggtgagaggcccaggtggtcctggcaaccctgagtagaaggagagacggggtagggaacgggcccggccagaaaagaaccatttcttctgccatcttttatgcaccatagacatcgagactccagggggtcctggctcccctgtccctgcagccctgcaggtcagtgcatgatctgggttcgtgtcctgaccaggtgctcctcctttgatccgaggggaaagggactggtttatagaaagagcctaggagacaaaagggccagtccccctgcccagaatggagcagcagcaggacagacccccacgaggccccccagagaggaggaagatcccacggaggaacacatgaggttagggacccttgttcagcaccccaaacagcctgcctgtttaaagcaggcagcaggcttaggccttccctgcaaccccaacacccacaagtttgtttctctaggaaacacattcactgtctcagctggctgttactctctcagaccatatggcaaagttttccaagaaaatgccccgacaggggtgcccagcacactgcctgagggacaacagacatcagaacaaacccccagagagaaacagtcaaaatcagggcccggtgcagtgttgtcatgtggaacctgctttatccattgctgagtgttgaatgtgggtaatggttagggctttccagatctcagcagccaaagacagttattgttggaagactgtcatgtagataaccatgagcaatggctcgcctcagaatcagttcataaaattctatggtactggccccttcgtgggtattgtgtgaaatgagatggtggcgaggggtgcgctgtggaactgccgcagccacgcaggaggtccctgggggatgctttgggaagtccttgcccctgagcactgcctgattgccagggcctgtggaggtctaggccgcctggcagaatctagcaccgtccgaatccccgcaggacccatggagctatgaccacaccaggccattcaaatggctctgcattatcttcccttggaaggtggccactcctcggtggcagggcctttccctgaggctgcaggccgtgggctggcagcccgtctcttggcatttcaattgaaggtcaccaggtgctgggtttgaaaggaagtcactggagtgctgccaggggccgccctccaaggttaatgagaggcccacatccaggcaagaactaattcaaaaggcagatcagaaaccacaggagtcaaaattattgctccggcagtgcttcccttcctttcatccactggcctcgtgtggtccatgcagggccactgtctgccctttctgatgccacgtattaggctttcttactcagaattttgatagaaaaccatggggccaagagctctggaagcctggccggaaagaccaaggttcatgcagcccaacaaatgattgttgagcacctctcggagccaaagtccttaggcgagtgtggtgacttcctggaaggaggatgcagacttccagagagcccccccaacggacgtgctgagaagggagagggaggcgggggctgtagtcaggaaggagccagagaagaacagggtttgggtgcatccagaaatatgcctgcagtaggagggagaggaaggggtgccaccgtcaacggcttcccatcggaggtggttggtgcagatggaagtttctgtctgctggccctcaagagagtgttttgccagggacacagtctgttcctcctcagaaaacaccccccaaatgctaacaacatccccaccagctgctagaagcccctttcccctccccaccttgaagtagctcatagttctctgggcagagccagaccatccagtgtaccccagaggccagtaggttcctgcccattttcctctctggcttcctgccaagaattatggcagctgaggatgaatggagaagtaaaaacaactaacaccgcacaactaacaactaacaccgcagttcccacctgggttccacttagcaggagacatttcggagggttttttttgtttttgttcctgttttttttttttttgctggaatttgttttctcagtactgaaaagagaaaaagtgacaatcttgtatttttaaaagcctcggaaaggtgataccatctgacagtcattttctcacgttggtcttctaaagtcacctatttcttgtgtgtgcacatcacaccatttcctgtttctttataacccgacaagggtaggagtgcctgtttcccctgctgggcacaccagacaatcgtaatcacaaaacagacactgagccaggggcccaaagggtgtgatcatgagagttaccgggacagcagtaggcatgacagtcaccaggaaggacaagggtgctctgttgttagtggccacacaccaatttgacaaggagtgttgcgaaatttttatttatttatttatttattttgagatggagtttcactcttgttgcccaggctggagtgcggtggtacaatctcggctcactgcaacctccacctcccaggttcaagcgattctcctgcctcagcctcccaagtacctgggactacaggtgcgtgccaccacacccagctaaattttgtgtttttagtagagatggggtttcaccatgttggccaggatggtcttgaacccctgacctcatgatctgcctgcctcggcctcccaaagtgctgggattacaggcatgagccaccacgcccagccaaaatatttttttaaagtcattttccttaagctgcttgggctacatgtgaaatacactggacggtcaacattcctgtctcctcccatttgggctgatgcagcagatccagggaatgttacctgtttctgctgctagaagatccaggaaattgggaaggttacctgacgcacacatggatgaaggccatcatctagaaatggggtcaaccacaattgtgttaattccgtagtgtcagggattcttcgggaaggtcaacagtatgaaggattctgacccctgtgcctcccatttatgtgatcaggtgacagttaataaccgtggaggtcacactcagccatccaacagccttacagtgaccctacacaaaagcccccaaattccaaagactttttcttaacctaaaggaagaaattatttgttaattccagtagagcaactgaatatactgggctatttgtacttttttatagagaactttaataataattctttaaaaatgagtttttagaacaaagcaactgacgatttcctaagattccaatgccctggagcttgtaggaggacttagcctgggtcagctggagcacccccgacctgatctcccactgccagattttcccatgctcctagggtatggagtccacgtgggaatgactgcaagttcaggtggaacttggccgactgatgctctgcgagtttttaatagacactggggacaactgcttaaggtttagaaacttccaaaccacaggaaagacatttttagtgtcccccatccagaggcagccctggaataggattcccaggggtttctgggacccctttccttgctccgtgaggctctgtggccatcttttggcaggaggaggatgcttccttggctctgtgcccagacccgcctggtccccaggtctctcaccttgggtgaagattcagagatgccctgtaaggattttgcccactgggcaactcagaaatacttcgatctcccaagatataagaggcagcagcaaacgtgcctattgacgtctgtttcatagttaccacttacgcgagtagacagaactcggcttttcagaaaataggtgtcaagtccactttataagaacctttttttctaaaataagataaaaggtggctttgcattttctgattaaacgactgtgtctttgtcacctctgcttaactttaggagtatccattcctgtgattgtagacttttgttgatattcttcctggaagaatatcattcttttcttgaagggttggtttactagaatattcaaaatcaatcatgaaggcagttactattttgagtctaaaggttttctaaaaattaacctcacatcccttctgttagggtctttcagaatatcttttataaacagaagcatttgaagtcattgcttttgctacatgatttgtgtgtgtgaaggacataccacgtttaaatcattaattgaaaaacatcatataagccccaactttgtttggaggaagagacggaggttgaggtttttccttctgtataagcacctactgacaaaatgtagaggccattcaaccgtcaaacaccatttggttatatcgcagaggagacggatgtgtaaattactgcattgctttttttttcagtttgtataacctctaatctccgtttgcatgatacgctttgttagaaacattaattgtagtttggaagcaagtgtgtatgaataaagataatgatcattcc

SEQ ID NO: 37849 - DNA, 68631 bp, Homo sapiens; identical to SEQ ID NO: 35736

SEQ ID NO: 37850 - DNA, 397827 bp, Homo sapiens
cgcccttagccgatcggggcgctcagcccacacgcaccgctgctcggggcttggagatccgcgcaggctgggctcccggacccggcggaccgacgcgcggaggatcgggatccggcgctgtggggctggggtgggcgggggaggctgggcccggggcctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggtgagcaggacgttttctggtttctttccagtggtttgggttagggtgaatgggctcggtgcgtggactgggggctggggctggggcagggggacagcagcgggagaatgcgtcggggagggaacctggattcccgttttgattcggggttgctgaggtgctcctggctgagcccctacggcaggggctgtgcggtacgtgtcttcctctggccgtggcttaggctctcccgagggctcgtagagcttatgccagtttcatcttataccggtgtaagagcattaaaatgaaaggcgtgtgtgcgtgtgtgtgtgtgtgtgtgtgtgtgtgtacacgccccgggcagttgtctggtgccaaggcgcgagacccgactgtcccttctgcaaaaagaatgccagcgtgaataaaggcactggcccctcacgttttccagctacctgcaagatgacattgtgaggctggctgtccccgcgaagccgaacctgccgctccaagggggcagttattgctatgctggtcttgtagatggcaactgcctccccctcccccttttctacctcccgcgcccgggcgccctctcagcgctcccttaaatgccagtctgccactcacctttatttatggctttaactcagccctgcctgttctttctgactttgtggctgtaacgtttcagttttatggctgaacttaagcaggtgaaagggatgtgttttctgcttttcctcaatcagaccggaactccctggagtgtgtgcgagtgtgtgtgtgtgtgtgtctgtgtgtgttttccccgtgtctgtggccagtcctttgtagagcacctccctccccccagccccactggtttgcgtttaccttcacgtgaattacctcagacgccgtttcattgtattgactaagacatcactgatatagaatccattttgctgttgttttgagatcagaataccaggaatccaagtgctgcttcgacgcttccccacccccaactcccgatcccaacacactcctttggggaagggggcagagctttcttgccattttaattagatgctgcctgcctggaagggggtgaggggtggggatggtggcagcagcgggtgtctgagaaggattggacaccaatttaaggactgcttcttcctctcccgaaccaaaaataaaattaaaaagaaagcgagtgcatatacttgatgtatggagggtggatgagaaggaattcatggtggctctctacagggagacaccaggatggatgaagcatggaagttcacacgccctcctgaggaatacattgttagattgatgctgaatcttggggccatttacctggattcctagtacttctgacattgccgctatctgcactgatatattaaagtgctacctttgtgatcaaagtggtactttctctttggtctccttaattaaaccttttcctccacatctctttgaataagtctttctctcttcgtcttaatctgttgggctaagagatgaggtttcagcaaggcaagtaaggagttgagaagaaacagagatgccgtttgaaatgggctgttctgatagttgggcagccaaagctcattcatgcattattacaggaagctgtctatttccctggagtggaaatgccacatcaagaaccggctgccccctgcgcagcggggtggggttggtaacagggtgggtgcattggccaggtctgtggcttcctgctttaccgactgtgtgtgttcatttgccctactttctacgctgggagttgctgccggcgagttaatcaggtggatggatggccccgactgggggtggggtgctgcgaatcggtcggaggtcggggtggggggcgggaagtggcaaagggggaaggggtctgaacaatgcgcagggcttgcggtgatttccctgggccggaatctcgaccttgctcctctactggaaagcagtctgatgtgattttaagttgggccgggacttgtcccttatgggctttttcctcgggaaggttttctgagataccaagcacggagcctgcaggcaggggagcaaccggtgagggcccactgggcggacgactgcggttcacacttgggatgtgctttcttgtgatctgtattttgaaaatatatctttgcacaattcactgaaattgctctttgtggcctgggctatcagcttagggctctgcttctgtttttctgcctgctgggaggtgtggaaacagagagggcaacagctagcttggggaccaggaactgctggctagaagacttagatgcagatgtggagacagttatatcctggagggccagggtctttgaccagtcttgtgggtgaggtgtgtctgctggagtgggtccaaaggccacataggtaatctccacaaatcagagggcagatcatctccaccttgccacatttggagaggtggcctcatctagatgagatgtctcatttgttcctaagcccttggtaaagtctgcctgctgagcccctcctggggaatgcctgacccctgaaatgcagccaaggtcagtggcttctgggagaatttgctgcagacttaccagtccctcgctgtttcggtggctctttaatgtacacagtcaatgctctttttgtaaaccctgggctcaaagcattaaaagcagatcctgtctagagaggcctttatccttctcactttgggggcttattgttctcagccagtgattccagaccggacccagtctaaattttccccaaatagcaacaatgcataatttaaaccagagcaaccaatgacagcactgatcatttaaattatgcaagatttgcatggtttaaaagtgagtgaagcaggatcttctttggttagaaaataggtactttgaatccagttttagccctgatttttagagctcagagataaactaaatcttgagggatgggctggaattgttttatagattcagagctggaaagagaattgtagaacactcagccactcctttcattgaacacttgggaaactgaagcccagaggcgtgaagtaagttgttcaaggtcacacagtaacaaggggaggggacagcgaggagcgtggtttgaggaaataatctagatttcctgactcctcattcagtgctcttttctctaagtcacactttctgtggtggaatcagaaatcaataatacattttctgcctgagtacaaaagaatagcagaaaggaataatttcaccagggtcagggaattttatttattgagaatggcgaaactacttcatgcaagtaagcttgtgatacatgaaaccatggagctctaggccacctttggaattcatcttgtccagccctggttcaatgcctactctgcaggcaaacgactgtctgaaatcacctaggacacatggttgtcctgcacaggtaacctctctgagtaacctgtgtccatcagagcatgtctcaaggggtcagtataaacatacatgttattcagatggctctgcatgtgaggtttatagagttgtgtgtatgttttgtattatctatgtggatacatatattatgtgtagtattatggatataaaccgtatccacgtgggtgtatgaaaatgtgtgtatacatacataggctacagcaaacaatttactcattcaaacctggggcttgagtcattcttgcttcaagacatctcagtattaaaagagatgaaagttgccaccagtgtgctttattacatatgaggcgagctcagcccagaaagctttttggagattagcatatttctggacctaagcaccttggctgtccttaacttggcccacagggtaaggcattcaaggccaggagttggctgctgctgacctcatactctcagcttctgccaggactcacatacacttttgtatttgaacaaaattagatgatctacacttgtctttccccttagccctcattccctagccattcctttctccattgaaacccagatttaagaattgacctcatctgaaagccttgcatacatccctttgctacacttttcatgctcatgttttacttggtgtgtgatttcctttctgcttctttactaaaccgtggacttcttgagggcagaggctagatcttgttcatctttggagccatagtctccattagttggatgaatgagtacgtgaatgaatgcttgaatgaatggagtggaatgaaccctgtctccccagttctatgtccacctcttattcactctgtgactttgggtaggacatttaaccatagttaataagaatcatcacaactgtttgcctttctcacatactggtttcaaaatcaataaagtatttaaggcaatgctttaaaaaccatacagcactgtacaaatatgctatcccatggttaagtagaatttagtgggaaaattgataccatcaacatttgattgcaatgattttatctaatagaaaattatctttcctgggcacagtggctcacacctgtaatcccagcacttcgggaggccgaagtgggaggactgcttgaaaccaggagtttcagatcatcatgggcaatgtagggagactccatctctaaaaaaaaaaaaaaaaagtcagtgtggtggtgtgtgcctgtggtcccagctaattgggagactgaggtgggaagatagtttgagcctgagaagtcgaggctgtgattgtgtcacggcactccagcctcagtgacagagtgacatcttgtttaagaaaaaaaaaagaagactaagaaaagaaggaaaataatcttcagaaaaagatatcagaaggttccgactctttttaacagtacctccacagaccttagctgcctttttccttttgtgtaccaatgtgaccttgtatgtttctttgatggcctgaattgagctttgcgcccccagtattaagcattcattacatatgaggtaagtgcagccctgaagttttttggagattaacatatttctaaactagtatcaactatcagcattgttcattaaaaccttcttttttaaaaaaagttttctctctttatgtattaccgattattcaaatacaaacacattgatcatgactgtgccttcctaaagttttatcttttcccttgggagatagagtggacacataaaatgatacactaatggcccagtatttaaaactttctggtgagaggtctcatggggctcaaagaaatctcgaaacattattagttcattactccagagcacttaattaaatttggtctaaaatgagattttagtaaagttgcatgagttgataacagtatctcaaaatgataacagcatggcaattttttcattagatattctttttatttttcagagatactaaacaggtgttttctttacaatggcattgcctcataaaaagtagggtgtgctggtatttatcagaacatcagagaaatatgcataatcattttcattattcattattaactggagtaatctttagtacaaaagccagtgtaagtcatggtttgctgtttgcataattatctacttaggaggtcatgtaatattttgttgatgagagagtacccagtacatttctttcaggaaatattccttttttcccccttatctgtaaaactctttgatatcttataatttcgagtcttgcccgttcggcctttcttctttctgtgtctctgccctggaattaatcttccgtgcccttcttgtttcgacgccattccttctctcagtgatagtggttctaaagtccacccagccaggcgctcctgtgattgaatcatggccgccatgcccagctgagcacaaccagtctctgattcccttcctgatagaatctggagtaacttgagtctgaaagatgctttaatgtcaaattgattcttacatttctgtgggggaagtagctctctgagaacagggcctaaactggtttgttagcagtgtgctgagaattctaagaaaatcttaatgatattttttgaatgaaatgttattctgcacatataaatataaggtctctagtggagagagagggaggacttaagtagaaaatgttggatgaattccgcttgtgattccttccagtctggttggaagcttatttccctttagagaaacatgattctatccactcttttttacatgtcctggttgtctcatgggggtgccctcagtttctcaaaacacattttatatcaccccaacttaaaattcttcccttaatgtttatcatatgggtccccttgtctccactgttccctgcaagtgctgtagttactgtcccctgggcaacacccgcaacaggacctcccctcctcctgtgtctctaccaccagccttcttctgactggtttctcgtacactgtagccacgtgagtcttccaaacgcacagtttcaatctggttgtttttattcaaggccttctctgtctccttagtctacagactgaaaactaaactctttagcatgttaagaccagcggcaattcagaggggcctcccaccgagctctgcagttttgacgaccactcccccattgcggcagggaacaatttcattcccccatggatgctctgtagggggcgctctgtcttagtctcctttctgtacctactgccccaacgctgaacattcgcagaccaccttttccacagaagtctctgatttctctcaagttgtccctcccactcatagactgtctcagaactgacctcacacctctttcataacactcagaactttctgtcttggattatattcactactagacaattcctttttagaggcaacgtttgattttcttagggatcctcaccagttttctttacacagcaggcgttcgttcaacaaataaattttgaattaacaaaatatatactgtgcaacccttttagaagggctggaggtggtgctatgtagagagagtatagaaacctcagaaaggtggggcctgttgctgaccatggcacaatttcagggatcatgaattacattatagtctaggttgcatgactcctggggacactttttatgtagagtacaattccagtggatgctaattacatagagtacaattccgggggcaccaattacgagaaatactatgcctggtcctgggtaggtattcctatttctagaatttttctgccaaggaaagtgttctctccattgtcttattctaagttttgagagatttaaaataccatgggttagaattgcaaggcgtatgtgtgtgtgtgtgtgtgtgtgtgtgtgtgtgtgtgtgtgtgtttggagtgtgtttcaattatttcaacaatcggataatacttatgactgctgttttgattaaacagtaatagatgggcgggaaagggtgtgcttctggggtggcccactggaagacaacgttgagtttttatcttgacagagctggcagtgagcgggtagagagagtttgggagatggtgaggtttaatgaggcacacagctgggagttagagcccagcgtcataaagctggctctgacaccttgccctctaagcttcagttttgtcacatgtaagatgagtggtttggactagaaattgctggaggtgacttccagcaatttgtattgctgggatgcatattcctggaatatgtaagggaactagaggcaggactgagggcatttaaatagccatggattcttattctatctgttggagataccaagagattgcaaactgtgcacctcaatgagctgggaattgccactgaacgtaacatccctttctaatttttaaatgagctatttttttccagctgtcagattctgatttataatttaaagtgttgttctagtttttgaagaccgagtgataggacgaagggctgactgtgacttccgctgggtactcccttacagtgttgctgctggatacccggatttagactctgaagtaaccctagattttaaagtgctgtctctctagttagtgaaattagaaccttggcagtatgcatcaagtaggaaatttgtagactttaacaatacattgcatatgttacaaacatttgtttgattagtgtattagaaggtgcaagtttgggtgcagggtaaattcaggcccagtattctgtgattctgtgaaatgtgattaactgtaggggaagaaatgcacatggtatccagcattcattcatttatttgtttgtgtatatattcattcagtacctgattattgggtgctactagttgctggggctgagctgaagacaacattggcatggtttctacacccatggttggatggagaagagagcctgcacttgtcttttactacactctagccacactgatttttttctgttttgtgaatatgccaagctcattcttgtagttctccgtgtcagaaatttcacatggagggctccatcttattatttaggtctaaggtgagatgctgcctgtattattacttatgtatctgcatagcagactaccctcaagcttagtggcctaaacaacaataaccatttattatatctcacagtttctgtgggccaggaattcagaagtggcttacctgggtggttttagcatgaggtatctcctgaggttgcaggaagattttggcaaggtgagctatcttctgaaggcttgactggagctggaggatctctttccaagatgatttacttatgtggtgctggatgttggcaggaggcctcagttcctccccacgtaggtggctccattggttgcttgagcatcctcataacatcgtgcccacttttaccagatagaggaatcaagaaagcagagcagaagccactatgtcttttatgacctagccttggaaatcacacaccatcatttctgcaataccctgttggctacccaagtcagccctattcatttcgaaggggactacacaagaatattaactaacaccagaaggcagaagtcactgagggccctcttagaggctccctactaaacagagaggctttctttgcaatatatctgtaaagtaacactcccttccaccctgaaactgtccaattcagtgctttattatctttaaggcagtcgtgactatctgaattttttaaaaatctggctgtcccaactggagcctaataagttttgtgagaatagggatcttgcctgcatgttcagcaccacattcctggtgctttgaactgtgtctggcacatgataaatgttgattgaataaatatcaattgtgtgaatgcaattaattcattcatttaaaagggatcttatttatttattacacctcatacctccaaaaagtaagttgtggcaccttctgataaaaggcataaataggataaagccataaaaccatgttaaggctaaaatgaaaagtaaagggggattgtgtttgcatatctttgtctatatatctacttatctatctgtctgcctagggcttggtgattggtgatccaatttacctcttttgtaggtagaaatttggggtcagagaagttacttgtcttgtccaaggatgaaattcgaatgcagtgctgggtcccgttataccacgtccctcaactggattgccaacatcctggacatcttagtgaatcagtcattcccacaacacaaaaaccagtctaacaaagtatggatacaaagatggttataaagttgcttgtatgtacggaacacactgaagatagcctgtgctccactgtgaagaaaccaaatctaattagatggtagaggagaactcagctaagttaatcaatatagataagtagcaatgcttcagatgttgaaaataaaggttacgattctatgtgcaaagaggccacctgtagaagctggaaatatgtgctgtatcttaacctgagtgggaagctacgaagactcctggggctccagggcccaaaaaatgcagactgtgaaagaaagcagactaagcctgctgagttgttaaaaatttgtttaattttttttttatgtttgagacggagtctcacttcatcacccaggctggagtgcagtggcaccgtgttggctgactgcaacctccgtctcctgggttcaagcaattctcttgcctcagcctcccaagtagctgggattacaggtgcccaccactacacctggctaatttttatacttatagtagagacggggtttcaccatgttggccaggctggtctcgaacttgtgacctcaggtgatccaccctccttggcctcccaaaaattttgtttaatttttaaaaggcttttctggttctcattgtaaaagcaatggtcattgcaatggtttctgcatggtcagtgcagaaaatttggaaaatggagaaaaaataaaaagaattctcaaattatttaaacttatgattcctaatgataaccacatatgcactttggtgtatggcttagtagttttttcctatgcatggataaatagattttttttaaagtggagataatattgtacatattatatgtaacctattttttaaacctaataattagccttttctcatgctattaatctttttctatggcataacttttaaaactctttttcatggggaatttaaacttaaaaggtagacagattacaggaaacaacagatgctggggaggacatggagaaataggaacgcttttacactgttgggagtgtaaattagttcaaccattgtggaagacggtgtggcgattcctcaaagatctagaaccagaaataccatttgacccaacaatcccattactgggtatatacccaaaggattataattcattctactgtaaaggcacatgcacatgtatgtttattatggcactgttcacaatagcaaagacttggaaccaacccaaatgcccatcaatgatagactggataaagaaaatgtggcacatatacaccatggaatgctacacagccataaaaaaggatgagttcatgtcctttgcagggacatgggtgaagctggaaaccatcattctcagcaaactaacacaagaacagaaaaccaaacactgtatgttcttactcataagtgggagttgaacaatgagaacatatgtacacagggaggggaataacacacaccggggcttgtcagtaaatggggggctaggggagggatagcattaggagaaatacctaatgtatatgatgggttgatgggtgcagcaaaccaccatggcacatgtatacctatgtaacaaacctgcacgttctgtacatgtatcccggaactcaaagtataataataataagtagacagaatattggaatgctcctatattactgataggaatgtaaaatggtacagccattttggaaaacagtttgacagtttctcaaaatgctaaatacagagttaccatgtgacccaggaatttcactcctaagtatatgcccaagagaactaaggacgtattcatgcaaaaaaaaaaaaaaaaaagtgtacatgaatatttatagtaacctcaaataggagacaacccaagtgtccatcaaccaatgaatgaataaacaaaatgtagcatagtatatccttacaatggaatatttattctacaataaaaggaagtgctgatacacactgcaacatggatgaacattatgctatgtgaaaaaagccaaacacgagaagacacatggttgtatgattccatttatataaaatgtctggaataagcaaatccatagagatagaaggtagactaatgcttgctggcagggagtgactgctaacgtcccaaattagatagtgcagatgtttgtacaactctgtgaaacatactaaaagtcacttgtacacttcaaaagagtaagtcttatggaatgtgaattaaagctcaataaaactcttattaaaaagtagataaaagggttaataatctctctactgaacaattatcccccataatgaatcctgtttcatctgtactcctacccaccttctcccccatattattttaaagtagcatattatttcatttataaatatttcagtagtttgtgtacttaaaaaatacataaccataatagtattatcatgcctaaaaaatttaacgtgtaataaaatattcagtcagtgctcaactttctaatcatgtttttagactgcttagcattttgttgtggagatggatcataatatatttaaccagttcctgttgatgaagcttgaggttatttctaactttccaactgataaatagtgcttcaataaacatccttatatataagtctttgtgtgcatctctgtttccttaggataactccttagaaattgaatttagaatgaaagtgtatgaatgatctctaaggctctagatattgccagattggcttccaatttcttgtgctgtaggtgtgtagcatttataaatgaacacataagactctgaaaaatcaattagtttaccaaagatcgtagagctactaagtggctgagcttacgactgactggcccaaagccactgccaatagtgactcacatagccatcatttgatttatggaccttgtcatgacatcagaattatctgttgtattatcaccctgaggctcacagacttcccagaagcctttggtttagggcacaagttgtctttcatgagcatagtggtgttttaagagctatttccaaggtatttcttccttgtaactttgttttgtaagatgaccaatgtcagattataacgtgtttttttttttttcttgcctaaaaccttaaaaacctaatatggtagctatttggggattaacagtgacattcttgtggagtgtatctaggggatgtttgtttgtttatttatttatttatttgtttgtttgagatggagtctagctctgttacccaggctggagtgcagtggggcgatctctgctcactgcaacctctgcctcctgggttcaggcgattctcccgcctcagcctcctgagtagctgggattacaggcgctcgccaccacgcccaactaatttttgtatttttagtagagataaggtttaactgtgttggccaggctggtctcaaacccctgacctcaggtgatccgcccgcctcagcttcccaaagtgctgggattaccggcgtgagccactgagcttggcttgtttacatttaaactgtcattctttctggaaaattatccagcaagtgtgtttggaggatgtgtggaatcaggctcaaaggtttcagttttttaagaattggagacagctgactctgtgatgatcatagaagatagcaaggtgagctacggccatgatagaatagagactattctcaagccttaatctgccagacaattgctaaaatcaaaatcttaagttgtgctttcagtttttcacataggtagatattttaagattctaatggagaaaatagaagatagaacaggaaaccaccagagtaaaaagctccgtattctggactataatctactttcaacctggtttataagtaagaaactattaaaattgacacaactttatggtagttggtcttgcagagggcaattttcttgatttactacagtttataacctaatcctccatttaaaatgcctataaattatttatgtctagggtaaaaatccagggcttcacatgaatatggtttcatcatttctacctctaggtattttttttaaagctgcctgtaatcaaatgatagcagtgtggtgggtggaacaggttgtaagcagtaattgcaaactgtatttaaacaataataataatatttagcatttatagagcactttatatcttcaaagtacttgcaaacattatctaattaaataccctctctgattataatctggatacaaatgcacttaaactcaggacagggtcatgagaaaagtatgcatttgaaagttggtgctagctatgctttaaaaacctatacaatgatgggaaagttagagttcagattctgttggactgtttttgtgcatttcagttcagcctgatggcagaattagatcatatctgcactcgatgactctgcttgataacttatcactgaaatctgagtgttgatcatcacactgatccttacagttgctacaacacgaataacataaataagctttaaaatgaggtccctctctacatttcatgccctggcttcagatgaaactgccattagtaagtgaaatgaagtggcatagtgcaaggaagaatggctacgcattgtggtttagtaatgtccatctgagagtaatagatttaactgcaccgtaggatacatcataaagaaatgcactggagaaatgaaacatctttagtttgactgtattaactacttcttgctgttttggatatgtgtctgtgtattgtcccctcgcacgtataccctgtgttgccaatttagatggtgtttggagcaaggacctgtgcggcttactcagtaggtagtagagagttctgcagttggtagattctcagtaaatgttatcctgcatgttgtgattttctaaaagctagttgacagtttaactccctaagtcagcagttctcaaagtgggatccttggaccagcagcttcaggatcctctgttaggccctgcctctctcaactttttttttttttttttggagacagggtctcactctgtcacccaggctggagtccagtggtgcgatctcagctcactgcagcttcgacctccggttctcaggtgattctctcatctcagctcctggggtagcaagtactacaggcatgtgccaccatacctgactgatttttgtattttttatagagaagggctttcctacgtgatctcggattcctaagctcaagggatctgcctgcctcagcctctcaaagtgctaggattacaggcgtgagccaccatgcctgggctcgctcaactattgaatcagaaactcttaggatggggaccagcaacttttgcgttaagaagccctcctagtaattcagaagcatgtgggagtctgagaaccactggcctaaatgtttaaaagatagtttccttggctgggcatggtggctcatgcctgtaatcccagcactttgggaggccaaggtggaagcttcacttgagcccaggagtgtgaaatcagcctgggcaacatggcgagaccatatctcaataaaataaaataaaataaaaaagaaaagcaaaatatattcatggaaatttgggtatgcctgaaaatgttgcagaataggaaatagtaaattatttatggtaagtgcaactttttcataaggcatatgacctcagagaaattgtggacagtacacattcttaggagtatggaagttaaaatttttttactaatatttgcatttgaattgtttgtaagactcaaagatacttgaaattgaaaagtctacaactttcaattgataattctgtactttgcattgttctttgcattgacatgtctttttctttttttttttttttttagcaagtttattcaaggtgcagaaaagccccactcccttgatcaacaagatgcatccttctgatgtcgatttcctgtttttccctataggcctgtagggattgagtttgaagccccaggaggtgctgacatttgcttggaaactgaaagaaagaatccatattcacaaattctttcagccctacttctgttagaagcctaaaatcttcgagttatttattttttgagacctgggaaatggaatgtatatttggaatctagacagcaggttgaagatttccttactgggaaatcccacagactttctttgtaacaacaacttgtaagcatctcttacctagccacaaaagtgtcccatgttgctatttaatccacagttcttagataagcacattgcttatattgcatgtctgtttatatggaggaaaagttgatggcaagtatggttgttaaagcaactttatatacaactgatagtgagcgtgcatgaaaattttatactcattgctggggaaaatgcttttaaaaatgtaaatttgaagacctcccctcatagaagaactattttgaaggaaaaaccgatggttagacaatcatcatcagactagatataaaaaatacctggttaaagattattaggtttttcccagtattgacacttagagggatagctccagttttctcagaagaggtgttaatatcattaaagtatcagggaattgttcaagcattttatttttattttattttttgaggcagggtcttgctctgttgcccaggctggagtgcagtggctcaatcatggctcactgtagcctcaaacttctgggtacaagtgatcctcccacttcagcctcttgagctgggactacaggtgtgtgctaccacacccagctaattttttgaaattttttttttttgtagagatggggggtctccctatgttgcccagcgtggtctcaaactcttgggctcagcctcccaaaagtgctgggattacaggtaggagccagtgtgctgggccctgttcaagcctttaaatcgggaatactaactgctctagatgggacaatgaatgacatcatttgaaaacttccgtctggaactaagtttggagcagtttcctttctagtggtggtgaaatcatagactctgtctaagaaagctacaaatttgaaatggctttttcacagcctgtttatctgattcctccaacgcttgagataatatatgttgcaattggcgtggttgaaagggccctttgagtttgggagtgctgcgatttttcaattgagctccaagactttcagagcatggatactctgggtagcagtggaaccaggtggttctgttgctggtgtcttactctggaatggttgacagagtcaaaactaagcatttgctcttcctaaaaggcctctgcttcttctgtcttctttaaattggtagctccagcaccagttagagagtactcagttttctttccatgcaaacaaataaacaaataaagcgctgtagtgctttctagagccaatacccagatgctattcagggaaagaacattgcacagacactctgttgtctgaacaatatgtatattctctctgggagtattttaaagatgtaacttgtgctggtattgtagccatcatttcttgaatataaacagcttttattttgggagaagaacagatgtaaaagtgtgaaatatagaagtttacacattttgggggagggggaaagggaagaggaacagtatttctttaaaatcatggtaaaccaatcttagtttttcctttgttttctttgagtgactgaaaattagcatgggaaatctgctggaacctgaccagctgggtacctaaacctccatttcactgattgcaccagaaaaagtgccagtggataattattataggtcctcatcactggaaacaaaaagggtccttcttcaggaggaagcctctctatgaagagaggaaatcgtagacattcagtgaaatatgtatgatacttaaaataaatcttagagagatacagagatccgagccccagatacagggtttgctttctagattgaaagagtctgttgaaggggtttgaaggctgggtgtccctctgtgatctctgaaccaaagctcttgccagttcagtcccccaaccccctttaattagtgtgtatgtttgcaaagagtacctgggggtattcaaagcagcagggacattcctgtgactattaagttctctgtccctttgaggccaggtctgtttcttttcttttctggaagcaaggtctcttgtatctcatcacttgatacaatgcaagttgcatcagatttaaaaaaataatcccctgtccttctttcctgtttcctccgtgtggctgctgccttctataagttgctgctggtttgcaggattcacaatcaggattttgtccctgtggagattttgtttagtttgcaaggaacatttttatttgagttgcatggttccttaataactcccctttgacaaatattctggttaaaatttctatgatcattatatttacttggttgtttagtatcgcatttttatactgaattatttcaaccatgttttcaaatggacagctctcaaaattttttaagtacatttaagtgaaacttggaatgtgcataagttgtgagatcatgtgaactctgcacttcacagacttgataaagtcaaacctttatccaggggatgcttcctccacaatacatgtaaatctgaatttaaaaatatacctaagaatatgcagaaactggaactctcatacattgccggtgggtctatgaaataactcagccactttgaaaaacagtttggctatttctgaaaaagttaaacttactacacgacctagcaagtccacttctgcgtatgtacccaagagaaatgaaaacataggtccacacagaaacttgtacaggagtgttcatgaggagcatcattcacagtggcccaaaaatggaaaccacccaaatgtctatcaactgatggataggtaaacaaagtgtagtgttttcatacaatagaatactattaggcaataaaaatgaaggaagtactgaatcaggctgcagcatgcatgaacctcaaaatgttatgctaagtgaaagaagccagacacaatgattgcatattgtatgattctgtatatatgaaatgtctagaaaatgcaaatctacggaggtagaaagtagattactggttggctagggtggagaggaaaacagggagtgcctgtaaatgggccggagggatctttttgggtgatgaaaatgcttcaatattggatggtggtaacctgagtgaattttatggtatgtaagtacctcaataaaggtgttaaagtataatatgcctgagacactgcttcatagttgaccagctccacacaccgtgaaggcaaatttcctagtcaggtctctgtgatatttctaggaaggccatctcttcaacacctggagagatagatgggttctctgatcctatcttctgctttctacgtattttcgtgtcattctttattctgaagcgcttgtcatattttacaaacataacgataatcatttccttcaagataaggtagctcaaataacttattcctcctgtagagaaaggactttggggccaggactgggagagctattcctgtctaaaaccattccttactaactctttctgttttcttaatgttccatgcttttctcacctctatgctgttatgcacactgttcctgctgcctgaaactcttcccaagcccctatcataatgtgccatttgttcatttgttaacaaattatttggttgtctccctccacaccctcttcctgcagaagagactataagctccacaaaggcaagctatgttttgtgtatccttgtatccatttattaatgaaatgaatgcctgctcgtgacttacagcataggctaaactccttaacttagcaagaccttctatgatctaaccattccctatttttctacagtatcagtaactaccaccccattccacctccatacactttatttcctccactgttacccctagagctcagctcttttgttcccacaaagttggggaattccttttctcaaatgatcagagctccttttagcatgtcatcttcctggaatcacagataccaggtgtttttcaaattgtaatgggttgtggagtgagtttaatgggttgcaatcagattttgaaaaaaaattagaatagagtagaaaaatgttcctatgtttactgttactgttactcaccattactatgatggcgagggaaggaaaggggcagtaatcaaggaggaatgagttgctggaaactgcagtagccaccatggccttgagaataccctctaggaaatgtggagaaaggaagagggcttaagagtctgcagaactgggtggaggctcagctccagtaatcattgtggtcattcgcccagcctagcatggtcttggctatcataaaaacagagggagagaaaaatcatggacactgtcatattatgtacaggaaaactgtgcaggcttctaccatgtgccacagtgaggttgagtaatggggagagtatggcccttccctcggagcagctgggagacaagagtagaatgttcatgaaaccagtggaaactgagcacatgctgagcttctgagggctgtgtgtgctaggtgttgagtgagggccaggtgggtgggtggcacaggccagtggcacatgctggccttggttagggcaagactttcagcgaggaatttgtggtccaggatttggtcctaagctttgcagttccaagaactatactgaaatgtggctaggatagagtctcaggtcacaccaacatgtggatgtacctgacactgatctggagtgtaatttatataataataatagtaatacacatgcatttaggctagtcgattgaagcagtgggagatgagaaagaacaaaatttaataccaatatttatagctaatatactttgtgaccactggccacgtgtcaagcactgggttaattattttaataaaagtctagtcttattaatgcagccacatcttgtgatatatactattctaattttatagatgtggaaagtgaggcttaggttaagtgatttattgaaaatgatggagccagtttttgaacctagtttggtccaattttttttctttttctttttttttttttgagacagagtcttgctctgtcacccaggctggagtgcagtggcaccatctcagctcactgcaagctccgcctcccgggttcatgccattctcctgcctcagcctcccaagtagctgggactataggcatccaccaccatgcccagctaattttttgaatttttagtagagacagggtttcaccatgttagccaggatggtttcgatctcctgaccttgtgatccgcctgcctcggcctcccaaagtgctgggattacaggcgtgagccactgtgcctggctagtccgattttaaaacatgaaatgtaagcattgtgctattgctgcttcccattttctaaataaatagtgggaatgcttttctaatggtagaactactgtctgctctctggggaactgtacttctgattttggagggacataggactctgaaactttgattagaaatgtgcttgacagggttggaatgaggctggggttgaacctggagcgtggagtccaaattctgatcccaccacaagtggtggttggacagggctggaaacccacacactcttccttttgttaacctgatcgagccacaaaacccctgttactaagacactttcttatgaaaaacatatcagggaggtttggttcatcatctaggtcccctggttaatgttaatccttacttttgtttttctgccttgctctgttcacactttttatcacctgcatctctgttttgcttcagaatgatttgtccacaagccattggtgtatttaaattataagcttcttaagggcaggaacttaagacactttctcaagtgacttgtttacatttgcattctgcagtgtgcctaacacgtaattcaccaggacgtgtcttctgggagtcatcgtgtttggatcctgcatccccactataactgagtggacaggcgacttgctatgcagttgtgaaaatacaatttcatgtgtttttagcctttaagaggagggattgtgattctgggaaaccaaaccttaacaaagtgcaggacccctgggaaatggaaagacctgtgtcctaggcagctgtgggtcttaatgcttgcattgttagaaacctcctaggtgctatgcaaggggaagaaactgagagggccctgagatggtgaaatggcctctactcattgctcttctatctcccctttagactttaaagtggttcattaagacaacagactataaacctctttataagtacaggctcaataaatgagacacaggtgaatttttattggcgacaagtcactgtgcaggtgcagcagttatattcccatgtctgctctatgcactctaaaaagcactgtctgtggggcagcttccccagtggctaacaggaaagtatgggaaaagacattttgccgcctcatggcgtggatagctagctagctgattagctggttatcaactccccggatttcctcagcacctgtcattagtggcacattgtaggccctcagatttttgtttaagtcatctggagccatctaattctgcttttaagaagcatgtgagcaagaaagattctttctaacacagggcatcaaatgaagttcaaacatggccttggcatgggtgacagattataggtggatttcagttacctgataggagttgagaatgatggaatctacatggtggcagatttactctcacctccctgactgttggcagagaagggcctgcctctggctggtccaatctaatatggaaggagaggatgagctgttcttcagaggctacagggtttgaataaatgcagccataaatcccagaagcagttgcatgtattagcttagacataggtcttggaggcacagggtaaaagcctcccctgcctatgcttgcatttgtgtgtttcttcgtttcatttttagcttctaaatattgattagctttagtgagtgctcactggctcttgtggttatcctacagctatagggggataaggcccatgacagttaaatggcattcctggaacagagcaaagtggaaggggtggtcaggtctgcaaaatgcagttcagcagcaaatgctatcccgatgtctcccacgttctctactgtgtacctcctactaagcttgggtgcttttttcctttacaaatgcagactgttgcactttacagtaatcagctgatatgactgcaatgaactatgacttcactggatagaatctttgaaatcaaatgtattaaattgactcttcctttctcagataataatgagtagacattccagctataaagaaagaattaatagattccaagcttttataggctttgggggcagtaataaaaaaagagaggaactggcacagatgccgctgtgcttgatttcattctttttgaggggtgttaaggttcttgacagcctcgccaaatgatccaagggggcaaatgcactggctctgtgtgaggctggggatggggatgaaaggtagatacactgtctgtttgatgcagatttgtgctgcaatgttcaaatcttcaacctgttctcagtcttttgaaaatcaaggcatgtaaatgaatgatgatagcctctagtgtctggttaggattccccagatgacaccttggcagagcatttagccagaacgtttttggcacctcagagagtaacgtgtataaaaggtgaccatgaaataatttgggctcatttgtgagcttctggcttatctcatttgttttcaaagtcacaggaaggaaaatgacttacgattacatcaggggttggactctctggatttgaatcttggtgctatagcttactagctttgcagcttgtgacaagttatgtaaaatccctacacttttctacacctatgaaatggaggtaacaataacagtacacataggactattgctggaattaaaaagacatattttatgttaagtatttatgacagtgcctgccatgttgcaaatacacaataaatgttcaatacattcaacatcagcatcactcttgcaaacaatttgagagcctactctgaatctggtgcagtgcaagcaactgggtatatgtaggtttacaaggtattaggttctgcctccaagaagttcaaagtgtagtggtaaaaacagatgtaaaaatagataaagagtattgtcagagcaccagggtagatggctagctgtataggagtggggaagatggagggaagtggaccagatggagggaaggtcaggagtgggagtttcatggagctgaaataacttaaagcaattctcagtgattcccaatgctatgatgagaatgccattgatgtaaaatattgatatagattaagtctgcatgtgttgtgtcttagaagtaagctttgtgttccttccatgctttcctgccctactgcccccactccagaacaagccatatcacttcatgtctgagttgttctgtctgtctttcttgcctgtcaccctctgattcatttctccctcttcaatttttctggcttaggatctggaaactttttatatgtgaagtattatttattaataagcaataatgtgtgtttcttgctttgtatgaaaaaccctaaaaattgctaattaacagtatggaactgaaaacacagaaaatgctatgtaagcccccttatttctgtcttaggaagtctattaatacaacatattagtagaccaaaggacattaattatgggatcatttcaatggatgtcaaaaaggtatggggtacaacttagcagttatttttgattaaaaaacaaagcaaaaactatttttaatagactaggattaaggacattctttcttaacttgataatatgtctaaaaccaatagtcatccctgtacctatcctttaaacaccagagactctctgtggtgcacactgttggttccctacccggcagtcatccccatcctttttctttctcacagagctctggatgtgttttggtgtttacctttccacattctcagaggaagttgacctccacttccccagcatgggggaggtagaatagattaagccagtcattgggattccattctttttgttgatgattggcttaagcaagtcatgcaacacaacctgtccaataagaaggccagaggaagcctcactgggggttcctgggaaggctttcctttcttttacaagtaaatatgtaaaaagatatcttccctatcctggacttggatattatctaaagactgtgatacttaggtttgctccagccatctgacaaccatgaggggaaagccaggagaatcacagaataaacgtatcaggtccctacattattgagcatctgaattaatcaaccctggaactggcctgactccagtcttcatattatatagataatacaatttccacattgtttaagccactctcagttgtgtgtttttttttacttgcagttgcaaacatcctaattaatgcatgttctttttaaagtgagggatgatatcaaggtgtcaggaatcagataataaccaataataatatataatgtaatggaaatgttagccattgaataaaggcaagacataaaagaaacaagaattataagaggatgagggccaggcacagtggctcatgtctgtaattccagtgttttgggaggccaaggtgggaggatggcttgaggccaggagttcaagaccagcctgggcaacatagaaagaccctgtctctaaaaacaattttaaaaaattaaccagatatagtggtatgcacctgtagtcttagcttctcaggaggctgaggtaggaagattgcttgagcccaggagtttgaggctgcagtgagctatgctggtaccactgtattccagcctgggcaacagagcaagactttgtctcaaaaaaaataaataaataaataaataaataagtaaaaaagagttacaagatgacagggacaaccttgtcatcatttacagatgatacctcaaaaacttagagaatcaactaaagatatattagaacaataacaattcagcaatgtggctggatacaaaataaatatacccaaatcaatagtatttttgtgagccaagaaaaacaatcaattacaaaatatatttgaaaaaagatacccttggccaggcatggtggctcacacctgtaatcccagcactttgggaggccaaggcaggcagatcgcctgaggtcaggagttcgagaccagtctggccaatatggcaaaaccctgcctctactaaaaatacaaaataattagctgggcacctataatcccagctactagggaggctgaggtacaagaatcacttgaacccaggaggtggtggttgtagcgagctgagctcatgcttctgcactccagcctgggtgtcagagtgagactctgtctcaaaaaaaaaaaaaaaaaaaaaaaaaaggaaaaagaaaagaaaacagatattcttaataataataagtgtaaaatatctagaaattaatgtaataagaaatctgcaggacttatatgaagaaaaaattaaaacctaacaagggacatactaaaggcctgaattaatgcaaaaatatctcatgtttctgaataggaaaatttagtaatattattcccatattaatatggaatttcaataaaaatatcaagcaggaatttgttttaggatctgaaaaaattattttaaattttatttggaaatatcagataagaatagctttttaatctgctgttataatttgtgtttttgttgcacacgtgtatgtgcatgtgtgtgtatgtctgtgtgtgtgttctgtgtctgtgatgcaatatttgccgcataaaagttttaacagttatacacagtagattttgatttttattaatataagcactctgtttcaggtaatgacttttcctaagaattacatctggtttcataaggtgttttgtttgttttactttgtgtttgctcaattatgtatgattttccttttctttctataatttgtcttgatttgtttttgctgtatcacttgaaagcagcatatatagtaagatttactttttgaacccaatgtaagaggtttcttttaaaggaggaatttaaaccatttggttttacagccataaatgatgtgtttgatctcttctcattttatttattctactttctttagtgttttctttgtttttctatatagactgttttcaaaaatccaatttgaatatatacttaaacctgtagttctctaattatgcaaattaattaaaaaaggaatcctttaatgtccccattacataaaaaagagtcaagttaaattttatttctcctacactgacctcatccttccagtgtttgttaattcaatttgatgctatagattaaaaatacattatattatctgatatcaatttaatattatatgcttcttattttttgttttaaattaaaatgtgaagatattaagtacaactcattgtttttcaaggatgcttttagccttttgcattaaattggtcattacatgaaattaggcatttcctgctctattatattgagttctttattttgagtttttattcacttagctggaatgtatacttggaatagatttttatgagaatgttatacacgtgcagtgttttatgaggcttcacattgcttaaaatgtttcttttgccttttttaaatgaacaataatttgtcagggaatacaaggattttatcataaacttttgctaccaaacttagatggttcataggctaatggtgtttaatattgtgaaagagaggcttagggctaatttgatatctattactttgtagttaacctgattttccgtctggttagtgctatgagtttgggaaaataatggaaattacttttttaggcatagatatagggtttgttttcagttattttgcttagtactcactgtagttttgctcctgggagcaggtttttgtccacatgtgaatatttatctttactatttttatttttggttctgttccttactattgaatttcttcctacttagtttggatctctgtgctgtatgttccctctctatcaccttttccttatttatttttgtatccgtcttttgaaattgcatctggttgtgatcatgtttgtctttcacagcataggtattattttccacaagtcgattgtgttctgtattgcctccagctttcctcttgcatcttaggcttccttgtattctttcttttcatttgtgtcctcatttcaatcttttcttctcttttggctattgcctcttgtcttaaggaggccatcttctcttagagttcttttggtttggaaacactattaaaaatgcatactaaaatttttatatattacgttttgcatgttttcttctgagttgtcaagatacaatacaaaataaggaaaatcaatcatttcccagtgtcacacaggcttattgttgtgtttctgtgtatgcattctcaaaaagaggtaattaactagtcttgggatttgccaaaaggcaggatgtaagttgccagcctgggtggcagccttttggtgggtgacttgagcaaactctaatgttaatcttcatgtgtttgaattctgtgtagaatgtactaaatttctctgtgactcagttttcctatctgtaaaatgggaataatgattttaccaatttcatagggttgttgtgtggattaaacaaactgatatatgaaaaaaaagacgcaaaagcagtatcctcctaagtggagaagtaagttactgtactaatgcatgcataaaacaaaaatatggtcctaaaattatttttagattttaaaacttaatgtaggctcattaaaaaaattgaatattacaagaacagtaaatagagagtaaaaagaacatgtaaaatcttcactcagaggaattatcagaggaatccctgataatattttggcatatttctctccagtatttctgtttattagaaaattatattaaaaagaatgtacttgtatggaaccctggacattttggcaataaaactctaaagacgctaaatatataaaaatacgtcaagatctatcatagcagctaccactgtattctgtttgcaatagacatgaagaaaaagtttgttgatatgggggataaatggagcatattatactattccaagacctttttatgttaatcattattttcctttttatgtaggagacaacattttcattttgggctcttcttttgtaagaaagttcttacaaaagaagattctttgcttaattaatttaacctttctgaaatataggtttctaaagagccaaaacaagcaggacggacctatgaaataagtgcgtaattcattattactgggtttcttcaaagcataatgttaaatctggttcagcttggtgtggctctactttttatcttctgcaacatgcaaattgattaaaattaaggtctactcttctcttggcaggaatttttatttagctatcttctcctgtattcaccatgaaggtgtaatctgaaaactcaactatatttccaaagttgaaatgtaaaggaaatgtaaaagaagattctcatccaattaataagattaagctatttaatattaaatgatttattactaaataaaaacatttatttttgttattcatttaatattaaattaaatgattttaaacaagctcttgattaaaacaatattaatttcatttctttttttttttttttgtctgttttttgagacaaggtgtcactctgggccagggctgaatgcagtggcacaatcttagttcactgcaacctcaaattcctgggatcaagcaatcctcccacctcagccttctaagtagctgggactgcaagtccacaccaccactccgggctaattgttttattttttgagagacagaccctccctatgttgcccaggttggtctcaaactcctggcctcaaaggatcctcccacctcagcctcccaaactgttgggattacagggatgagccactatgacagggcttattttcttggttcacgttaaaaaacaaagtattttcattgtttagcgtaaaggcattttgtttttacttttgttttttaaaattaggtgtagaggtaaaattcacttgatgtatattgcgatgaaactacttgaaacagtattgcaaaactcaagtttcttgagggatagctatatgctaaataccgtatttggtgttttgcatattatttagttgacaagatcaaacaacgtaaggcggtatttcatgtcactagtttttaaactttagcgtgcatagccttacctggggagcttgtgaaattacagggaggtgggctctatctacctctagagattctgaatcagtaggtctgggatgggtccccaaaatttgcattttaacaaaatgatgctgctgctgctgctgctttcaggatcacatttttagaatcactgtgatgagccacacaggagtggtaaggacagcaaattgcagggtgttcgggggaggaatgctgcaaaccactcttggttagaatgtatgtgaaaggcttctggggcgaggtaggattccagcaagaccttgatgggcaattaacatagagtagagaagaggggatggaggagagaacaaccagagagggaattgtgtaagcagtgatatggaggtaagaatgtaaaatgcttgtttgagggatggcaagaccatctgaaaggaagaagtgattcttgctgtattagggaataagattgaacaggctaataggggctggatttttgaagatgtttaatatctggttgaagagttgtactgtactttgcctaggcaaggaactggaggtggggtaatctaagaatttcaaaggggaaaatgtacctagtagaaaacatatttaaaaggaaaatagaaatagccaaaatcaggccctagctagtattcttttgctctctctcccttcttctctcttaacttctgaaggttatgtggagccaataaatattatttattagatgagtgacatgggcacaatagtgttttagaaaattaagctggtggcattgtagaatgaattgtagagggcagagggagactctagtagatatcctaggcttgaagaggtgaaagttcttatttggggatcatgatacccttaaaataagtagggcagttaaaataacgcagcttgctttgtggagggatggttaagatggagtgtttggttttggcttggtgaacttcgtagggcaggatgacttctaactggaatgtgtagctcgtggttgtggatctaaagctggagcttgggagacaggtggaaactaaatataggaatacagtacttgatggaatgataaattcattcatttgttcaattaacaatgtctcagtcactgaactgggtgctagagaccctataaacagtcataaagactatgagtgtaaggtcttggcagtgtagcttcagggggacaagggacagaattcagaggatgctgtgtttgagagaagagaagaaaaaggaggagacaatgaaagagaaagaggaggctatggaaggaatgatcacagccatcacatgtaaatcaggatgttagatctcccaccatggagagaatttgaggaaggaggtaataatgggcagtgccaaatgctgcagcacagaattgcagctactggcctggatgactagagtatgctggttgccctgcgggagtgctctttggaagcagagttatctgtagtggaatggggtgggggtgggggcggagcccttgagaaagtgaagaccctggattcagagcaattgttcaagaaatttagtgtcgagcattaagagagattaggacagcagaaagctaacatgctttcttttcttaaagtgaggaagacctttggtcggttgaccacagggggcaggaagcagtggtgggggagagataaagctatgaccctgcagtcttgcttatctcaatacagagctgctccatttttctggtttctgggggcctagtccttgggagtaactttgactcctctctttctctgcactgatcattagatccatcagaaaacctttttggtattttatcttcttgaaaaatatagccataatccaactacttctcacatctatgcaactatcaactttctcctgaattattgaaagtctccgaactcatctcccttctccttccttgaccttgagtctgttctcatccagtgtctaaagtgatcctaataaagcttaagttggataatgccactgcacaaaatccaccagggtccccctctcttttattattcactagagtaagtattgaattccttgcagtaacctacaaggccctgccaaacctgacctgctcccccagcccccagcaccaaacacacaccctcctcattcctcaagctcaagccctccaggagactgcagcgtcctctcacgtaggagtgctcttctccaaatacctgcttggtctttctcctcttttgggtctttgttcacatgtcatcttttaagtgagacctcccaggacactcttttataagttgtaactccatggcgcttatcacctgacttaagtattttattcctgtccctgcccactaggctgtaaacttcacaagggtgagccatctttcccttgattttgttcgttgttatagtaccagtggctaaaacgccttttagaaaggtagcactaagtgaatttttaactaatgcgagagaaagcaggcatagccattgagggagacaaggcttagagggtaataataatagcacttttgttatgcaccctgctctgtggcaggtgctttaatatgttgttgtatttaaatcttataactgccttgcacggtgggcattatactccattttacagctgaggaaactgagcattgggcacatggttaataagcgtataagctagtagattacagaggcaatctaatatgcctaagaaaaggggatcaaaggcagaggatttaatcttagaagttaggaaggatttttctcaaataggaagaaaggaagagaagaaacataagagctgagatggaaaggagaatgtgcgaggaaatcttttttctgatgaccttgatttttcttagtaaagaaggaagccagcttttctgctgagatggagaggagctgactggggatttcaggagggcaggaaaggtatgaagtagacctatctgggcagtctgatgaagatatagattaacagtgggattcctgagatgtgtttacggcccagctagaataatacatcaactaacaaaaggatgttagcaatagatggtgtctttgtgatcaattaatccagctcccaaattttatgctttatcattctgtatccctttcgtctgtgatctaccaagaccctgggcacttccacttatcttggacgatcttacatctgttttccatttgctcattggtttgtttatgatcattttttagtggtatttgtccaggtaggcagccattcaacacctgaatctcgctcttcattgacctctccaactccagcgaccttaacctctcctttcctctgtcacctttgcctaaggctggacttcaggagactgtggccttaccgggaaagtaaagacgggttgacagtggcagagtgtggtgagaaggggctaaaggacaggtgcccaggagtggagaagccctggagactctggagaggatggggctccagttcaaaaaggagggaggttgaagcaaggtagacctgaataaaactcattcctgtttaaaataattttgtatacattccaagatgattttatatatatatatttattatactttaagttctagggtacatgtgcacaacgtgcaggtttgttacatatgtatacatgtgccatgttggtgtgctgcacccattaactcgtcatttacattaggtatatctcctaatgctatccctcccccctccccccaccccacaacaggccccagtgtgtgatgttccccttcctgtgtccgagtgttctcattgttcaattcccacctatgagtgagaacatgcggtgtttggttttttgtccttgcgatagtttgctgagaatgatggtgtccagcttcatccatgtccctgcaaaggacatgaactcatcattttttatggctgcattgtattccatggtgtatatgtgccacattttcttaatccagtctatcattgttggacatttgggttggttccaagtctttgctattgtgagtagtgctgcagtaaacatatgtgtgcatgtgtctttatagcagcatgatttatattcctttgggtatatacccagtaatgggatggctgggtcaaacggtatttctcattctaggtccctgagaaatcgccacactgacgtccacaatggttgaactagtttacagtcccaccaacagtgtaaaagtgttcctatttctccacatgctctccagcgctgtccaagattattttgatgtttaaaaagaatgcatttttacatgcatggtgctgtcatttcttcctttttttttttttttttgacagagtctcactctgtcacccaggctgtagtacagtggcgtgatctcccctcactgcaatttctacttcccgggttcaagggattctcctgcctcagtctcccgaatagctggaattacaggtgtctgccaccatgcctggctaacttttctgtatttttagtaggaacagggtttcaccatgttggccaggctggttttgaacccctgacctcaagtgatccaccctcctcagcctcccaaagtgctgggattacaggcgtgagccaccatgcccagctcttccctttttttggacaaatagaatccacattgttcatagtaaaatatttttaaaatgtggaggaaaaaattattgtggggatatttgcttcacagagttaaacgtaaatactctgcaggaatgggtaataaatatagcatggtaaataaatctgtagatagtctatctaattatgtatacttttctgtatatttagccataggggtgttaaaaagttggcatttgtgttgctgtgaactaatgttactatttataacattactaatgtttagctgagaagaattgttagtttgtacaccagtctttcagtatttggcagctggcttaaattgtggcttttgatatttggacatgtatattaaaaacaagtattaatttcatttctttgctccaaaacacgcaaattaatcatgcataaattgaatgggagtgcatataaatgcaacataccagtttatgcgaactcagaattttaatgtaaagagttcggttttaaatgatttgggtgattgtagtcattccctctatttagtaacatgtgcccagttttttttttttattatgctttaagttttagggtacatgtgcacaacgtgcaggtttgttacatatatatacatgtgccatgttggtgtgctgcacccattaacttgtcatttaacattaggtgtatctcctaatgctatccctcccccctccccccaccccacaacagtccccagtgtgtgatgttccccttcctgtgtccatgtgttctcattgttcaattcccacctatgagtgataacatgcggtgtttggttttttgtccttgcgatagtttgctgagaatgatggtttccagcttcatccatgttcctacaaaggacatgaactcatcattttttatggctgcattgtattccatggtgtatatgtgcaacattttctcaatccagtctatcactgttggacatttgggttcattccaagcctttgctattgtgaatagtgccgcaataaacatccgtgtgcatgtgtctttataacagcatgttttatactcctttgggtatatacccagtaatgggatggctgggtcaaatggtatttctagttctagatccctgaggaattgccacaccgacttccaccatggttgaactagtttatagtcccaccaacagtgtaaaagtgttcctatttctccacatcctctccagcacctgttgtttcctgactttttaatgatcgcctttctaactggtgtcagatggtatctcattttggttttgatttgcatttctctgatggcaagtgatgatgagcattttttcatgtgtcttttggctgcataaatgtcttcttttgagaagtttctgttcatatccttcacccacttgttgatggggttgtttgttttttcttgtaaatttgtttgagttcattatagattctggatattagccctttgtcagatgagtagattgcaaaaattttctcccattctataggttgcctgttcactctgatggtagtttcttttgctgtgcagaagctctttagtttaattagatcccatttgtcaattttggcttttgttgccattgctttgggtgttttagacatgaagtccttgtccatgcctatgtcctgaatggtattgcctaggttttattctagggtttttatggttttcggtctaacatttaagtctttaatccatcttgaattaatttttgtataaggtgtaaggaaggggtccagtttcagctttctacatatggttagccagttttcccagcgccatttattaaatagggaatcctttccccatttcttgtttttgtcaggtttgtcaaagatcagatagtcatagatatgtggcattatttctgagggctctgttctgttccattggtctgtatctctgtttcggtaccagtaccatgctgttttggttactgtagccttatagtatagtttgaagtcaggtagtgtgatgcctccagctttgttcttttggcttagggttgacttggcaatgcgggctcttttttggttccatgtgaactttaaagtagttttttccaattctgtgaagaaagtcattggtagcttgatggggatggcattgaatctataaattaccttgggcagtatggccattttcacgatattgattcttcctacccatgagcatgaaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtccgttattggtgtataagaatgcttgtgattttgcacattgattttgtaccctgagactttgctgaagttgcttatcagcttaaggagattttggtgcccagatttatatagctatgcaataaatacctatgcacatgttgacacaatgtcacgtattgactcatttgcacattgtctaaaatacctgtaattttagccatggaaggtagttaaaaaaagggaaagttcaacctgggcttaaaatggcaattagaatcacatattttcactggagaagggatgcaacaggctgcatagttcagctttttcatttgtgcagatgaagatcccagggttctgaagatatccattgttcaaagccaccgggctaggaagtgttagagcactaatgagaactcactaatgagaactcctttgtatcaatgaagagaatgtttggttgattgaaaaatttgtttttaacacagttttattggactatgagctcttcaagggtcaaggctaacttagggtcccatggtattcatctttgtatctcagtgcatagcacagtttccagtacatagtaggtatttgctgaatgcatgatttccaaaagtaagtttattttttccattttgataatatttaaaaaatacattaacaaaacaaaaaaggcattttgagaaagtagagtttaaaaaataaaattaataaattgagttaaaactgaagctagtgaattggttttcttgaccatataaatattgtctttatgtttacagttggacttactaattcccagaaataaatggccatttgtaaacagtgtgtttggtttgaattcatatgtataaacatgtggtgtgtgtaagtatgtgtaagggagtttatattttatttatgtatgtcttttactactttattaatatatattatattttacttaacatttccagagagtgcattaaaattaatgtttcctgagacttaatctttcctgagaaaggatctatccaatggtttagtcaaactgactttacaggatgttctgtaattggtggacacattgctagttccttctgtattaatcatgttatttaattcagtgtcacaataatattatttgttgtctttatttacagacaaagcacagaaaagttaagtctcatttacacaactggtcgggcgtggtaggtcacacctgtaatctcagcaatttgggaggccaaggcgggcagatcacgaggccaggagtttgagaccagcctggccaacatggtgaaaccccgtctctactaaaaatacaaaaattatccaggcttgatgtcacgcacctgtagtcccagctactcgggaggctgaggcaggataattgcttgaacctaggaggcggaggttgcagtgagctgagattgcgccattgtagtccagcctgggtgacagagccagacttcatctcaaaaaaaaaaaaaaaaaaaaaaaaattacacaactaatcaggagcagagctaggtcttcttattcaatgtctctgctttttatccagcaaaccagcctggctccgaggttagcatcttcatatgttatcttatggttggagtacagctggaggtgagaatgaacaaatttcaggaatatatatttttaaatagctgagaactacagtgtacaaccacaggcacccacacccaaaagggctggtggtaccatgacttcagaaggaaagtatgtatccaagttggatcacagctcccttatacacaggcccatgaaggggctatggaaagaggggcgtgaattctagaggataagctggtagactctttcccaagaggactcatttcagatgggtgaatttatcacaatgggtcagttctgccagtcaggctcagggacctcactttgtattttctggggtatgtgcatgtgtgtgtgtgtctgcagggagtggaaggcagtttctacatcttgtttagaacattgtgccagtttattaaattacagtgagaactagaactatcaaaggcacttagtttatgtagaactaatatgcattttttggtctaggtgatagagagacttagtttactgtctaacctggtctttcatatcttagtgatggaagcagtacaaaagggtaggatttgtactgtagtcccccttatctgtgggttcattttccacagtttcagttactcacagtcaaccacgatctgaaaatattaaatggaaaattccataaataaacagttcataagttttaaattgtccatcgttctgagtagcatgatgaaatctcaagctgtcccactctgtctgcccaggacgtgaatcaggcccttgtctagtgtatccacacaatagatgctgccctccctttagtctacttagtagctctcttggttgtcagaccagattgactgttgcagtcttgcagtgcttgcgttcgagtaacccttattttatttaataatggccccaaagtgcaagagtagtgatgctggcagattgttataattgttctattttattattagttattgctactaatctcacattgtgcttaatttataagttaaactttaccataggtatgtagtataggaaaaaaattgtgtatatagggttcagtagtattcttggtttcaggcatccacatattctctacagataaaggaggagtcttgcactcatagctattctgtggtatagctgggaatagaactctcatgtcctcagcatttggcccagagttctttccactggttttggattggaactgggcctcagaagtgctggagaggtgggcctaccttgagtgtaaaaaaactcctttttactgcttgccttcatgtactgagcagttttattgtttattcacatggagagttggaatagtggtaacattaaagtaaacataaacttaaaaatcagtttaggactagatgcttgaatacaaactcctataggcagggaccaactctgtttcttctgcatatcccaaaaggctccagaggcccagggacagttgggcctgtcttaccaacacttaatgaaacatcggttgaaataaaaaccctcataagtcaggcatggctaagtcgatcagtcagcaaatattgactgtcagctccgggcatgaaatagtttgatcacttggacactggtatctcccttgactaaagatgctaaaaagccatcttggttttagtgacatgcctcttctcgagtcacaaacatgttcatagaacagcaagcttataggtaagtggcactgactctgttgttggatattgaaaaatgagtgcttccacttctgcagtagccactaaaaacttgtggtcaaattcagtgcctgagctttgaaatcaattcagttcaaaaaacagatgggctattcttctgatgaaatgctaataatattcaacaatgaccattagttattaagtgcttaggatacttgtcgggcactgtgcattacctcgtttcattttcacaccaactgagaacaattgccatgctctccccacgtcacagagtaaaggaactggaggttcagagactggcccaaggttacacagctaatgagtgggagcactgggatctgagcccaggacttccttcaaaagctctttgttttttcatccttaggcaatcatcttgagccttgtctatttgtttattattttttaaacagttttcttgtgatggagaatacaattcacccatttgaagtattcaattcaatggatttttgtatattcacagagctgtgcaaccatcagtacagtcaattttagaacatttttgtcacctccaaaagaaacatcattccacatttccttcaactctatccccatcccagccctaaacaatcactaatctactttctgtctttacggattttcccattatggacatttactctaagtagatttatacaatatgtggtgctttgtgactggcttctttcacataccataatgttttcaggttttgtccacgttgttacatgttataaaatgaatgtttgtatcccctgtaaattcatatgttgaagccctaaccttcagtgtgactgtatttggagacgggccctttgaagaagtgataatggttaaatagaatcaaaagcttgggccctaatctggtaggattaatatacttataagaagagacaccaaagagcttgctctctctctgccatatggggacacagtggaaaggtgaccatttgcaagccagaaagagaaccctcaccagaaactgaccctgctggacctcaatctgggatttctagctggaccacgatctgagattactgtaagacagtaaagttctgtagtttaagccacccagtctgtggtattttgttatggtaactctagcagactaatacctaccaggtattagtagtttattattttttatggctgaataatataccattgtatggatataccaatcttgtttatctattcatcaactgatggacatttggctatgatctcccatcccctcattctccctacgccaccctaaagcaaccactaatctactttctgtccctgtagatttctctgttctggaaatttcatacaagtgaaatcatataatcttgtgactgacttttttcatttagattgttttcaaggttcatccttgtagtagcatgtatgagtatttcactccttttaatgaccaaataatatttcactgtgtggagactgtaaatgttgtttatctattcatcagttgatggacatttgggttgtttctacctttgggctattatgaataatgctgctatgaacatctgtgtacaactttttatgtgtacatacattttcatttctcaggagtagaattgctgggtcatacggtttggcccacgttttagtctctaaggttttgtaagtccttatggaagttgccagggtactcaaaatacgtagaggtagcagaatacagaagaattaccaaagggtttatgccgtatttttgaaatttgataattatgtttcccctttctgctccacataggaacactcgatggaattatagaatcttagaactggaaggcaagtgagaggtgacctagtctcactgtttaattttaaagatgaggaaatcaaagttcagagactgactcacttcccaggattgtacagctgggtcatggctggacccagaccacacatgtaatctctttttctctcaggcagtattttccactggggtaacctctcagagagggagcagttcttcggaatgaggctcagttgctgaaataaagatgcttcgtatattgtttcccactggctgaagtctatctggagttcaaaactaggtcatggtaattctttgggaaatgccatgcagccttagagaaagcttgtctttcaaagccctttgattataggaaggggtgaagtcccagtgaggtggtgggcttggggattgtcacaaaagggtgctagtaagtattaaagaaacatacttattgaagttcagtgagcaatctgatttcagcaaagtagaatgtgactgtctcagagcctgatgatccaggaggcttacagatgtcaagattcacaaatagaaatggaaatttaaaaagctaggcatgagatgagaagtcaaaagttaaatgatttttaacttttttttataactataagttataatacctttcacaatacgagaatcaattcaataagttctaaagaaataagtaactataaaagttctcattgaagagggttagtgaagatgcatttagtatgaatggggagaggtgtataaatcatgatactgggatgacttcccaagttacttggtgaaacaagcctttgttagcagagatagataagagtattcaaaacagcttactaaatgctcttaatggcatctcagtttcaaataagatatgctactaatttattgagtcacttattgaatattttatacattgaaagaacatcttgatttcataatttcttcaaaacatattttgagatgcaaagagtagttttattgttaaacatttcatgaaatatataaaattattggcaactgaatgcaagttccaaaatctgaaagatgtacagtgcctcagtacattttgtagcacagagacattcagggtcatttaaaaattgaagcaaataaatagtcattatgtggtctaaattaaagtacagtaatttcgaaaattcaacaacccatttatgagctatgtactctatgtaagccattgtttgcttcttagaaatgcaaagattaaccaggtatcatttctactgccagggaatttacaatttagtggctgaagcagcatttaataagaactttattggcaagagaaagaaagagagagaataatagaagcgtaaaggacaggcctaggaaatatagttttcataatcatcttgtaaataaggatttataaagcctgtctcctccaattagtattaaagatgccctgtggaggctaagccctgctgaattcaggatatagatattactgtgatgagatgtatgtgattggagaaggacatgatatatatggaaaatgcttaatgattacttgcaggggtgaatagtgataaattggacattggctttaaatattgtagagtaaatggatgtagctgatgaagcttttgtaaactatgccatccatattcagctttctctagtttttcgattttctagcttccccctgcaatccaggatccaactgagtctttttttcttaatctagtagagcctctacatcttatttgttcttcccgatactaacatttttgaagagacctgtccagttgtctcgtagaatgccctacattccggatatgtgatgatttcctcatgattacattcagattacatatttttagcaagaacatttcatggctgatgatgagtagctctaattgtatcagattaggggcacatgatgtcaggttgttattccctcagttgccaatttactgtcatatctgcaaaaatccaggaaataacttggaccttcttctcaaaaagatagcctaggacatttatctgtcagtttttgcttactctgaggcatgcgatgaaattgccttaggcaacgagagacctcttgcctggggggtagaaggggaatgttggtcattaattttttctttctttctttttctttttcttcctttctttctttttctttcttttttttttttttttttttttttgagacagtctcgctctgtcacccaggctggagtgcagtggtgtgatctcagctaaacctctgcctcccaggttcaagtgattctcctgcctcagcttcccgagtagctgggattacaggcatgagccaccacgcctggctaatttttgtatttttagtagagacagggtttcaccatgttggccaggctgatttcaaactcctgacctcaggtgatctgcccgcctctacatcccaaagtgctgggattagaggcttgagtcatcgtgcccagctaatttttttttaatcaactgattggcattaggtccagtgatgtaactattgtaacagttgttggagtcatggctgttccaatcctaggggttctgtacacttgttctttgtcccatccatgcactaattttttttgtgcatttatcttagttgtgagatttgtttttgttcttttggcttcatgtataagaatcttttcaaattggaagaggtagagattttaaacagggaaatttataggctgcattcctttatgcaataggtacttattgggagcttcctattgtcagtcaccttttcaagtgctgatgatacagtggtgagcaatacaaagccctgccctcctagatcttacattccagtgctgaagaccagttataaatagatgaaacatttgtaaaatgtctagtagtggttaagtgctatgatgaaacagtagggaaagtggttgcagagtgcgtctggggttgttaataagattagatggtttgaggacctctctgaggaggtgatatttgtgcagaaatgtgaataaggaaagggagcaggccatgcactgagaaccacccatgaataggtactgagatggtacatactctgtatgtctgagaaagagccaggcagcgggttgggcaactggagggcagtaaggaagggggagcctggtagaaaactggtggaaaactggaccaaggaagactgtccaagtacagtagaggctgagtctggtatcaaggaatcccagcaggctgatgctgtgtactcctactctacttctaggaaaacaggctcgaaagactgaaaatggctagtttaaaaacagagtttcaactgaggtcttccacttagtctcaggtagtatagaactgcattaaataccatttgacagatttgctttgcattatatctccaaggtgatactatagatactttaaccaaaacacaaattagcagtgggttacacactttccagctgggtatctctttgtaaagatatgcgaatagttttaaatcctgtggtgccataaaatgaacactgaagtaggagttggaagatctgaatcaatgaactggcctgtgggaaagctcttgaaccttctccagcctgagcagtcccacttagcacactgagataaaccccctggttatctgattggggctgctggaagcatgcgatgaaggatgtgtatgaacgtgctttataaactatgatgcatccagcaggtctaaggtattattatcatttagacctttgttatagttttgctaaacagatgcagtctattatctagctctcatttggaaggggaatgacaaatagttacttcaaggtacaatgcttcttaaagagcagaatctgatcaatgcacctgaaagaacctcatgaattactcagctattcttcaaaccagcatatctgaactaagggaatgatcacttttcattcccatttaaagctcctggaaatcagcatgctctgtgtgagaccctatctggggaatcttgagtttcgatgctggcttaataaagtagaaacagctttgtgcttcttggagaagtggaaatttgagaaggattggtacgtctaagttaggcaattggtaaagattcatcgagtctctaacataaatgggtggatggatggatagatggataggtagatagattattaatagatagctggtgctgtgggggattaaaaacgtgtgagaaatgggtagtgataataattatagctgacattattgagcacttatatattaccaggcatgaatccccccttcaaacaatgtgagataactacaattataatcccatttgacagagaaggaactacgatttggagaagttaagtagcttcctccaggtcatacagctagaatatggcaaggctgggatttgacttcagatctgcctgactgcgaacctgtactcttaaccatgtgctctctcaagttgcatatagtatccttgaggagggaggatttttctctaaggaaagttacatagtagtaaattatgtagaaatgaaactgaaaagtctgcacaggtaggaattcagtagaaaaacaaaatggattaatgggggccaaattggtcatgggaggtctgctggaagaggaggtcctttagcagggtcttaacagactggtaggacttgaactggaggaaatgagccagtgggtgatgctgagaggatccggccagtgcaaagatgcagaggtgggaatgagcaagatgtttatgttcagggacaagcaggcagagaggccttgtcctttatagaagagttcctgatgaggcatggggtgggatatgtgtgtgtgatagcattagaatggaaattactgtgaaaggtagaggaaggtaggccaaagagactggattttatcctattagcataaaaaatcctcagatggctctgaaaccagctagttatttaatcagagccgtgtctgaaggacttaatttggaatcagatttaaggacccattagagttgcaaaagattgaatgtaagtaaaaatatgtatgcgcatatgatattatcatgtatttgtgtatctctagttaaaaataaaaggaaaatgcacattgtttccctgagttatgaatactgcatatgcaaaatctcccagaattatgcccattccgtgtttaaaaagaggagttgaggctctggagaggaaattctcgccaaggtatagtttgcctgcttggcagaaaatgaggtgtgcatgttcctgatgcttccaggtttccttcccattcttgtgtttcatttttgctagcttggctgtgttccctctggtctgcataacaaaaaaatagttaccattgattgaaaacctacattctgagagttcacagcaaccaattataagaattagatggtattatccctattttgctggcaaggaaactgaagctcagaaagtttagaaactaaagtcacatatctagcacagtaattggcagagttagacttagatatcagtcttgtttagtcagaaaagccctgctccttcttctatactttgtgtggtggttaggagtataaacttgggtgttagctcttgctttctaagtgctcttgggcaggttattaaagttatttgtgtctcattttcctcatctgtaaaatgctgatagtcgcagtactcacctggcacattataagggctcaattaatctcttttatgatttttaaaaatgattgctttctatcaccaagttgttctgttggctgtaacattctggacctcagaaaaagacttaaattttggcacaaggaaaggaggaacatctttgaaaattcatttcagtttgtgcacattaatttgaaaactctaattagctatctattttttccctggggttttcttaacccagtttccacgttgctgctgctcacctcttcctctctgtgtacctgtcaacagtgatcacacactgctgctctggggtggaccctgtctgcctaatgttggttaagcaagaaagaacttgatgtctgcctgtcattcctgccttctcttgaacagggacgaactgcctcttctccaagagaaagggttattagactggccataccttgtttttggactttgcagagcaaggacaactcaagtaggatggtttgaagtttctcaagaagcccctcagcaggcttgaagacctgctataagagcaggcacccaaggcaaaaaagccaccaagcagtcatcaggaatgggtaaagaaaggattcagacagaaccagttcctacagggcttggtcaccgtctaaaatggaaaacttctcgccccatcctttgtgtgttcttctagggcctagaacaccagagatattcattaacaagttgctggcggggatcagcttcggtgtaatttctaagtggggctttccgggagctatgtcttccttgcctgactttaatgagcagttttatatgcagatatattctttggtactagtagtattgatttctcatcctgatttaaaataacctgaagttttcctgctcatctgaatgaatattcacaacaggaattaaatctgtatgtccaggactgcataattatctattcatttccgcttggaagaccagtataaaaaggtgagccatgaagtctttcggtgaccaaaatttggaattaaacctgttgcacctccatgaaaatattaatagcttttttttttacccagatgacattataaaatacatgcaataaatttatatatttgatgattgccagtgatcaaaggcaactcttttttaattttttctaataaattccccaaacttggaagatagcagtgaaatgaaaacacactaaataattaactagcacagttgaccagcaccactttcaatctcccaacattaagattatgatttctcagccagcctggtcaacagagcaagaccttatctttacaaaaaaattaaaaaatgaaaaattagccaggcatgatggtatatgcctgtagtcccagctccttgagaggctaaggtgggaggattgcttgacctcaggcattcgaggctgcaatgagctatatcatgccactgcactccagcctgggtgacacagcgtgaggccctgtctctaaaaaaaaaaaaaaaaagattattgatgttttacaggagtggacatctacatgtgcacaaatctgatccactggggctcattctgccattagccctgtttgtgatgcagaccatgcaaggcaatctgagtgtagtggattaatggtggcttccaattcaattctcctgttgagaagtggggtctatacctccttccccttgcatctgagtgggtttgatgactgatttgacatataaaatatggcagaaatgagtctctaccaattttccaggcaaagtctttttttttttttttttttttttttgagatggagtcttgctctgtcgcccaggctggagtgcagtggcgcgatctcgactcactgcaagctccacctcccgggttcatgccattctcctgcctcagcctcccgagtagctgggactacaggctcctgccaccacgcctggccaattttttgtatttttagtagagacggggtttcaccgtgttagccaggatggtctcgatctcctgaccttgtgatccgcccgcctccgcctcccaaagtgctgggattacaggcgtgagccaatgcgcccagcccaggcaaagtcttaaagagactgcagccttcattcatatcctgagaaaccagctgccatgcaaggagctgattactctgagacctccatgctgtgaggaagctgaagatactcatccagaaaggctgtatggagagaggtgtcagccagccttctcaggaaggtgccagacatgtgagtgaaaaagccttcagatcattccagcttcagctgcaaagtaaaagctactagaaccatgaaagataataaaattactacttaaagccactaagttttagggtggtttgttttctagcatagcaaaccagaagatgcttttgagtactgagaattgtgtatttctctttttacagataggtgctgggacctctgtagtttgatgttatcaaagttcttttaggattggcagagggccaaagaaccctgtataaattgctgcttctcttctgaattctaatttttatttaactttgccttgcttgtttgtacaaaattgtggtgaatataaatttccctttctctggcataatatacatgcaaagcaagtgttgcataggccagaagaaacactgggataggtaggaaaagcctacaaattggcagaaaagacactaaaaatgattagaaattaagaatagtatggtaacccataatatactgcttgcactaaagatggagagagacagagagaaaatttagtcttgattatttaacatttggcatcctagatgaaatgacaattgaaaatgattagatgcacaggattctctgacacccatgtgatgtatgtggtgtctggggaggacgggaatgaggtttcattccaggctttgtttctgcccaaactcatcatctcaacaatacaggtaatgggggttatagaggccttgttttggtctgtttattttgaacaatttaaagttggaattcagagtttacatagttgggagttgaagaccatatacccctgtagtgtacccatggccattctaaaaatcaataaattagtcaatagaaacacatatcagctagagtaatattcatttttcaggtttggttttctgcttatctttttattagtggtcagtggtagactgaggtcacgttgttcctacagatggtgtaaatatcgtttatcaaataccttccatgtgccggacactttgctgggtgttgaagattgttaggcaagtttcaccccagagaaactcacagaacttttgttcttaacacttgtttttctttatcttactacctgttttccacatattcagctccttttggatctttgcaaggatatgcaaatatcaagttgcttgttgctaatatttgtctttagcatttccaattctggttttctcaaattttacccaagagtatgagcacagaaataaaagcattaattaaatgcacaaaatgaaaaagaaaataactataaaacatagttcatcccccctcagggacacttttatattagtgtccctgaagggggctgaactatgctttatagttagcagtatacaggtggggtagaaagaaactccctgagagatgctttttactcttattccctgatgtgcagttgcgagtgaggtgtaccgattggcactaataacaatatctcctaacatttgcatagcgatttaaagctttcgcatactttatcctttgtcagtttgcagttgaggcgcctgatatttagagacgcttagcttgccataccactggggttcagccagagggaaaataagaagaggtgaaagagggtggtttgtgttgtatgtctggtaggtatcaggccctttagcatggcacttcatttaatcatcacaacaacctactgaggtgggtagtcccataaacaagcttatctcaccattgagggaattgaggctcaggaggattaagtgacatggccgaggcagtcaatgatgccagatgctgaattggatccagatcggcctgctttctgatgtcttctgacctgcatagagaatcttggtcacctgaccctaagtaaaagtccttcatggcggaatgaatcggatagccctttcctccagccaccttcatttggcaagtctaggccctggctcctgttgcagcttcccttcatggctaaatgagccaccggtatctttcatttcctaaaagcttattaaataagatttgaaagtcagggcttccataaataaaagatccttttttgcaaaattttccagattgagcgggggaaaaaaaagccctaatgtggtattttatttgtctatgtggactttttttcttttcatttatttaataaagacatagaatctatacaaggtacagaacataaacattatgtgagagatgttatatttactttcatcaccttttttagaagaagctgccaccaaaatggttttttatggaaattatatcttgttatgagtcccattatactgtcttatgattcccattatactgtcttatgatttttttcttttatcttcagccatttatggacattattatctcagaatgtgtgcctcagatagatgtgtcattgtgggttatgaaagctgactcagaaccatgattgctgaagggattgaagacgggaagcagccacgaggcacctgaatgtctttttttctggactgttaaatgatacttctgattcttgaatgagcctgatgagatagatgggcgcctgttgaaactctgagattcttgtgtgtgtttcattcatagtggaagatgctgtcgtgtcacaaataaacttagggtggccttgcatgtagcaagaacttcaaaatacttgttagattaaatttaaacttttagatgtttctgttcctctggaaaatggagatataatttctgctgtccaactaaagtgtttgtctggtgctgatttgcagagggtaggtgttgtcttagtggcccctcctgtctgtctgccaacttagaacaggggctgggagagtatttatccctcagtctgtttaaagagctatgagcccagtgaaaacacatcattttaatagtggtaaccaactgtcctccaaccccattccaattaaaatgagaagaaatggaccaaagcaacaaggcaatttctattttacaaataaaacgtttctaaatttggagcggataactctggaaggttaatagaatcttaccatcactgaaggtcatctagatggatgtttgcattttctgtatgatgtttctaccaagattgtcatcatctcttgtgcccaccttccccttttccagcactgacctctgtcagaaggcctccccagttctcttctacttccttccgccatttctttagctcatcagctccttcgacttttccttctccactttcacccacataccagtggagaaccaccggaccccagtccccagctctcagtgtccttcaagctcctcttgaccattctctcccctgattactgctggaggggcttcttcctgtcccctctgcctctcctcactcccattcccccacttccccaggcaggcctgaggggccttctctgcccctattcttcccttctttcttcaaggtacagtctcacagagtctactgtgatctttgtcagcaaatcgctgtgttatcttagatgttcagtactgaatcagtgatttcaggaatatcacacttctgggtgcctctactggccatctgtaagatggggacacatcctctttctctgggcagttaattcttgggctctttactagaaagtctttcaaaactgtgtttgctgggtgggtgaggtggctcacgcctgtaatcccagcaacttgggaggcccaggtgggaagatcacctgaggccaggacttcacgtccagcctgggcaacagtgagatcctgtctctaccagaaaaataagagataataataactggtgtggtagtgcatgcctgtagtcctggctactcaggaggctgaggcaggaggatggcttgagcctgggagctcacggttacagtaagctataattgtgccactgtactccagtctgggtgacagtgtgaggccctgtcttaaaaaaaaataaataaataaaccccaaaccccaaatggtgtttgctctcaatatggagggtgccctgctgcatggcctccgagctctgggttcttctcaattcctgagtctgtaactctgttgatatgactaggtagctcctgcaatgtgccatggcatcagagttccatcatctagggaggcagtagagtggactagccacaggattccgagattacggaatgtgtgctggcaacagggaccaccactgaacccatggtaagtaggtgctctggttttttttttcacttctagctcttctttgatcattagatatctaattattaactcaacatgtgtttgtttttctggtgttatagatccatatatgcttacctacctatattgtaccattgatcatacattatcatagaatataggccacatggagttttacttatagctgtatctcctcccgccctttccatttttacctctgtagaggttgattcttctggggacttagacagatgatttctttgatagttcaggcttttccctaagttcttacttgccctcaacctggctacttttcagtatgcacatggtttttgaggtaagactgtgacccttttggtgtcttactaaattatttcatgactatgaatttttatattaaatagtgtttcttaccaagatatcatactcttacttctggagattaaacttggttgaaaatagaattttgggatgctctgtagaaattttagactagaaaattatcagtcttatgcattggctattggtcataagcatcataacctcctatgtggaatagaataattggagtcaacttcttatcacttttgaagttgaataaaatgaatctattttctccaggctgttgtttaactcggtgtgttgcctctgtatgatttttgttgtgatttttttttttttaccagatttggtgattgagagttgtcttgtttccacagaaatattattaatagaatagaaaattgatgatttattaaatgcccactacttaggcaattaaaatattatttagtttgatagagggacagttacttgcttgtttctatattttgaggtcatttttaccagttgatcaaaaacttacataggggttgctggttttctttacagagctaaagagacatttcattgtttatctaaacaatccacctgccagtttttctggggggtttatttcttagttaaatctactgggagttttccccgacttgagtttgactgcttgcgttcaaatccacactgttacttactagtgtgtggccttaagtaacacattgcttacccctttctctgcctacatttcctcatctgtaaaatggataatgattgtatctacctagaagaactattgggaagaccacacaagctaacctgtgtaaaaccctcagtcacctttattgattttcaaagtgtaccattttgaggaccattatagttgacctgtcagtttaaaaataagatgctgggtttcaaatttataatcatcgtgttaaagatttgaatcaagctgatgtgttataggcttggcatagagaaaatactgtctagagtaaacatcacagctgagtggagaaaccgccagactgacaaccagaagttctggtttctgctccaagttctgtcaattatgagcttggaaaaatcacttcactgctctgacctttagactccctatctgtgaaaatggggaaaatagtattttccttgctgagcttacatgactcttaagagaagtaattagcctttgtcaatgagagaatatataagaacttaaaaaaaattaaactgcatactctgcagttgtgaagcaggactttgactgaaggctggcagggattctagattcctcagattttctctagctcggttaaaaaaaaaaacaaactcaaggcacaaactatctttagtaacacccaagcatttggaagatcagattgttcatgatttcttaatgaatgtgttataaagattcattaaattaatgaactgataaaaattagtggcagtgatagggaaaaaaattgacaaatgttaatttttaatttttttacttattcctcacagtggttctcagttgggagtatgagcttctggaaatgtggaggagggaacattttttattgcctcagtgactgaggagtcacactgacatttggtggacagtggctagggatccttactcctcaaaacgcacaggggaatttgaggaagaactgcatggtcaaaattctcatagagcccccattaaaaacaacttgttaatacatctgatttctatacacttatatgggttatactgtaggtacatagccagtactattttttctagaaaacaagtggctgtacttcatgctttgataaattgaagatgcttctcccacttctcttatcttcactgattttattttcaaggctgtagccatatcctgtgacctctttgcctctaattctctatagatgtgtgcaatacagaaagccaagtgtgggtcagcagttgatgctgtcaaaagaacaagtaaagcctctggacactgttagcagaaaacaatcttagaactttatttttatttgattttgaacaggtagtactttcacatggtttagaaattaaaacaacatagaaagtgtactttaaaaaacctcactctattctagttctactgtctccattattctccatctcctgtaagttgctgtctttattagtttcttatgcttccattgtttccttgtgcaagcaaatggatctatttctattcacccccttttcttttcttttttttttttttttttttttgatacggagtctcactgtcgcccaggttggagtgcagtggcacgatcccggctcactgcaacctctgcttcccgggtttaagagattctcctgcctcagcctctggagtagctgggattacaggcgtgtgccaccacgcccaactaattttgtatatttagtagagacggggtttcaccatgttagccaggctgatctcgaacttctgatctcaggtaatctgcctgccttcgtctcccaaagtgctgggattacaggcgtgagccaccgtgcccggccattcacccccttttctaagacaaaagctcttgtttgcttggttttcagcgtactcatcactagtgtagttctacactcttccccaggtgtgggctgttctctttaacgtatttagccacagcagctattcatctgtttcatcttgttggggccatttcttctggagcctctgaccagccccaggctggactatctgtgccctaggcctgccatactgggatttcctttcaccgtcatccttttccctttttgtgctagctcccatttcctggatcctctttctttgtttactcccttattttcatggagcacatttttcagtagctttcagagaaaggaaggaaaacttttagacagtgcatatctgagcatgtctttatggtgttcctacaatttttaaaaatactttggctgggcaaaataattctgggttgaaaaatatactttactgttagatgagtgattatgcaggtcatatttaagtatgtaaacttatttcctccaaaaaatgggaacattaatttatttgagctggatatgcttcaaaatgattctgtctttgatggaacataaggactaataaataacatagaaaaaattcctaaattttggagagctaacctttgattctggtaccatgtctcttctaccagaagttaaggatgtttttttgaagctggaggaagggtatcttttagtcaggtgattaaaccttgatgtaaggatattatagacattgttcactatatcacggtcaatctatgaaggaaaaaattttcacactttattaacaataatagcagtatttcccttggttttggaaactgtgagtactgttcctgtttccctctttagtccactgccaggtggttcacagccaaattcgagacccacaactagcattgtgaaagggacctctttgcctgtgcattggacaccgaatacatttttccttaccctttacttctctttagactggttgccttactttcttttcttaattttgttttgtatgcatctttgccaacttccacaaatcctttttgaatggatggaggcagcagtaatggaataaaggttcagaatgtcttaccttaaacagcctcacatgggctttctaaagagagcattattttccattcaatttcttaagtcttttgtgctgctgtatttatagtaaaagtggtaccagttatcgttagtcattattgcaagaatgctcaacaactagctattcaaaactaagttaatggaagcctacagaaatatatgattattagcatttcttgtttgaggggtttaacaccccacatagctttcgaatttttcctctgttaattgagaagcaactgctgacttctatttgatagattcctaagaaacagacgtgatcactttgcttggttccagaaataaataacaacagtggttgtagcaatgacaataacagctaacatttattgagctctcattttgtgtcaggcactggactgtgtttaaatgcattatttaattcttccaacagccctatgaggttgatattaaattacttccttgctctttcatgccaaatccccctgaaactcccacatatagattaatctgaccatctgcttctcacttgctttctacatttctgaaccctcctgggaaaaatcactccacgatgtaccttgatgctcctagacatttgataaagtgttgcccctcctcctgcccccacatgccttgttctgagcagtgcacagagactattttaagacttcactgctccctaagccctctacttcttgaccttacctcctagttgagagaaccctgaaccctctccttcctcagtttcctgctcttacacctatgaagctatttcctaccatcatcaccctttcctcctttctaaccagtgatcgttagacagcattgtgcatcttaattacctgggagcttttagaaataactcagcctagtcctcgtcctgaagaggaccgttcagtaggtctgctggtgaggtgaggaggaggaggagcccaagcctgtgttggctgtaaaattgccacaggagattctgatgggctccctggttaagaatcactgggtcaggttccagaagacaaagtacctctttcattcaagggtgatccctcacctctcctaaatgaaaattcaggagagaaggaaatatggagctctggttcccagcttcttctttttttgttttcttcaggactagatctgctctcattattcctgtctctcctcagttttcattgacccccttttccctgtattcttcactagcttccaactagatatgtgtttgtctcaaccctgtgagcactggcctgattctcctgctattcccaggcaaaccccttaaagaaagattataacatcactcaggtatacacaccactttgttattctgacttcagtcctccctgaatctggtagagatcatcagcaccagtagaagccaaatccgaaggacgcttttgggatctgtctcatcttggtatctttgggggcatatggtgcttaggagactctttccttgtctttgtgacaccatccactcctagttgtcctgcttaatttctttcatgtgttaagtgtttccaaaaaatatttttcagcaacattaagaataatatggaactgtatttacaaaaaggaggatgtggaagaatattcttggggaggaaatgtctttctggctggggtctggatctagcactttatttatttatttatttatttattgtgagataggagggtctcactctgttgcccaggctggagtgcagtggtgcaatatggctcactgcagccttgacctcctgggcccaaatgatccttcaatcttagcctcccaagtatctgggactacaggaatgcactaccatgctcagccaattttttgtaaaattttttgtagagatgaggtctcactatgctgcctcggctggtctcaaactcctgggcttaagcaatcctctcgccttggcctcccaaagtgttgggattacaggtgtgacctaccgtgcctggcctgaatctagcattttctatgaggaaaatgagaacaccaggggaaatttggcatgatttcttgaaactcttgcaaatcaaattcagaaaactagatttaggtcttagatttttgtcctagatggcaagggaactgtgggcccagagtatggtttctaccaatttaagaaaacccatcaggtcccgggtccactctgagtctagggcagatctggggcacccagggtgtatattcctgtgagagccttactcctgctgtgtcctgtgatcctgacaatgggccagcttcccagaacattggtggacagctgtatgcagcccagagtagaacagctcggcaataataactttttactcctttctgctttgatttttattacttccccacctcctgatttttccatacaaaagtaaagcatacttgctacagaaaacttggaaaatactgaaagagaatggagaataaaataaattttttatcactataatgtcactcagatatacatgccactaaacacgtatattttcttccagtcttcttacttttgcaagcacacatatatatgtttttataagtaaaatttggatcaaactgtatatagtgttgtttattccttttttgttttttggtaataatatttattgccataaaaaattcttatcaacataatttttttatcggttgcctactattctctagcattgagatagtcataatttatttaactaggtctctgttgtttaacatttaggctgtttcctatttgtactcttataaataatgctacatttaataaccttgagcagaattgcttgtgcattgctggtgatttctttaggacatgtttttagatgctgaatattgttggatttctgggtgggaccagcactcttgtgattgtttggcctccagctaaacctgcctctgggagggagggaggctcagggtccaagggaatttgcctgctcctgtttgcatctacttgagctcttttagactgcatgttgaatttcagaaggaggcatcaaagcatttctccaggaatccataaatggcaagtcctgccacaggtgaaattgagcacatatgcttcagaataattccctatttgatagagactggttttgaattttctctattctctgcatgctttggagaaattctgaattatttcaaagaacagcaatggagcacctacaatttgtcagacattgtgcttacctctgaagttagaaaagtaagtaagctctcaaggggctcacttgcagtgtagaagacagagaagtgacctactgtgggtgagaagtcccctgggagcacagagaggagagcctctgattcttggggctaaggaggcagcagagggcaagaacacctgtgctgcagaggtgaagtctgagctgagtcttgaaaaataagaattatttctttcgtacggaggggaaaaatgttccagggaaagggaatagtgtgtgcaaaactgcagacttgcgatggttacatgacacgtcaaaggaaccatgaatacactcccataggtagaatgtaggtagaatgcccctacctcagtgacataccaggtgatggggctgcatagacagttatcctttcattcctggggcttgagcccagttgttcatttacctcagtgtgccttatgaaaaagtttaggtaacactgatttggtacatagtagaaggacaatgggagctgagctggaaagttggactgggtacaaattgtgaagggctgtgtgggccataccaagaggagtttggattcctttgtcagctgtttagagatagccaatctctctgtgaaacactactgtgcaggtactaaatagaagatatggattcccaagttgcttaaaaacacagaagctggtgttcttttacgctatcccaacaatttcgtaacatgtatttttccccctaaataaaaatgtgatgctattagctctgtatactgacctgtttcacacctctttggggaaaatattgcaatgttggaactacacagtggaaacttgcagttgtgaagtctgttttgagctggaaaaaggtgacagtctaaggaggaatgatttgaaaagtgctaatagtaaaacatcagttattttggtatctacaaaagtctgtgctatttactgtgactggtgtgaaaagaatcagtaaatgggaaaattgtgttttggccaacataaattaaaagtatgcatatcaccagcctgttgtattttctttctccagcatttcttattcattaaatatcacttcatatctaaggtctaagaattctccagcagtgtggttaagaataagataaaaatgttgagattccccaagggatattagacagcagtttcttttattatttggttttagtttgtttattttggtaagtgttgtaaatctagaccacagaaataagcataaaagaaaaaaagcgtgtatgttgtattatagaaatagtttcattgataaactctacatactaatatctaatgtatttggattgcctgaatgtgtttgggttttaggaaattataatatacaagcctctgtatatgtgtatgcattttctttaagatataaacatattacagtgatatctctatatttcaaatgtaaatttttttggtaagttgtcattttgtaagttcgattgtcaatacaaagaggtgttttattttctctctgttcttaactaatttcacttcaagatgaggggaatgtggagttcacatgggtagctgggcagtcagcatgttttcattccagtcacgataggatactgagaatttctgcttcctaggtcctcctagtctacatctctctgagcaatagtttacttgagtcaaagacattcagaaatactgtgttaaaattcagaggcgttactgtgttggccaactttttaaccccccaacatagctaatgtaaaggtgaataatgtactccttggtccgtcacctcactctgtccatcaatctgtctgtggctaacaaaaggggagtgtagcagactgtagaaaacaagacaagtgttgagtaggaaaatcagagacagatgcccttcgcactcttgtatcaaaggctttagagactggcacatcagaccaaaagtgatttgtgagggtgtgaatagattttccagatgccacatttcagaggctttcagatgaagcttctgctccttaatctctttccttctaccccttgcctgctttctcttcatgccagtgtatttctggcaattcagactcttggtgagaagtagatttaatttttataaacatacttgctggaagtcattggtctgaaaaaattgtctgtacctaatgcattgatatttctgtaggtcttcaatatgagtccatttttatattccatctttagtggtttcatcattgaagttgtcaacacagacacagtagactgaatcaacatgaaaaataccttaaaaatggtagtctgagagtcaaaagaatcaactgagaatggctaggaagtggaagagccttgtttctactaagtcttctcttcttgctactggctttctttaactgctagaaaatttcaattcttagaagataggatttgcacacctatgaataattgatgtgtaactacttatgaagagttttcactggcattgagggcctgctgttggctgaataggttggtttagcaccataagtcactgacatacttttagctttctgccacctggagatcagtataaaagctggtgagttcagcttctcaaaaggttaaacaattgccatataaccaggcaattctactcctacgtattgtgtacccaactgaaatgaaaatatgtctatacaaaaagttgtgcacaaatgttcatagcagcgttatttgtaatagcctaaagacagaaacaatacaatgtccatcaactgatgaatggaggaataaagtttggtgtctccaaacaatggcatgttgcttggccataaaaaggaatgaagtaatgatatatgctactatgtgaatgaacttacaaaacattatgctaagtgaaagaggccagtcacaaaaggtcacatattgtatgatttcattcttatggaatgtccaggacagagaactccgtagagaaagtagatgactgattgcttagggttgggggggcagtgggtgggaggatgaggggtctgaggagtggtagctacagggtatggggtttctttttgaggcgatgaaatgtcctaaaatttatggtggtgatggttgcacatatctgagaatacactaaaaaccattgacttgtaaactttgattggatgattgtatggtttatgaattatatcttaataaacctgttttttaaaaagcaaggagtgaaaaacacgagaaacataaaattcaagacattaccctgggctatgagaggagggtacatcagggaaagacagtcagatgatttccaagtggtaacgttctgtttcctaagtttcctaagcagggtggtgggtacacggatgttcactccgttcaatttattattatttgaactgcacgcatatgtcacaaatgctcatggtatctgtatttcataagttaaaaataactgtaatctaaaaaacctggttaatcgtagaaaagatatcttttcaatatacagttttcaaatatcaaatgtctttctatggatacttactgttttatcttattgtcatttgtcatcaccatgcctatttcctagtacttcttgagtgcctgtgtccatttccagtgtcctatgcaatgtaatgggacatataatgtaggctctgtatttaactggagaagagatgttattaatagttgtaataattgcgaccatttttgaggggcctgttaagtgccaagcacggttagaggagctttatatgcaatctttgatttgagtcctataatgaccctatgaggtgtgcctgataatccctgttttactgatgacaaaaggaaggcttggagagattaagtaaattgttcagaatcaaagagccagttagcgagggatagatccggaatttcaccccgtgtctgtctactgccagaatctgctgttaacgattatgccatattagcttttactgtgccagtttttcctgaacttctaaaactcatatctccctttgataaacttcataaaaatatcatgtcttttccccagttgagaatctcaatcgttttttctttctccatcagccaagatcaccttatcaagccgtatattgtttagtttataatgcagagagcatttgttttctaggtataaaattaaaccaaatatgtgctctcaaatgacgtatttccccggagttttagacatgttctctcctccccctgcaacacacacacagctcaagaatcttaggtgcgagactgttttgccaatctgagaatccatttttaaaaaggtgcttcataggcaaaggcagtatttgatcaatgccagatggatagaatagcaggtaattttcagtggagcacaaataacaaaattatagaatggaaagaaactaagaaacaatttttcttgaattcccatttgttttttagacaaaacccaagagtaacaagaattgaaatcctgtttggttgctgatgatctctaaaagctaggtgtcttatgaactgaggatgagatgtcataaggtttgttcatccatcctttcaattatgttttgatcttcaactccatgccaggcagtgtccctggggtttttcatcagaaatgtgcaaggcacaacctttccctttgtggagatcttggtcttttgggggacatagatcaagagccccaaattagagtgtggtaataatataataaagcataggaggctgtgggacctcaaaagattgacatttacttcaaccttggggatagaagtgtcagagaaagttttcaggtagtcaatacttgagcagaattctaaaagttatattgagttcagagaaattggtatattgaggaaaatttataatttggcaggagacaaggggagatgagctgccagtgttggtctgggacatgtcatgaaggacctctgactccatgcttacccataggtaaagggaattcattggctggttcaaacagggggaagggtcacaggacaagatttgccccagataaaaattactctggtaccagcctctgaggatgcatttgaaagaggaggacaagttcaagggaaaagatggctgtactcatttgagaagttttaagcatttcgtccatggcatgtgcaattgattgtaagatgctatattattttatatactaaaagaagaaaaccagaatcttaattttcagatgcatcccaattccagaaatgtcaaaatgtgaaaaaatatgtattttagacttgatgaattgcagtaagtacttaataaatatcggtcaaaagaatgcatgaatcttttctgtccgtgtcctgtgtagatttggaatagaataaatacctgataaatgaacatgacatttgatttctaagttgtatagcttcccttagtttgacaaatgaaaattacgaaagagatcagttactgtgttccttgaaggcttgtccttctgttggtattaacagtcactcttgatagcaagaattttggagaaaaaaggtttgagaaatggctgaatgaggaaactatgctatgagagggtaacgttattccctttggatttcaggcctaatagtgaaagctgtgtttgagaacctactggctgcttgtaggtccatcatatggttcaagaggaggagtttaaaaaccagtggtagggtcatggcatgattgaaaagaaatatcgagggataatttagagatctgcccttgggggcacttttaaagggaaattgctgtttgtaagctgctctctcctgcagcagctgggtatttcctgaatctagggcctttcttgtctgttttccccctatatttgctcagtgggattccagccaggaatgtctaagagacaagggcagctgggtctgcactgaccgcgagattgtattttgcttctgcggctgttttgcttcagcttgcaccatttgggggcacttctacaggcagaatgcagcaagcactgccaaacttagatagattctttgcattctccatgtgttcgtacttgtgcaacctgagaaagtgcactgagctaggagagagtgggcaaggcaggtggtggaaagtgctgtctgctcttagacatactgaaaaagtgggcccttttacagtggttcctagaaatgcctgcattgtaaagggagaaggctcattttttttttattttaaaatgtgacagaaagcttgtggaagtgctttctttcagataaatggttattactaccaaggattattactctttttgcccagaaaatagttgaaaatttcctcactgatgagacaaagtatgcattgaatacactgaatacagtatgataactgtattttctttctttcttttctttttttttttttttttgagacagaatctcgttctgtcacccaggctggagtgcaatggcacgatctcggctcactgcagcctccaccttctgggttcaagtgattctcctgctcagcctcctgagtagctgggattacaggcatcccccaccacaccctgctgattattgtatttttagttgagtcagggttttgccatgttggccaggctggtcacgaactcctgacctcaagtgatccacccactttggcctcccaaagtgctgggacttcaggccgagccactgtgcccagcctgtattttcttaataataaaatatgatcaacgctgatggtctttgggaagatgaaggaagtgctgttttcatatgctgaaagtgctacacattaattatgtcattctgcctttatctggtcttgctgactccatccctctcctcccctttctcatagccaccagtttagacattgtgaccagattaaatttctggaatcacccttttcaatatacagttttcaagtttcaaatgccattctctggatccttattgttttatcttattgtcatttgtatcactgtccctatttcccagtatttcctgagtgcctgtgtccatctccagtgtcctatgaaatgtaatggggcatataatgtaatttctttttaatgaattagctgattttgtgaggacttgaaaggagattttgagcaatttgttaaaattctagttattcttcagcaattatagagttttgggaacttctggattatgaagttcttttcttgcagacattagcaggtttttcttggtgtctaggtttttctaagcattgtcctttacatcttatggtcatcaaaaaaaattgtcctacaggtgtcttgtgacagaaaacagaaataaatatttttggaaactgaaggttggtttgcatctgttcactgatcacagttattgttatatactataggaaagggtaagactttttcatccactattttagattcagtactgggggcctacaagttaactgaaaaaagacagattaacaagagaaaagaacagatttaattacatacatatgcatggaagttcacaaagaaatataacttaaggaagtggttagaattgggggcttatatataccatcttaacaaagaacaataaattgtggcaatatgacaagagaaaagaaaggggttttggacttctaggggtacttatttatgtgaagataagtatatggggaaaactaatgaaagataagatttattacagtcaattttgtttatgcagattgaagtcagtgccatcttcagcaataagagttgcctcctcttcctggtatgggagaggaaagagagaacatcttcactgaggaaaatttatgccctgactttaggcagatacaaggggagtagacagctttatatacatctgatgtttgtcagttgcctttagctcaaaataattcttatgccatcatggcatgttttagactgacaaacattgatccccttcggtacaaacactgttcctctattacacacacacatggagatgataagacagacaaaaatagtttttgtcttttgggcttacagtctagatgaaagacaaatcatcccagcgaaggtgatttatgtgagataaatgcatctcacatattacaaatggtagatgcatcctctgggaagatgttaattagtactggaaaagtgcctcaacttattctcagatcactcaggcaagtcacagctcagcatttgtttattctgttatgaaatggaggtgaatatacacttgcccagcttgtgttgaaggaccgttgaaaggtcacctaagattctagatattagagtcctttcagatgatcagtgtttgggctccctttcctataaatcacacatgcacaaagcatagtatctagttttagcaggttcacaacatccatgggcacaggttaagaactgctggataaaatatagctccagtccaagagcagaataagccagcacagttatctcatgaaggataggtgtgaggttaatatgcaccctctctgccagtcagagaagcagcttgatggccttgaactttcagctgaaagctaatgtaccaagaggtgagatcaccaacatcacccagcatcatgttcttcctctggaggcaaatgccaagtgcagcatggcagttattcagcagcttctgtgaacctaaccaaggcatttagttccattaattgagtggctgtgtgcgagaccctgtgaaataggggcttttcataggcatttgcaatttgtaaacaactgctcagtccatgagggaatgacggtgagaacgaaaggccttaaaaagagatcgaaggtggttactgcaaccagaggtacaaaaagaggctgtaaccttgcatagttattatttattttctactttcagtcctacttgtgctgcattcaaacacggtgtggcagtaattaacactgagtgaaggtttgacagttgggtggcattttaatagctaaacgaaagtaccgagagtaattacccgggatctcttccatatggctgatcatgcacttgcacttttgggcagaaagaggcacctcactcactaggctttgctcccctttggtaaattcgtgccacaaaggctcagaggtctcctcacatgttccctgaaaatcaaatgtgttgataatggcttggcaactgaaggtgcatgagaaccttaattactttggtagtcaggaccaccttgtcacacagctccagaggaaccaatcaagatgtatttgcatcatgttgtattgtatatgaagggtgcctcttggggttgtgtgcagaggcacatcaggttgccagcctcaaaatagatgtaatgggttggcagaaacaaggggcttctccagggaaaggttgtcagggaatttgttgtaaagtttcaataatgaacggcttttatgtcttgatgctctctgcttcactatgtggctgccatattgccatttcattggaaaccctgatcaatcccctaagtacatgctggtaggagtacccctgtgggctggctgcacttcaattttaacacaaacattggcaaatggaggacattatcttcctaaaagaatctcctgtggccacatacatggcacagaacaggctactctatgttccgttaaatgattcatagatcccctaatgatgggtttaatgggcatgtaacatctgtccattaagattatgtcctcccaggtgctctaaagtttccatagcaagtgctctacaaatgttggtacctcgtggtgtctgcttcttgagactggggtcttgactttttattcatagatctttagtgtacagtacagaactggcacagagcaggcactcggaaaatatttttgggaattattaatgtgcaattgaaaaatctgtttatggttgctgacacagacttggtgaaatgagctttttgtatcaaaattttctaagtaatagtgttagccagcaccaacggacacagtttctggtacttccattgcagaagtcacattcccattgttttctgggcagtaggaaaaaagatggcatttttgaggacctaataagtaccaggtggttgtgctagatcccttgtgaacagattggagattgggcaaatcctgactttaatcacttatttgttgttttggggcctcaggtttctcttctataaaattaaaatactaatgtccaccttagagagttcatgtcaggattacagaaaatgcatgtaagtgcttagcacatagtaagtatacaagaaatgaacactgctattaatcaactcctttgtgtaacactgagaacttactgtcagttttgatactgttaaaaaactagagataccaataacattcaaaaactgtatgtacttcaagtagcttgcagtctagaggtggagttaggcacttaaacacatagttacaatacatggcaagtgctatagtcaaatactgttagaacacaaaggagaagcaactaagctctgctggggaggaggaaatgggatttaggaagggctttgtgtacacgatgcttactctgatttgaagatggaaatcagtttttaaggaagttgtttgtgaacagactaactgaaagcagttgaagtagaacacaaaggtagtgtgtgtgtgtaaggatgcctatgtgagtgctgaagcagtagggaagaagtcaccctttgtgggagacacagttcatccccaagacactaggaaactcaacaaagtaacatagattgctcagtcacatagctaatgcgtggcaggacctgaattttaaactgaaatgatttctacaatgaccagtgctctttgcatctttttatacctaattttaaaaatatgtaagttactacattttaaagtgttctttgtattacttcttagagacccctaaccttttcagaagagtatctctattcaataatgtgtgtcaatgggaagttgttatgttttataaaaataagattctaagccaggcctttctgtggtggttgttggacatctctgcccagaggaaattgattaggagggataagatggcactagaactggaagctgagggcagtcatgccagctctggcccaggccagtctttgtattgagtactttaggatatatggaaatcaccaaaatacatacaggctgtttaattattttgtatcactcctggagatggtcaagtaaaataaacacattaaatagtcaattagttcactggcagcaatctttctttggaaagatctgctcccccccgtcccctccccccacactccttgctcacctatatttttctgatagtacagtcattatttcagttctgttggagtccaagttctgaaccactaggccattttaactgcaaatttctcctgagaacatacaatcactctatccccacctgtaagataccgcaaaggggagaactaatgtttcctggccagtgctaattagaaacttcatatgcctcactcctagtggtttgaaattcataatcctacaggtggctttgatttaagccaaatagttctgttcaagagagaaagattactgtaatgacgcagatttttcacttcaattgttgtcattattcttaattcattatttgacttaataatcagctgcacaaaatccatctcttcctaaaaatatccccagacacatactccttaagtttcttatctcataaaagcatttgagtatagtgactgagaagggcacatgagagggattttgaaagaactatccctagaaagatttgaaacaaaatgtggaagatgtaagagccgatgtcaggttttggagatgtggctgtaggcttgctttagttacacacactggcaaacactggtatctcaatgtaggagacactctatctactagcattatgtagttagcattgcactatagtatggttaatgactgagtggaattcagtaattaagagtgagaatttctgcactaataaaagacacttacctctactgcctctcaagtaggccttcatttctgaactttgaaccactcctagaacagggaactgatagtttaattgttgggttgcttatgtctgtttcctcattcttctaaattgaagctgccctcttaatgattaaattattttttcaaacttttaaattgtaaaatatgtactgaaaagtgcacaaagcaaacatgctcagcttatttaattagcaccagtgtgaccatctctctatttaaggaatagaattgctctattatttgcctcacagaaaaacctccctaatccagagacctgggaggagcagggacattttatattgctgaaaggtaagacaataataatttttgaagaatcttattcccttttaggtttagacaataactgagaaaccctggagtggcaaagtttttcaacagaggtcctggaacaccacctttagcagagaacactggctttgatagagatgtctaattgtaattagcaagtgactggatgtgaatgatacttgactgaagatttttaaaaatgagatttccttttttatgttattacttttcttgaaatctattctatatggacaatagacaattaaacttctgttcagctctaatttcagtaattgcaaattctgaatgagtagaggtgaaataagaagcatttattgtgtttgaaaattagggctataaatggtataggtgagcaatacacttctgaatgtctttatcaaaacatccctgtgggtaaagaagaggaaactggaaaccctagagattctggtggactgactgagaaacctccactgcaaaccagaaatttgttagcatctttgtgttttatttttaaacttgatacaaacttattcatgtttaatttaacatattaaaaaacaccacgaacaccaaagtttttatggaaaataggctttccaaaaagatatgccgtggttgaatgcagcttcacagattctctgggacccagctggtactctcagaggaaggtatatttaatgatgtgaagatacatgtattcatctctctccgagttatttatttatttcacaagaaaaagtaaacaacaacttataaatattttcttgttgttgatcttggtaaaattatttacttaaccagcatttatgaaggtccccctgtagcctaggtacagtgcatgtagctaaagatattaacatgaatggagcccagcttcagctttggaaggagcaggagcatagctgagtggggaatacggatgtaaacaagttattacatcagagtcatttatgtatttgttcatttgcctgggagaagtgaggcctcaaacagcattttgttcaaaaaaatgactggcttatattctttatcgcatgcatgtctgccattttgtcatagccatgtgtgttcaatacttgaaatccatttgccttatgaaatgcttacggaatcctgatttctagaaataatttaaagtttgctgaatgcatatgctgtcctataagtgataggattgttttatcatttctgacagaaatgatacatgcaattaacatgtgttcttttaaaataatactattaacaaagcaagtttatcccctctactgatatctctgtctgtgtacccaaatcctgcaggtattttaaagtctagcttggtgcccaccttttccattcagctccgcttgactgtgtcagtttgtatcgatttcctgcctgtctgaactctctttgcatttatgttatgttctgcttgtctgacttgttagagcagagatcccaaactccatcctttctcctttcttgagcagggttcttgagaaatggatgatggaggttcctccagcaaatgtttcctctgtgttcctcgtcagagtggctgccacacacctccgtctagtctcaggcctctgccctgacagtcgtgagactcccttctgatttctctcttaacccctaggctgagagggccccaggtttgctgtgaattccttttcttctagggcccagctggtgtcccctcccactcctatcccagtattttcaaagcagtagatacctcagtcatcagcccactgagaaggcagagctacttgtcccctttggctcactcttcattctttccactaaaactccatcctcaaaccagtggccttaatgtaccgttttgacctccgtgtgcccttcatgtttggccacctttgagtgtgagctcagtttgtgatgggtatgttgtattttagtgttacttgataaacaccgacttaatcatttctttgtatttggcaaaattccttcattctctttagctcattttaactttagaataactttagttcaactctgagaggcaagcaggctgcctttattcttatttctacttgataggaaaagacaccaaaggctaaaaaatattagtggccttgttcaatgtcagaaaaattataaacgatgaagtcattttcagtcatgtgctcttctaaaacacagttcttttgcttctcttcatttatatttcatgtattttaatctatttttactaatctgacatgtcacttgagggccagctcatgccataaatatctgaatcctttaaaacaccaaacagttcaacttaaccaaacatttattggatataaagtgtagtcatttcctcatttagtgagagtctttatgtattagactccccgttggatgttttctatgtttcccctcattctcatcatatctctgctgggtagattttatcaatactttggtaccattaatatgcattgggataacttgggaatcttattaaaatgttaatcctgatgcagtaggtctgggcagggcccagatttctgcatttgtaacaaggttcccagatgagttggatggtcatgggtgcagtctgagtagcatgctgtttataggtgaagagactttggctctaagagattaagtgatttttcaaagataacacaactggaagtggtaaagccttattcaaatgctgatcttgctccctggagagttgccttccaagtgcagtaagacagatacattcaaagcgatctttggaatgtactttaatgtggaatttactctaatggagtgtaatgggaggaccttaggtaggaactatgatttgaatctgatctcaaaagactggtaaggctttgactgacaaagatgggacaaaaggactttttggatagcaagaacaaaaagggaacaaggacacagaatgcgggagtgtacagaacatcttctgggaatggtgagctggaggctgtagctgatgcctggggagaggtgtgctgtagctttaaagggaggctgaggttggatgggagagcagagtagaccggggaaccactgggagatttggaggacagtgtctgtgatagcacattgtaggtgctcaggaaatgtgcactggttgattgaatgtaatctagtttttagtcatctgttgcccatgttgcaccattgagatctccacagaattctgtggcctggctgaaacgccacagaattaccccaagatgacctttactgttgtttatatagagctttcttaatagtctctttgcctttggcaatataggacatattactttttcctccctttccaaatttttttttggctaagaaaatgctgcttttgcacagaccaataatacacattcttcttaaaagaagcattgttccttcagtagcaacttgtaatgggaaaagtggaacaaagacaaaatgcaattctggtctgaatggagaccagtttttctttgtgtgaataaccagcattccagtcaggttgccacagtgatgctgagattataactgttcatgccagcagtcagagaacgttgcccaattagttattctcagctgctaggttaccttgacagtggctcaaaaagcaggttttgagttcaaagacactcaaaaaagagcagtcgaggacttgcaattctgttgccctcagtggggtgcagagaccacaagctccagcatgctctggtttaggccatgtaggtgtagtcagccttgtgaacgtaggcaccttgtaaaaattctggtctttccttgccccctgtatcatcagccagctttggaagggattttactgtttctgggagctgccttcagatattgcacatgggagacagtgaggagaatgtatgttttggcattggaggctcttgtagcctcgctttttttctcttgtgagcaatctacttcacaggattgatgcagagatgaaataaaataacctttgcaaaataccctgcataatgtctggggcatggggagacattcagtgtgaagcagttcttctcaaatattgtttcaaaagttacaaagcattatacaatatgattattattatcatcagtttctggtcttttctattctttcagtcagagtagagtaggataggatatggtaatgaacactcttagaggctttatataactaaagtttatttctcgaccatgccacatgcctagagtgggtcagtagaggactccattcatcagctatccaagtaccagactaatggaggcatcatgtccacatatgcttccacagtcatcacaatgatttgaactgtcagtcacatattccatctggaagtggaacatcacttccatgcacactttattagccaaagtaaatcatgtggccccagccagcttcaagaggggtagggaagtgccatcctataacatgccagcaggaggagaaatagaacatttattcaggccgggcacggtggctcatgcctataatcccagcactttgggaggctgaggcgaggggattacctgaggtcaggagtttgagaccagcctggccaacatggtgaaaccctgtctctcctaaaaatacaaaaattagctgagcatggtggcatacgcctgtaatcttaactacttcagaggctgaggcagaagaattgcttgagcccgggagacggaggttgcagtgagctgagatcatgccactgccctccagcctggctgacagagcgagactgtctcaaaaaaaaaaaaaaaaaaaaaagatgtattcaacaaccttagagactgccacctctaccaaagagcaaaaggctaatggagaagagtcctttaaagaaggaatgttagttaaacataaatgaataaaaatatctgaacagtaaacttcaaagtaaatcaattagatttcagctgcttcaaacagaaaactcaaaatattagtgggttaaggaagatagaagtttgtttctctttcaagataaagaagttcagacataggcagcttagcggtagcatggtagctccatgatcgtcagaaccataggatcattttattgttccgctataacaatcttagcataaggcttccattcttaaattcacctcaggatcagaaatggctgtagtgttctagccattacatctgcattccaggcagcaggaaggaggagggaggaagacagaagaacccttctcccagctaagtcagctccatttgggcagcccttctgaatgccccacacagtaattctgcttacataccattggccagaatttagtcatgtattcattcctagcttcagtgggacaagggcatgtagattttgagctgggtgcatttcctcccaaataaaattggaatttttgttaaggagcaaggggagaatgaatattgggtggcattgatccatctctgttacagtaacttaagatgcaagctttagttaagtaggaatgacacagaaaagattgctctatacactgtcattttccattctatgctctgcagaatatcagtgcttagaggagatacaaagcttccttaaggagtgttctgtggccagacaagttaggaaaatatgaaaagctttgccctgtcttggagattcacagggtacattaacacattaaaagctttgagaggccttgcagtaaagaaacccctaacctgctaatctttttaacctagtgttcccaaacttatttgacagtggaaattcaacacccatggaaatctggagggacaaaaggactggctttagcttcttgagtctgccaaaaagcttttagatccttgaacagatggtataaatcccccgttccaaaatgttatctgccttgcaaaactaataagcaagcaaataaatttgtatgtccttcacggtggcctagccatagatataaaagcttgaaaaaaaaatagatgcaaatgaagccctgttattaacatctgtatgagatttataagagttggtattggtcagccatctgtaccattactggtgacaccaagtgatggactaagattggtttgtacctctgccagatgacaggtccctgctccaggtagctattattgggctcctggctgttcctacatggctctgggccatctcacccttctctggaaatgggagagtaacagatgatctaatcaaccagccaatatttccctactcatagaaaagtcctgggcccttggccgaaaggcattaaccctgcccctttcagtgtgcacaactcttgccctcatcagaggttccctctgcaaagggcaaagaaggaagctcactgtattgtgaagaggggtggggacaggtaggcagctggtaaagggggcctcatactcctattagacttagaatagagttaggtcccttttacctaaaagtttcacctctgcctgtaatcaacttcatggttgcttataggtgtaggaagaacagttgaaaattctttcaagcaaataacgtgtcattggtctgttgtaagcaggtggtaaatgagtatctctgggggaatggtcccgttaaggctcttcttccaaaacagaaccttgaattgtttcctaatctttctttcttaattatttaggtaaccagctcttgtctttaaatccatctcctgcagttgctatctttttcttcatctaagtatcttcaaaaaggcaaaaggccaaaatatttgctagtctggttcccatcatttccacctcgttttgctggaaatactggaaagttaccctgtcctgacaggtctggaaggatcccatgtttgcaaatctttgtaaactgtatgatacattttcccaaacagctgtataatctctgcaacaacctgatgatgggagggaagggaccaggttgagcaggggctggggttgggggtggtcatgtgcatattgacctttaaagcaacttgcgtgtgtgtgtgtgtgtgtgtgtgtgtgtgcgcgtgtgtgtgtgtgtgttttgaccaagtttcgcttttgtcgctcaggctggagtgcagtggcgtgatctcagctcactgcaacctccacctccctggttcaagcgatgctcctgcctcagcctcctgagtagctgggattataggcgtgtaccaccacgcccagctaatttttgtatttttagtagaaatggggtttcaccatgttggtcaggctggtctcgaactcctgacctcgtgatctgcccgcctcagcctcccaaagtgctgggattacaggcgtgagccactgtgtccggcctgcatgtatgcttcttaaaagacttttttagaagagctgagaaaaattacaggaggtgatggagagagctatccttctccaatatctgtcttgtggcttagtaccctgaagagttttcttaacttgccttatggagttggtgtgcctttctctgactctgaatgtgttagaaaacagtctctgaacacacagttggggcttgtgcattccttgtgtgcacaagcaggtttgtagtcgtgacttgggaatttcaggtcaagaagcatgagaagggctggccagtgaatcccagcagctgacaaaggattaaaatagctgtgctatgcaccaaaatcagaaaaaatattcaagtcagtgttacaagaagtccttggattgttctctttttagttttatattcttagttgtatatacttatttatgcaatgtaagctagtagacaataatcaatttatgtagaattatttgttttcatctgtaaggaaataattttgaactgagctaactgtgagtatgaatatgctaagtctgtgaaccgagaaaaatatattttgaaaatattatttatcttttatgctgatatatatgcatgtgacctactaaatggactgtcaaactggccatgtgcactaaatcttcttacatcatttctggaaatgaatgaaatcgatttcttaacccaactacctagattttgcaaaagaacagcagggcctgcccatcctacctactgtccctgtttccttcctttccaggtccactttttgaaaggcaatgggtgattccatcggtttactaaagggtgaaatcaaacagaaggaaaaactagaagtcaaaagacataggtcttcatttaactctgccactaactaggataagacctcagataaatcacctaaactatcttgctggagaaatctataactgcataagtatatagagcctgtctgggcctctctttgctcttctgtaaaatgggtagagatattttattgatatgatctcagaaatcctcgctgcaaatgtcacagaccttaccgcattgtggctgtcggtggaagaagtggtgatgtgaggacttgctccatccagataatatttattgaatatctctgatgtcccagtcatgatcgaggtattggagatactgcagtggacaaaaccaataagagttattcattcttggagtaaagaaattattctttcttgagtaaagaatttttagcgaacactttttaagcacttacaatatgctagatgttgctttacacattttatatatattaattattatatcaagtaatccagcaaagtgggtactaccattatcagtattttatagttgaagaaacaggcatagaaagattaaataacatgcccaaagtcatatggctagaaaatggtgaagctgggattcgattcaggcttttggctgtagagtctgtggttttcactattatgctataccgcctctcactgtcaattaattggttagcttaaagtaattagcattcatcctagctaatggcaaagtaggaaaaaaagaaactagctttagatagaaatctgagagcctgtttgctctccctctctggggcttctggctctgataagaggcagggacaccaagcaaccatggtatagaaaacttctatgctcccagccatttggctcattgtggtttcctgtcctgaggtcactgcccattctctggctctattgttaacccacaaggccttcagcatccccgtaaccccaggttaatttcagcattggccatttgtagagaaatgagtaataatggacttggattcaaaatacctggatttgaatcctggctctactatgaaccaatgttgtcatcaccttgggaaacttctcttaataccaccagcaagagcagtatgtctgtagccattatttattaagcactgccatgcattgtgctaaatgctttatatatgttgttttggattctcagaaccatcttccatgacaggtatttttacctttactttacagtctggtcttggctgctgtctctaccacttactgtttaatcttgggcaagttacttaattccttgacgccttagttttatcatctgaaaattggggttagtaatacctatttctcaggttgcataaggaagaaatatgaaaatgtatgaaaagcatttaggctatggcctatcccaatgacaacgataatgcctattatagcttattgtatagcttaaggttttgcagtgattaatccgaggagtgatgtttcaaatccagttctaaaggccgactttgtgaggacaggctggagctgcagggtcttgagtgaagcagctgagcggggagggtgatctaaagcagtgtcactgctggctgctgcacattagcaggtgaaactaagcagactgcaaaccaaacaggaggtgaggaggctccagtctccctgttctgagagatgaaagccaaactggaagctaccagtatcgagggttagttcctggaggtttggctgtgttctgccagtagccagctgatcattgaggagctggtattagtaagaggataccaacactagccaggaacagctctatcggagcagtttgtgtcctggaatcagcctacactcaggacagcccttcccaaaagacgatgcttgacacagggagctggggagttacctagaacattcatacgcaggatgcgacattgtaaaaatgcaggccaaagggcactttcccaaattacagatgaagaaaactggaatatgaggggtgaaagaactctagtaaggagtggaatccagacttgaaccctaattgttttggaccagtcctgtgataggtttgcatagtttaatttgtcctacactgatgatcaagtaagaaaaatcaacaatcagtattttacctacctatagccatatctctctcatctatctatctatctatctatctatctatctatctatctatctatcatctatctatctatctgtatatatttatgttttttacttgaattatctattccagttgagatgacttctttgggccagcaggttaatgaagatatgcttctgggctatattccagatctcctggatcaatactcttggagcaccttttctcatatgctgcttgtcgttatgatgatctaatcactatgtacgtgtagtaagttgctcatgtctgcttccttccttagattggaagcaccatgaagcaggggccatgtaccccactgcctctaccttggacagtgtataacacacagtaggtggcgagggagggtgccaggtagcagtcagggattaaataaatcttactgtgtaaagcaagacctttgactctgcaaacctctactgctttagaagaggggaagttaaagtaaaaaattacctttgagggaacttgcctggctgtgagtgcagcataaactagaatctgggggttgttgagtcagcacagtttcctaatgctgtactttcgaagatgatgttgaaaagcctgaagcctcaagataaatgtggagagttctcctactgttcctgttttctttgttctgttttgcttttgtaagcatatgcttgtcagttagggctgaaaccaaacaaaacagctgctaaatatggttctaaaagaaataacattttggtcttcttaaggcccgtaagtttagagtaagcacagtcgtttggcagatgtcaatagggaatccgggggtagcagtcattctgggagcactatcagccatccgtattctgttgggtgtattttaccctgccagaggactggtggcctcaagtaaaagattctgtcacagaacggctgtgtctttaagaggcgttttggaggaggggtgtctagagtctgtgtaggccatttgctcatgatccgtgtcaatttcattttcaaagaagtggggaggcattggaaagaatatgtatcatcttttatgatgtgaaggaaatagtcatcctagttacagacttaagtttgcctttttcaatctttgggatttagcccagtggtgttatttagtgttcttataaatccagtatcattcagaggacctggaggaattaaagcataacctagtggcagggaatatcaaaccctagatcttaaatctctcctctctgctgtgaagctgggcttgagcctgccaatgccatctaaatttcatcagctgaaagaaagagtatttatttcaacatccaaggaacccccaaaacttaatgcgccttctcaattgtctaactaatttttaaagagacatacattttgtccataaatacctgactctgtttgctaagcatgtggtgggtaatattattggttgaaaagcaataggttttcgtttactggccagattagttttattggcttttttagttgaaaatctataaaatgcggactgaattttactgtggcatattctttgtttattacatgaactcattttcaaagatgaaaaagaaaagggaggaagaaaatgaatatttattaaagtcctattacatatcaggccccaagctagtctagacactcacagttctcattgtatctcccaagggaggtaatcctgtccacattttaaagatgaggaaactgaggttcaatgcagttctgaaactggctcaaggttagagagctaccaggtggtaaaccaagggctggggattatggttccatgaagctatgatatagtgattaggaactcaaggtttggagtctgaccatctgagtcaacatcctggctctgccgctcattagtagtgtgaccctgactaagcatttaatccctccgtgcctccatttcctaatctgtaaaacaaagataatgatagcatccacttgataaagctgtgataaatgagctattcatgaaaaatgcttagaatcgtttctgacacataagtcctcatgaaatgttcactattactgtaatttttattgtcatgactaaccaagtttgcttttatcagtactggctgaaaaattacattttctttcaaggaatagtctaccttttgatatgtagttatatttcattatgaaataatgtaaactactctaccttagaattaaattctcttctcaccctcccagcaaaggttaagatctgaataaaggcatgtgtggccaacagggattcttgactttggtaaatgtcaatgatttgctcttttctccttggtgtatgtaactttcttccatgctgctcatcctggctttaagagcagctaagcaaacacaagagggagaattaagtggatttcttatctcttagctttcctgtctttgtaacatgattattaggtacagcttcctctccttgctgcacattctgttggccacattctgacagcctgtcttctcaatgcacgtgaggcacagtttactacaacaggctctatggattttatttttttaagctgggaatactacaggggcttttacatgtgacagttttgtccatttgggattggggtaaggaggatagagggcacagtggtaaaacaacttgtctagatttaaaagaaatgatgtaagtttgctagacctttggctctacattctgatcccattttttgtgatttgcactatacatgtcttgaagaattgggagtgggacatcaaccttattcagtaaatagttatatctagcagttatgtattggacagcatgctaagtgctggaaataccaagataaatatgttacagtgcttgctcttgaggcatttgtaattcatcaagggagagaaatgtaagagaggctagcactatgtgaaaatggttatcatagagctgtgcacaacatattgcggctgcagagagagagaggcagtgacgctgatttaagaagggcttcagaaaggaggcagcaagctgggctttcaaggatgggcttgcctcataaagaaagcagaaggaataatcttggcagatgggcagtatgaaccaagagctgagtgtggtatgttagggacatgagggacatgtgttggttatagtacagaatgatggaacacaaggctgggaatcgaggccaggcctaagaatgacatgaccttgactttcagtttgaaccgtatcttgtattattttaaatcatggagtgtcatgattagaaatgtctgttttagaaagatcagtatggagaatagcttagaaggaagaaagaattaactaaaagcaaatggtcccagaaaaagatgatgaagcctgttgtgtgaatggagtggagtagatggatatggtggacatttggagataagatcattgacacttagtgaacaaaattaggggagtggtggacaagggtggaaacttaggggaaggtacctagaaggtgtgagcagaagaaatattatagaatctgtgagagagactaagaggtatgatagaagatggtggagggatatattttcaacaggagtagtgatgctcaggagtataaatgcctcaaaagggacaactaggacaggactgagaagcaaccactatgtgtaagaaattgaggttcatggtgaccttttggggaaattactttagaggtactctagaatggagaaaacagctaaatgcttatactgttcaagctgtatcacaattctacaaggatgtaactaatgatgaaatgcatttgtgtgaaagactattcacaaacattcagctctccaggcgcttggattgggggaaagagagaagagagcctagggtcagtactgaggtgtcactgaataatacctctgacttccatatctagggtttcaaagagccccctccttgcaaataccatgactcatgctattttgctttgttactctcaggatactgtagactgtagatgcttatagacttctcttttgattccagactggttcttatttctagccatggtgcttgtagtgtatgttgtggtatgtcacacagagctcagttctccactgctgaggcactcagttgtccaccttctgggagtgtaggtagctagggatgacgttcatctgaaaaatgtcctcagctgaacagtgtcagttcacctaagattgttacctctgggacgggtattggggggcatcccacatgcagtgactagtcaatggagatgggatgcaaagtcctgatgcttccaggtaggataattctccagggctgtcctagctccagcacttccatggatcagatgaagtttttgttaccactacatttcagttcagctcttcctttggctcagtccagttcttcctttactccccggcaggtgttgattctgaggcataccccaataaactcacacagtataaatctcagggagtctcaggttttattcctggggaacccatctgatatgatgattctttccagtttggttgcctatgcaaggccagttgccagtagaactctttagttcctctgaactttacttctgaggcccttggatgtgtccagcaaaaaccttctcctagcagtttgaactaaaggctcagcattaagcctccttggttttgattggttgggacatatacccaagaatagattattcaaggagagaaaagagcctcacaagtcagctgtccagatcttcctgagacctacctactaaccccagctctgagaggggaccctgaggcgagtgacctttggatgtagaagctgattcctgctctgcacctgtttgtgctcctgccctcatctcacatccctgtttgattcccaggttccttgaggcagccactcatcactgtcctgtatctcttctctttctgttattttttttttagttaagaaaaatgaatgttgaaaacacaattgagctatttcaagcaaatgtaggacttctctccaaatatgttgcagaaacaccaccaagcaaacaaactactgggaagcacagcttagaaacaaacagcagctgccaccatttatgggctttttttttcttttcctcatttctttctaattccatttgtaataaaacctgctgctctaatggcctagtagtttaaccaacaaaatttttcttcccgatcctgaggcctcccaggtggccttgatggtgtcttctaactatggggtgttggtcgactcagagctctaagtcccttaagagtgttttccggttttgtggttctgtctggaaccacacctcccagaccaggtggggcataactggaacttctggacttctggatttttcaggacatgagcatggagtgtggtttcttgcccttctggctttgtaagagcaggtaatgtagtgctaactccaatctttctcagtgactaagtgcttaatctgttgggtgctttgtttgctttttgtttttgtttttatttgttctctgtgtggaatctttgaaggcacctacgcaggggcttttcttgagtttgatttaccacagattggactttaaagcatcctgacttgtcagatcaaactcatttttccctttccccagaatagcagataaactcattttccccttcccccatttaaatcctgctggtggtgtggaatttctcagcttaaaagtgattactattaggtgttaatagatttccgactacttgaaaggcattgtgcaaagcccacacttattcttcacaagagcatggctaggtagatgtcatccctgcagacccagacaatatgttgctttctcggggtctcctaggatcacacagctggtcaaggcacagctggtatttaacccaggtctctctgaatctgaagttcaggctgttccctccctgcctcttagccacccattgtaataatatatggcattgctcttatgtaagtgtccagtagagacaggccaaaggcgcagtctatttttatttgttcctaagaatgttttttaaattaagtgcctaaaacttaaaaaataggagatctcacattaaatacaatgttcagtttctcttgaaaaatctttagacctggcaatattgtgctcatatgttgacaagacaacaagtggctccagctaagtaaactccaccccaccccaccctaccataccataccctacctccctcaaggaggctcgggttgcccagtttgccacaggccccaactggaccactttacttgtttatgttactggcctggcctctgtagacatttaagtttgtgactcctagatttatgcctttaaagaagcaatttctgtccagttaggaatcagtaaggggtgaaagtcaatttctgcctctgaatagaattttattggctttgatttttcttttcaactttttgggatagtaattcagttataatagcagtaattttggatatttattgaacgctgtaacatttagctgactcctggggttagtggacaactgattggtggtaagaacttgaataattctccaatttagtttgcattctaaatcctgcagttactcagcaggtactgcaggaactggaggctatcctcaaaagtatattttgtagaggcagtattacagaagagatgaatccaaagaaaaactttctgagagaggtagttaagttgactctattttcccttggaaactgttgactaccataggtaagattgccccacaatgcacgaacacccttcttagctaccagggctcactcaacacaatgaacagctcggatatttcaaagagaaataccctggaacattagaaccttctcaggatgatgagtctttcactttatcttgctgtagctcctgcaagtgtgtttttccatttaacagtgagaaatgtgttacttcttttttattatttcacttgaaaaagcatctccttttgcctgatttaaacacatttcatagaaatgtaaaatggaaagaaaatagaacttggctaatttcatagctgcagctgacttaaattttaaaattttgatagtattaaatgttaacacatgagagcccctgaagctaaagttgttatttatttgcttaatttaaataagtatttgcttttgattaaggcaatgcctggaatattgttttgaatttttattgtttgtttattttctttcaggaccccgcagggatctttgaattggtggaacttgttggaaatggaacatacgggcaagtttataaggtaagtacattgagtctgagagtggcttatgtacggtttcagttcatgaatgacaaattgcagtgctgtctatactggctcataaatggctcctaacaaatttaaaatgaattaatatacttgttgattgactctccatcttttaaaatatatctgtggttatgttgcttaaactggattctgtgatttgggtatttcccttcattatatattactgtgtttgtatgtgacacatgaattctgatggcacatatttgaagctcttcaagcgttcagtttcctttacttaatcactgccagaactggtttttgaaagagaaaagaatgccatctacttcagaaatttaagctattaaactattacagctggaaaagtagatgtgttattggcctaggacatgaattaaatgagtggagtgaacagtgttggaagaaaactgggttacctcacaaagcaaaagcttaatagcagcgacgaattttaggaaataattaaaagttaaacttgagttgagactgagctgtggaataagaagtcttgcttgcctgtgtactaatttctgcttacaaattcactcaaaaagtgtttttaaaaggtattttccccaagtataatctacgaaaaatggctggttgaaaatgtgagttgattccttttctgattgtcaaaaaaaaaaacaaaaaaaatgaaagtgaactgtttttggactgaaacttttggggtttcattgaatgagctattgaaatgccatcaaaacaaaccaactgtttcctcatgataatttctagggaaatatccatcattttccctagtggcagcgatatgggatggcatttccattacaaattatctcgtgttctatttttaaaaattcctcctgagccctaaacttctctcagttaattaaatttattatagaaatcattcaggttgtaatattttcaattctgcagaatgtcaaaagtattatttatagggtattctcgagattctaagtggatacacatttatatgtttatttacgagaggtttcctttggtgtccaggggaaaattctcccttgcaagaaacgattatttcctaaattgtacaccttttaccattagacagaatgtagtctacccaacctgctcacttgacgttgatcctgtctgacacagaaagaaatgtgtctcagcaaaggcttttaaatactttcaatgaagataattaggttggaagattgtgttactgcattttgagaaactggattgaacttgtgaagtaactaatgaattaagctctgacttaggtacaaaattacttctgatttgctgtcaatatgaaggagcaactctgtagcatgctgttggttttatggtgccatttcttagagcctttccgtttcattatgtttcccacccatagaatatacatttgggagacatttcacagcttggtacactaattcaagaggtgaaactctgcagtcttataagaggagataccaagagattcaattaaggatgagaatatttggaaaatccagaattatccataatttcttgttatttgaaaaaggcaaggaaacaaatggcaagaggtctcagatctttttagagagggaagatatttagcagctaggttgtcaacattattattctaaaggattccattctcttggtggttgatacagtactatggcaccttccaagtttaagggagattctgcaaagaatggtcatggtgaatgcagtgaactttgggacaggagatttgctctcttttaccagccccattgttttgtagccaccacagcttttctgtgtattagtcaaatgagaatgtagttagagatgctttggggcctggccaggtgcggtggctcacgcctgtaatcccagcactttgggaggccaaggcagatggatcatttgagctcagatttcaagaccaaccaggccaacatgatgcaaccctgtctctactaaaaatacaaaaattagccaggtggtagtggcatgcacctgtaatctcagctactcgagaggctgaggcaggagaatctcttaagcctgggaggcagaggttgtggtgagccgatatcttgccactgcactccagtctgggcgagagagtgggactctgtcccctccccccccccccaaaaaaatgctatggggccttgtgttgatttacttaaagaattataactccctacctacctatttaagggtttggtttctaggcaaccagacgatgttaggtggcactgctcatgagcagaccctgtgtttcctgaggccactaatccagtcctgctgtcattctgagttctaaaagattaaagtttaataaaatagcaaaatacgagctaaaagatatgtgagcctaagtaaattacattaaaaagtgattgcactatagattatgcaacttttatggaatatgtatgtttctaaaatactgtaggtataaatagaaatgttatagctctaggaggaggtccttatacataaaatcatatgataagtattttctttctgttaaatactgtattagtctgttctcccgctgctatgaagaaatacttgagactgggcaatttataaaggaaagaggtttaactgactcacagttctgcctggctgaggaggcctcaggaaatttacgatcatggcagaagccacctcttcacagggtggcaggagagagaatcagtgcccagtaaagggggaagcctcttataaaaccatcagatctcatgagaactaactcactatcatgagaacaggatgggtgaaaccgcctccatgattcaattatctccacctggtctctcccatgacacatggggattacgggaactacaattcaagacgaaatttggttggggacacagccaaaccatatcaaatgctaagcctttgattttaatttttaaagtctctcttttggcattcctggttttcataaagtcaggtataattttatgaataagtatatggacatagcccttattttatggaaaaatttattataagtttcttttttataagctgccctaagagagtcataatataattttgtttacaggtagttttaaagaaacatacttaatataataaataaaaagtatatgtaggtattcagagaacaccttgaaatatatctgcatgtgagtcaggtacatctagatatagaaatataaatattttatataaaagccatttaataatgtttagtttttcaaagttgcttctagtcttactcccaattttagcttattcctgttttgggcaaggttagatttgtttatctttagcattttagtcccatctaatcaagtagtgattcaatgtctgttttttgctttatttaccgaggagcataggtaaataataaagaatagtgattcactctcaggacttttaatgaggaaaccatctccttctgttcatggctgcattaaaaaataaaccaacaaaaggccacatacccatttactaaaggtcttggctgtttattggcatgccatctattgggaacctaatggaatctggacacatttttgttaaaatagagtaattcttttaataaattgaaataattgtttaatgtttactggtaagataccactacaaattagccacaggttttaaataaatgttggtttttcctgtctcctaatttgcccttttgaatatagattggttattacggaaatgaagacatattttatcccagggtgataatgtgaattaggaatatgaaggattcctcagtatttctcatatttcttttcaatacttcttaaggttgtaaagtgcaaagtagggaggccgtcgtggtggctattgtgcttaagagagacagatgctgtgagtgtgtatatttccagcatgctataagagtcttcatagtcctcattctgagttctctgccagctggctgttcagcccatccttcatgacctccagtcatgtggaactcattacttttctgtcagtccattttcctgcagttcctttgaatgttatcacattgtgctgagatcctgccttcttaaaatgtttaccatttcaaccccatttcatacctctagagctatttaaaatttaaaattaaatattctttcacaagaatgtagaacttttgggccgggcgcggtggctcacgcctgtaatcccagcactttgggaggctgaggtgggcagatcacctgaggtcaggggttcaagaccagcctgaccaacgtggagaaaccctgtctctactaaaaatacaaaattagctgggcgtggtggcacatgcctgtaatcccagctactcagaaggctgacgcaggaaaatcacttgaacgagggaggcagaggttctggtgagctgagatcgcaccattgcactccagcttgggcaagtagagcgaaactctgtctcaaaaaaaaaaaaaaaaaaaaaaaaaaaaaaaaaaaaaagaatgtagtccttttgtgtagtccttttgatatttgaagaaaatttctccgttcttcctccaaacatatacttacatctcctgttgtccaggcaatgtagcctcagttgcttgattcattcttatggcatagagctgaggcccttcattatccccacgaactattctgtcactaaaagtcgtgttttatgcttgtaaatagttttatattccataaaaccttttgaatatattatttaatttctatattagaatgagcaccttgttctcacttcagggtctttaaagtcatagttccctctacttagaacactttcccccagccctctcatggctggctccttctccttcaggtctcagctcaaatgttaccttctcaaggaagccacttttcatccctgtgtctattacagctagccactgcctctgcttccctctgccatagactttctttattacattaacctgctttattgtttttatggtattgccactctctgaattatcttacttccttgtttatgtctgtatttagcaatttaaatacataagtcaagggaaaattaagtcagagacctagtctgtctaggccatcactatccctagtctggcacacagtaaatgttgacacttctggggcccagaattgagctatgttttccttgataattctttctatatttgttcccagttttaaattttttttagcattttcataaaatgttaatctttgtactttagaaaaatatatttgcacaaaagcaataaacaaaatcctctacctatttttttttttttataatgggatggggatgtggatcttatgtttaatgaattaccagtagtctgcagaagcaagactatgctagaaatttacaaaatgaggcaaagcaattttctggggtctggtctcctggcagaggtcctcaaactttagtatgtaaaatgaatatttgggaaaggatttaaaatgtagatttcccggctccaacttctgaaattttgattcagtgggtctggggtatcctctttgaacatttaataagtataaatgctcattctgttgttcaaggtcctgggaccgcacctccagaaactgcaaaaatgattgtatgttatcctgttataggtcacttgagtgaatgctaatcctatactttttgtaatcatttattttaggatttccatgctgactcaaacttacataaactgagaaaagcaaaaatcaaagatcttgccctgagatgtgatacccgcctgttttggcttattcaaagatttgactttcagtgtttttatttgatatgcttatgattacagtttaaagctgaataatttaactcaagacctgagaatcaatattgtcaaaactgaccttatatagcaaaatcttggcctgttgggtggagattttctcaaatctgtatatcacgatctcttcattaaccttctgttaaaataagataaaacatttcaatagcaagtttattaatagtttatttatggaggtgattctataacattatcctggatgcactgtagcttttcatagcctgctgcaatgaatcatgtattatactattcacttattgtttggcaaggagtgagtatgggagaatggtgtgttttatagataatagtggcgtttgttttttaatcaagaatttctaacataaagaatacattctttcacatttgttgagtgcccatgaaaaaagccctgtgctttgtatgggaataatgcagagctaactgaggaggttcctactcttaagaagtgcgtaatcagattatctaattaggactgagtgttcactgtgcaccagaggtttttatgtatattgtctcagttattcctcatggtggttatggtctcattttactggggaggaagaacatttattaaatcacattatcactgtaaggcagggtttctcagcctcagcactcctgagatatggggctggataattctttgttgtgggggctgtactgtgcattgcaagatatatagcagcctccctggcctcatccaactacaaagcagcagcacccctaagttgtgacagctgaaaatgtctccagtttttcctgtgtcttctgtgggggtaaaaccactgctctaaaaatcacacagaatggcaaaactcttaacattgaggtgcaagtggggatggtgagagtgtagactatttaggaattaatgctgtccaggcagagtggggacctgaatgggcacaagatgtgggtttggaaaaagcttagaggctttggcatttccactgtatctgggagtgtaattgagcatttttataagtggaaagagtataatgaaaaggactttggagcaggactgcctgagctggattcctagtctggttttgctctgttccagtcatgtgaagataatcaacttaccctgtgagcctggatttctttatcttttattaatagtacagattagagctgttaatgaaaactcaagtataaaacattaatatgtggaagcattcagctcagtgcctgacacatagtaggcactcaataaccttttcctcttcccaaacacatgtgccagttcttcccatggtcttgctttcatagaacattttatgacctaaaagaaacattcatagaggaatgaagttagaaacacatgtctttgtgctccacattctacatttgatttattggtttttatgtatgcttagaatggcattatttgtattaaatattaggatggtgcaaaaataattgtggtttttgccattaaaagtaatggcaaaaacgacaatacttttgcaccaacctaataccagtattacttttaatggcaaaaacagcagtaacttttgtgccaacctaatacaattcttacattgtatttggtgatataattgccacttggatattatatttggtctttagtgcttaaaaaagccaatgtctcaataatgtgtaaagagaagataggttaatagaggaaacaggaatcagttgcagcactgtggaactttggtggggtgaaaatggtttctgaataattttatatttcacaagttttggaggagaagcaacagtatttcttcttcaggtagcataaggtctcaggagagagtctttattgtgagattagtgaaggggtgtggagcagcaagaacctcatttagatattgaggacccgttgtatggttttggttctacccttaacttgccttagctttgagcttgccatagatctatttggaacttcagttgttctcatctgtaaaattagaatataaagaaacagttttcatgatataacccatgaagctatcgtgaggttgaaatcaattaatgactatgaaagtattttgttaaatataaattcctatgtacatgtaaggtttgattactgctattgtcatttattacaataggaggtggcagattcctgttatcttggggtctggggaagtttattcctatgttgttatttctcttcttcatcctcaggctttattatctgttcttaaagtgtagttttgctagaattaaaggtaacaattttacttccattctccaataagtaggagaatcattcacctttgaaatatgttggcttgatgaatttttcatcctcatagatccccaagttgtttgcatctaatttgtctgaagaccatgccaccttgtgctatgatctgttgagtataatgaattagatggttgtcatgtgaacatggagggaagaccttcgtgggtgcctgtgtgctagatgccatatgggtgggtcgattgctctactaggtagttgaacctgtagagttgctaccaaaacttgatacagggactgtgtgggatttcttattgctactagtggttcgcagccttcactttttatagaaatcatctggataattttgcaaaactatagataattgggcctttctttaaaaatttgattttggtttgtctgatgttgggctggggaaggttttattccagaccttcccagatgcttgcaatgcacagccaggatagagagctgctgggctgaggctgtctgtagtgtaagtgctcttttgggtatctttgtctttggagatgagtctaccccttttagctctatcttggggttttgtttacctttgtttatttattcagtgtcagccttcataagtatctaacaactgcctggcattgccatcagggcatggtttatagataaacatgtggcatggtccttgccctccaagggtttgaagtctctgggtggagagacatgaaaatagatcacttcaatgttgtattccatgcaccacagcaagagtatacagagcagagccaaatctgtgggggctgtgggaagaccaggaaagccttcatataaaggtgactcttgagtggagtcttaaaagatgaatagatgtatgtggaaggggaattaagtaggtactctagggagaggtagtgttaccaaaggcttgactgcttttgatggcctgggccagggtcaataacctgaggtgaagtagggctgggaagcctttaagacagacatggacagatggctcttctggccttgagtcttggccttgagactcattagctgtgtgagcttaagcaagtcatttagcttttctgggccttggtttcatgtataacgaagaggtctggctagagggtctccagagttccttctagatatgacatcctttaattctaagtagagcactagtctggataacctccacaagttgcttccatgaatccacttacagcctgtgcttttccaactgcaaaactgttacagcaatactctaaaccattagcaaaatgatttatacggaatgcctaacattattaaggtacccatgtggcctggtggcattgcttggtgtagttgatgtgttgaaggatgtagacacatgcacattttataccattctctcattaattcagagccgcaaggttttagcaggttctcactgcctcagtgaatgatgatacaaaatttctaatagtgatgaaaagaggatgagattttctgttagggatggacatggattggcactcgtgtgctcaattttgatttgaagtatttagaatgctttagtccaaaatactttcattccacctcatattgtatcaatgagttgccaaataacttgatgcacaaccccctcatgacttgtagtttttagatctcataacacccttaatgacttcgtgattataaggcactttcaagtaattaaaccatcaatagttactattctgggttatttgtaacctgtaaaatgaaaccccgccaggattacaggcacagaatttagggctcttcacggtttttaactattttgtacatgggaaacatttgagactctttaataaaaagaataaccaattaactgtggtattgagattgtatttcttatctctgtagtttaaccttaagtataatttcattaaatctgcttggatattttgcatatgcaaaaagaaatatctgctgttcggcaagcaaatatatgcttactactacataggagcgttgttggtggtgagggtctagaatggggtcattacaacctctgctgctgggtgcagtggcctctgatattgcttcggatcttggtcctgttgctcactttgcaaggagaagcacagaactactgtgtccattttgttcctctctacaacaaaggcagacaagtgtagcagctggttacacaatttttctagataaattacaaaatgtctgttacaacaatcatgataataataaccatatcatctttgtggacagcagggaagagttaggaactccatatgtgaagaactcagtctcctttaaggagaaggtgacttcttgttttagaaaacttgcccgttactgtttaacatcttcgagttgatacttcgagtatggcttgagaaattcagttttgatctgtgcatcacattcagggaggtggtatgaggctcctagctgaatttatcttactggaaatctttttagtggtacctctttctcttatcgtagaacgtacatacagtaattacccccttagccattttaagtgagcatacaattcagcagcattaagtacattcacattgttgtgcaaccttcaccactacccatctccagaactttttcatcatcctcaactgaaaccctgaaccagttaaatattaactccccataccctactatccctcactccaccccatgccctgatctctgtttaaaaaaatactgttagtaaacttaaaacttaattatagaggtggtggtttcctgggtcatgtcctgcaacactggatctgcaacaagcttgaaatgggtctgcatgtctgtctgtccttacgttggcgttcctccaaggtacctcaccaacagcccactttattatctgcaggtgactgaccgccccacaactgcagggctgcatcttgttctaggaagctgaaaccagctgaagcccttgatttttctaccctgtttatatctaaataaaacgatccttctcaggtagaagtccacaaaaaatacgcaagcattttgtatgaatcctaaaagaatattgtgtatgttttctgatatggtttggctgtctccctacccaaatctcaccttgaattgtaataatccccggtcaagggtggggccaggtgtagatgattgaatcctgggggcagtttccctcatactgttctcgtgtagtgaataactctcaagagacctgatggttttataaaggggagttgccctacacaagcattcttgtctgcaccatgtaagatgtgacttcgctcctcattcacttccggccatgactgtgaggcttccccggccatgtggaactgtgagtcaattaaacctctttcctttataaattactcagtctcaggtatgtctttattagcagtgcaaaaacagactaatacattttctatattaaaatgtctgggctgtggttatttttattacaattttacaaatgagatttctctttaccttaaatgtatcaactattttttaaagcagcaaaacatttttcccccacaggaaactccagtatttgacacaatagcaggatgttctgggaggatagttaggatctacctcatggagccgtccctttgccgacacaacactccccgatgcacctctacctccctccacagagtagccccacacttggagctccagggagcacagttctacatccccagtcacaggttcctatgacatgacctctgcctccccctccagcctcatctacggcccatcctgattcccactgtgtccatctatggtagcacattgcggggcattcgtgcacactgcacacggtgtctgtttatccgtgctgtgcccttcctcaccccctgttggctagcaaccatactatatccttaacacttggttcaggcagcacctgcccaatggggtttgatggttttccctgcctcttctctccgtactctgacctgtttgtaatcctctgtctggctgtctcctattccaaactgagtcagggacattaccttactgtttctctagtaccaatacagagtaggtagttataaatatgtaccaaaaaaaaaaaaaaaaaagtacagaggctgaggcagatggatcacctgaggtcaggagtttgagaccagcctggccaaaatggcaaaaccccgtctctgctaaaaatacaaaaactagctgagtgtggtggtctgggcctgtaatcccagctactcgggaggctgaggcagaagaatcacttgaacctgggagatggaggttgcaatgagctgagatcatgccactgcacactccagcctgggccacaaagggagactccatctcaaaaaaaaaaaaaaattctgctgagtttggaatgccctaactcagtgagatatgtttaggtttgcttcatctcaactgtttgagtatataaattaaggagactgacacaaaatataatatttagtagccaacagcagtttgatacctgataagtaaaaacagtgtccgcctaccatctaatatgacagaagagaataggacaaagaaaaaaattgttttcccttctttttaaaactggctttatgattctaaggctgtttttgtggctaagcacaaagaaccacagctcatctgaacttttaaatagcccattgcacacttttgatatcagagatgggtttttggaggttgttttccatcttctaccatgtctttgggactgtagagttaaacgttgacatcactgatatcaatcataaaacataaaacaatggttttgaaaccttcatattcattatttcatttgaccttcacagtaaccccataagttagatagaagaggtatgattaaccttgtcttaaaggagagaaatttaggtctgagagtttataaatgtcttcccttgaagcccccaggtaagtagtagagcatgactcctgatcgagtcgcctaaattatcttacctccactcagaagtttcccaggaggaaatttgtgtataacatctccttaaatgtttggcaaagattggttttgccctgcccttccattgcatgtttagaatattttaagtagattcttgataagtctgaatttatactatagagcagcgatgccatagcctgtttcaatatatagtgcttctcatctttatagcaaaaatactaaaaggtgattcatggcttggtgattactcattgatttcttagtaaatggggacactgtgtttttgtacaacaaacacaattgtgttttcccagaaagataagaagtggattcttttccacctacaaaaaaggaagcggcataccttgggctacttacattttacaatataaaatacatctgtgttgattatttaagggagttggttgcctcgtttctcagaaaggaggaagaaatttctagacttcttaaaaaatcagctccaatagccaggtgcattatgatttttttttccccccagaaaaactctatattcagactggagcttgataaatgtttgttgaaatgaattgaattgatttattcgctcagcttcagttgtgtgattttgtgagcaaatggatgaatcttactgctctggagaccacgcaaatatttgccaggtgtataatttgtacttttcctctattccaagcagggggaaggccagttacctgttacctggtgtggcattgtagcaagttgcttactctttgcttttatatttcctcctttacagggatgcctaggtttgtgtgtttggggttgagggtggggagagacaatgaaatagaggatggaaagaaagaatttctgggtattgtagaggaggatgacctggctacaataccgagatgtaatctcttggataatttgcatgactgcaagttaggaatacctgtgactctctatttccgtttccattaaggatcacattattcacttttttccttacaggttttagttatataacatcagtaacccaggaatgctagagatgcctctatcagatactttcatgacaagttttagccagagttatctcattctttctctttgtcaaaatagtgaaagttagtgaaaacaggacagtgtgtcctcttctttgggtggaggcaaagctgattttatattctcttcaaaagagttgcaaattaggcagattctgatttctccccagctaacacttctggtgatttcagctggagaaaatgaatgttttgtggcctaaatgtttagtacattttgttctaccattttgtacccacttgtgaacttatgaagagacacttcaaatacttcagaacttcaaaacctttccattccctcaagaaacctatcacagaagccaatcaccaaagcctccctcctgctccatatgaatatgcccctctgagagtgcttcagggaggaggtgcctgaagccaagccctctgaggcaaccccagctttcatggtctgctgtaggatggggaaatgggatgagcagatgattaatacggagccatggctgctctgtccttggggttccagtttatctgttgctcagaacaagatttgcttgaataagacgaatgcctacggttaatcagctgagtaaatagtcataaattaagatgtgaccaagaatccagtgttcacaggggatgggggaaaatacaagacagaaaagacaaaaacaaaaaaaagtctgctaacagaacccaaaacagaatagcaacattgaaaacagaacgctctttgagtattgttttctagtctagaagcataggagatttatggctacctgattaagttgatgagtaatactatggtcagatgtgctctttgaaatttggcctaagtactatgcatcatggtgttacctctctctgaaatctatatatttgtgaatagctaaaagtaagataggtattgacaatgttttctttcacagcccaatcactacttaaattatttctccctcagcagtcttaatctacattctcagtgttgaagaaactccttagtctgtgcaacagtctctagggagtatctttgcatttctaacaatcaactctggagattaattgggattatgaggcccatttgctcataatcataagatttcagtgtctgactcaggatcttgtttctcaggaagcccaagggtaaggacacagagaactcctaggctttagtcttgtgtcagccgagtcctgctacaagctgcccttttggccctccgaggtcctggaggttttcttttgaaatttccttgaggaacacggctcaggtagtggaccagctcaggtgctctaatttcagtgtgagtctgtgggcagttgcactcaactacttctccgtggctggtgtctgtttccaaagtaaatacaggggagaaaatcccctttttacaatcagcaatttgggttagagcagaagcagtgaaagtgcctaatgctgaaaattagttttttaaaacaaggatagctatacaaaggtgtgtaaatctacatatatattacatatatataatgaatttggtgtttgtgctgagttctatgctttactgggagtgagtttctaaattgttatcagttcaagaaaatttttttttcttggtagcgcagtgtcaccctaagacatgaatgtggtcttaagggctgattttgctagaataatggcactttatactaacatacaccttttgggggcatttggagggtagaggatatctacaaaaaattctccagaataaacattttaagaaatcatagatattaactctgaagaagtaccaggaccacaatcattactgcctactattactaagagaagaaaaaataagttaactttttaactcagcttggatgaaggctgggcatccaaaataaaaactttgatttgtaggcaaaacacccatgtggaaggtcacattgcagaagaatattgctgtcttcctagacttgaacctcagaggttaagatgagttcagaactcttgatagtttaagagccatctctttattttttttaatcctgagtcatctcttgtagtcaggtgtttcatagatttagtatgtgctttggttggcagttcttgtctttacttgttaatgtgtctctttaaaagctcaaggaccgaccttgttctgtgcacagtaaaagtagcaatagtatgtaatcccgtatgtatagtatatgtatagagtaactatgcccattataggaaaggctcggtagcaggcttccgcaacatcataaagtaagcacttactgcttagtatccctgctttacagatgaaaagtctaaaccttgcaaaatttaacttaccctaggtcacactgacagtaagtggcacaacctggagttgaacccacaaccttttgacaccagtgattgaaacagatataattcattggcataatgaaagcatggtggggtcgactgctcagtgcaagagttcagtcatctaacctttaatttaaaattttctggtttaactgaagactactatttctagttcttaggatccttgtaaagtagagcagccacctttagtgttgtttacatgctttgtttctcatatctgaccattctaaaaaggtagaaaagaattattctgctcacaaatgacctagtaattctgccaatatgttgaaataaatgttttttaaattatcctatttaggaggagaggtgactttaaggtagaaacccagccaaaatatgttgctattctagaaggttctttggcttgggtcaatcaaataactttgatgttacttttgcatttctgaatacattaaagcctcattagttttcagagaggagacttgggcaaaacttgaccttttaaagtaccttagaaggaggcgtttaccaagcaatttaagagtataaacaggagtttaagaagtttgttgaaagcttctgtccttaagtacccttgggtatcttaagactgtttattcttgttgatatgctaatcacaagtcattcttcagtattaaagcatttcctccaaggaattaatactttcacttaaatagggttcctgcatgtacttggttcattaaactgtactgtaaagtagttccttatttacatagtgataccaacccttgcatcccaaatacactgagttggagaggctttgcagagtattaaacacatttatgtcaaacattcgccattttggaaaatctgaaattatcagttgcttattctttggataaataacacaaaagaacatgtggctaagtcacaaaggggatgcctttaaagttatgtatggaataatggtctccctccatacttggggtgtggtagccttgtggaatccaaaggcttaaaaggtgaatagatttttctgaggattgtctggagtttttaatgccacatgaagatatggaaaattttatggatcaccctggatgagaacccaggatgaacctttcaaaaaatcaaacacttctctttgaagcccaattttgcatttgtgtatgaactagacccttgatactccaggtgtggcctgctgtccagcagcatgatcagcacctcctgggagattgttggaaatgcagaatctcaggcctttccaaacccactgaagcagaatctgctttttaacgagactcccaggtgatttatatgcccatttaactttgggaagcatgagattaggccatctccttggtcctgaggactagagatagcttgattagtggaatgcctttccttggcataaatccagggttcaggatgggcagggtgcctgaaatgcaccatttaacttttgtgttgaatggttctcctgggaactgagagggctcaggcagggcctttttgcccagtgtggttggtttgtcatatcccacagagatgaatcacacatttggataagtgaagaggagaagggagatctcaattctggcagtaaccaggttacatgatgcagagtctgtaatacttaggtggagggtacatgaagatttgcaacatttggctactactatgaattggaaattttcctcccaactcttacaaatgcaatgatagccctgaaactctgtccttcaagatattttggaactttctctggtgctgttatttcatattaaaatgagaaaaagaacaagaacatgagaataaatgaattcttttcctctcaaaaacaacatccaatcaaaatacctaatgaaaaatgaagatgacacataatgcaatttttgtatgaatagttcttttgattaattatatagaagatctaagatgaccttctttcaatggttgagagatctgtcaagtgtttttacagtgataggatagagaatagtcactcagacacacatatacacacctcctatatctgcatgcattcatacacacacacacacacatatatacatatatatatatattttctctatggttgttggggaaagtaaataacatagtttgcatgaagaatacatagggcagcccagccatggtggctcaggcctgtaatcctagcgctttgggaggccgaggtgggtgaattgcctgagctcaggagttcgagaccagcctgagcaacatagtgaaacgtcatctctactaaaaatacaaaaattagccaggtgtagaggcacgtgcctgtagtcccagctacttgggaggctgaggcacgcgaatagcttgaacccaggaagtggaggttaagaaaaaagaatatatgagacagattaaagtgtccagcaagtgttattattatgggaagcagcaggttaaaagcataaagtttggggttgtatcccttgggaccagaatcttggctctaccacttattggtagacctaggcttcattgcttaacctctttgtgctttggttttctcttctgaaatttaggaataatagtacctagctcataaggattaaatgagataatacatgaaatggcatttagaagaattttaggtatacagtgagtactcaaaaaagttagtttttatgtatgcagtatactctgttatctgaaattcagttacaggattgagtttctttgggcatttttttttttttttttttttttagcaacagagctttaaacttgttatatggaaatctttcacttcctcttcctcttaattgcagtagttaattttcctcatgctaattggatttcaacagggagaagaattaacagaaaatatttgaatgtggcattatcagatgtagtcatctaatatcttcaaatgtcatagagagctttttcattctgggtgttgagattagttgtaaagagctctagaaacacctcagaatcctggatcaaacagcctggttcctaatctagattcagattcaacaaatacggattggctaccaggtttgttcttggctaccagctttgttccaggaactgttctggaacaaatacagaggttaagaccataggtttggatctaagcagatctgagttcaaattttgattctgcttattagctgcaatattttgtgtaaatattgtgtaaggacaatggtatagacaatattggcagaggcaaaagaactaattaagaatctcattcaccctcctcaaaaacatttgctataatgttgtattttatgtcttgtttgttctgtaattcttctatatgttcattgaaaaatatatagaatattttcctttgggtagcccatcttctagctccctgggaaagatttcattggccactaaaaacaacttaagatcttgctttgggagtagataagttcattcactcagatttaacaattttaagacatacaaaaaaagccctcgaatactacttttagaagatcctggataccattggctgctgcttattccacaatgaatgtatgctcggtgtaactagaatacgcaagaatggatagctttcaaatattagtggggaaaatatcctttacatcaaaacatgactgaaatggaatggattacaggaatgttggaaatactgggctaaaacattattctgactttccatcatcctgttttgacaggaccctagacaggcagttttggggaaatgtgtcaaatttgtgttgagctagaataaacaatctaattgtgtgacactgcctcttgggaatcaggagtcagcttcttcctcaccctgaagtgattagtttatgccctggagctgtctgacccttgtaaaattatcccagctggtaggactgcagtggctgatctcatttttctgtgaatgtcttattcttgtgggaatctttatcaatcatctgcctctctttgtacaatacaagagttattgtaggattgtttcatgggctagtaaaaggaggtgctttgtaccaaccaacaaatatttcttgctctcttgccagtgtgaaccactaattctgaaaaatatgatatgtgatttaaaatataaataagcactcagaccactatccaaaatttctaattttcccagtagattggtggtggaagttctggtcatgttttactgtttttcttgagagatgaaggtagttgatgatctatatggaaacttttttgggtgttatagctgagagtctgaatcctagtatttctaggattctaggatatcactagttttcagccattcagcaataccaacctctttttttttttccaagttcatcctagaacttgcagtctttttgcttaatatttttcattaaagtattttatttacttaaatttttcaaaaagaaaattcgttgctaccgtaaatgagaaactcaatattttcagctatatttaaaaatatagtacatactttttaaattaaaatatttgcccttgtctcactaaatcatgttggtatttggaccactatactttaagaaataacactttcatttgtgtttgaggcttaccagcatagcagaggagagggactcaaacacaaatgaaagcactacccggtgctgtagtatgactgttgtaggccctccccatttttgcctccgtgggcccctttctccaagaaaaataaaacaacaaaaagttaaaaattaggctttataacctcattggtgtaagacaaatattatatgttaaaacattttctttggcctaagaattagtttttatcttctaattttaaaataagaataattttttgttgactgcaaaaagtactgtaggctctaggtcctgtgctgtctgcatctaatggatacgttcgttggcctgtaaccaccccatcctcttcaagagatctaaaggcttcactcggtggtggtgtggaaaccacaaaaatgaaatgtatttggaatcttctgttatatccttaaaatttagatggattctctttatgccacatgataatcattgttgcgtcagtttaaaattatgttaatgaaattactatagaaaggttgacttaaacaaaatctatggtttcctgctgctgtaatacttggcatagagctgagtgccccagggagtacttgtgctctggtttggaagcacaggcatgaggcatgttaaagtagaaaagcttttctttttttccttttaaacttgtgctcaagagaagaaattgggtttataatggatttacttgttgtcaaaaacaaactatagatatcatcctagcactgtggctaccatgcacagacaaccttaacagtgaataagtaagtccatgcagattctttagaagatggtagaagaatctacacagcactatttggtttcaagctcatttgtaagtcttcttttcttagagcctagtgagtgatttacactctcttagctatttctagcaaagaggaagaacagtcactcttgatgagtgactaaaactgctgcttttacctcctttttaagaagtcacttccctaggtttccttggtattaagagggggatggctttccccttttgtcctctcattactctcttatctaggacaggctattataaaagctttttgtttgtgagatcagttctgatttctaacttccccactcaaaccgaaataccacacttgaagttcccccaaattgctgctgctccgatgactcctgggtattgtacgctaaattcaaggatctttatttaggttctttgctctcttgaaaagaaaatcctaatgagtcacccagtttgctgattgctttgtaggtgtgaccagttaaatgcaatgatagtggagttgaaatagaagaagtcatttgggctagctcatttatcctgaatctaatgtagcctgttggcttctctttacttgtgtgtgtgtgtgtgtgtgtgtgtgtgtgataggcacttctcagctgagggccagctctgcaggcacttaggacttgtataccaggcatctagatgctacttagaactagcttggctgtcaaagagaagagagtgtgctctatgtgtttggtgcctgagctagggttttgtcatttttcttttctttttttttttttttcagcaaatgaaccagtgagtgaagggcattatcacaactccaagaaccaactaggagtcacccatgacatcatctcctgaatttcatcaccaagcccagctgatcctatttcctaaatggttcctgatttctctcttctgttttctgtctctgccaccactgtcctagcacaggcattgcacatctctcatatgaacgcctgcaggactgtcccttgatgttatccttgcagcccctacattcctactgtgcagccagtaaagtcatattaaaatgcttatttgatcatgtctctctcctgtttaaaaccttttgaatgatttcccatgtgatcaagagtaaacttagcctacaaggcccaggatgatctgaacacaaccttcttcttagtgctgttctttctcactctctgggatccagacatactgctttctctttacacagaaaacctaatttgcttcctcctgcctcaagacctttgcacattcctgctcctggaatgttcttctcctgttattaactccatgtcactttctcacaaaactgttcttcatcctccagaagatcccaggccccgtttgggctttcatacccccggcacattctggtggggtgctaaactcagattatagtgatacacattggttgaataatatatttatcagactataagctccatgaggccagagacttgtctactttgcttaccacagtattcccagtaactagcacagacctaccaaagactggctgctcaataatttaaagaataagtagagtgcagtgcaaggatgacatgcgcaaggtgtatatgaataaataaggaatcatacttacatatccaagtcatcagaaaatgtttaattatggaccatatctttaatagggcacaaggttacataatacagcttcagtgatttttcttcaaaaatcataaaatcagtgtagagacttgaaggcatttatctacagtgactcaattctgcatagattgttaagcttttagagtaattaatgatcaaccacgccaagcagagtctgactgcagtgcccttcttcctgctgtttcatctgcctgtgatcctcttctccagacacctctgttgcttgttccttcactttctccaggtctctactcaaatgtcattttattagagaggccttccctgaccaccttatagaaaataacaccccaccctctccattccctgttccccttaccatgtttaatttttttcccgtagcattcatcaccatctaccatccatccatccattcatcattcattcattcatttgttcacttcagtctcttttcactagactgtgccttgtagataaataaggattctgtttttgttgagtactccatccttagcacctaaaacaatgttaaaacaactagatgatactaaaagcatattttttgaatgcatgaatgatcataatgaagaaaagcttactattttatccccttgcaactaaggaataaggaaggggaaaaaaagtccattttcaccttttgacctcttcttgcccttcaccaaaaactgagttccctggtgttttttctctcatatgctgatgtggtgcaaatagcctaggcttgagggtgagggtgaaggtcgagttcccaccctatgattgtatgctccattgcagctcttgacagtctattagaaatccataaccatagatacttctgcttctagggctttctttgtgagcctaagatttaactaccaacacctatgttgtcatgtggcaaaagtaaagaaaaaaaaaaaactcggtgttttcacctaaaaataacagcttgctctttgtcaagtggcagcctattgcctgctcttgcattgagtccttctccaggcaagatgtaatataacaaaggaagagactggtggtcacaagccaggacattgcagggctcattaattacttggaaaatggtgcctgggctgcagccagaatcccaaacaaaaaaggaaatagctcctgttctctaattgacaagttgatgagtgaggtaagaatgaaaatcatttcagtaagtaaaagggggaagaaatcaaatggaagcagtagttgtgttgaagaacaagtatacaattaagacatattcccaaccctgagagggttgattcacatcagttgagaccatagatgtcactgtgtgctctaggccatgagacgaattcattatctcttataaaggatagggaacatcaatttagggtaagtgttgatagtgttggagcctgggccaaagtagatgatatatatatacaaatgagttattaatctcggcagctcctaaatcatttagtccttatgagaactgtgttgcaaatataaagagagttaaatattctcactccagaaaataggatctataattttggcaaggctaaaaattcaaagccatcttagtgaatttgttgtaattaaatggggatcgtttcaagcaggaggagtcagttaagaaaaacgagaatttcgtaatgttgtaaaaagaggtaatttaagaaaagtacacttagtgggttaaacactgttccatcttggtgtgattatattttggagcaatgtttatagaacttagcctgtcactttcacaattctgagctgtgcaaaataggaaggtccggtcacctaatacttagcagaaataaggtcatcagtacctttcttgtgtgatattaatacagctttccaaatttgaatgaccataacatatctgtcccataaaaacactgcattaggagaaaaaggaaaatgaaaacacacacaccccactgctactaccatcacccctactatcacctcagaacccctacaaagaagcaagactttcttgtggttgttcaatagcctataaaaaatgtaaagaatatttatttatggaaagagacagctttggagtttgcaagcaatctcaaggtcaaatcttgtcctttgggaagaggtaaccagaattgcccactgagggtcagatgtttgtaactcccagaaatgtgaacgtaaaatgaatactaaagctgtgctgcaatcatataaagagaaatgcaaacaggggcaagatatgggatggggtttaaaggaaaattatttggttttttgcttttttggggaggcatagaaaagatgagaaataaatgaaactttctaggaagagacagaatttaagaactaagttgagcaatgggaaggagggaggaaacacattcagtttgaaatgttgatttctgctcagactagactgtcgaaggcttggtttgtaaattggttgagcagagtcatatgaggaaggaactcccccttttgttttactgaaacaagtgagtgaggcatctaaactcatttatgccttttgggtaaaccaccaaacacctctttaataataacctacttggttgtgatgatacattgatttggagataaatcaaaagaatcattggagaagaaagactagaattctccattaggatatataactctagaggcactttgagaggcaggaaaatatgagatgtggtataaataatctctgcctggaaaccatgcagcaggcttagtctcaatgcccattcacctagaggttgactccagagaatctgcagaacagcataagtgaacaaaggttctgtttcaaagaattgcaagcaggtgctgtggcagtcattgatactgttcaaatagttctgtactccctccatcctgggcacatttaattactggtgccagatccttcaggcttctctttccccagtgaaggtgaccaacaacctgagagatggtggctgctcagggagccttggtgttttgttttggaattataagtaagattgatgctttattgagatttctctagtttagtctcattttattgggatttcactagtttagtctcattttcattacatcatattgaagtaacatactatcaaaatgagttatccctgttgaggctgatgcagcagtgactgtcaggtttctctactgtaaacggctcacccctctccatgctgtattctttggcaggtccctatgtgcagcccacagctaagaagtggggagttagactctaccttgagggttgtattagtccatttcaacattgctatgaagatatatccaagatgggtaacttataaagaaaaagaggtttaatcgactcacacttccatgtggctggggagggcctcattattatggtggaaggcaaaggaggagcaaaggcatgtcttacatggtggcaggcaagagagcaggtgcaggggaactgtcctttataaaaccatcagatctcatgagacttactcactattacaagaacagcatgggaaaaaccaacacccatgattcagttacctcccactgggtcccccatgacatgaggggattagggagctacaattcaatatgagatttgggtggggacacagccaaaccatatcaaggatagagtaactgcatacattatttgaattcttctgcataggagatttgtcttttctgccccatttattcattcatttattcatatcaatatagattcatgtgtattttattttgtacattgggttatattctaatacaaccttatgtattttgttgctcaaatttttccagctttggccattggaaactctcagttgtctgctgtgcccctttgccacagagacacctccctctttttttgtttttttgttttttgaaaggaatcctcattttctggtaccataaggtgcttgagagtgatgatttctgagtgattgcaacaagcaaagcctttctgccagcctgtggagaacacgtattcctactgagtaaacaaaactctgttgagccactgagactcaggttgtttcacaatttaatctagaccagtggttctcaaaatatgttcctgggaccaccaacatcagcatctgctgggaacttgttagatatacaaattatctggtcccactttagacctgaagaattggagactgtgggattgggacccagctgtttgtgggtaacaaaccctccaggtaattcccatgcacactaaagtttgacagctttaaaagctttatagtttcagatctagtcttcgtaatttatatgagtaacataaagaggccaaactcaatggatcttttggttatatttaaattattatatgttgttccacagcaaaacattaacaaagttactttaaaccaagatggttggttttcttcataataaaaatgtaaaacatcttgaaaatacatggatatgaaggaatattactttgggatggggtatagggcttgctgtacactgggtccatttttgcaaacttctagcaatagctctgccaacttcaggagatctctgttgggatcaaataagatggtggattcaacagtgcttggtgagctggaatgaacgtatggattatttttgagttaagcctctctcctattagactgtaactgccataaggataaagactaggctactaccactgcgtagaccagtgcctgatacagggtatgtgtttagtgaatgtttgtaaaatgatcacgttattttttgggcttttgtttccgcataatgccttgggctttctgccacatctgcacagcacttgtactattattctcttacttaaaaaacaaaaaacaaaaagctgagatgaaatttacatacagcaaaatatatggcttttttttttttttttttttttttttttttttttttttttttttttttgagacagagtctcgctctgtcggccaggctggagtgcagtggtgcaatcttggctcactacaacctctgcctcctgggttcaagcgattctcctgcctcagcctcccaaatagctacgattacagcctgtgccaccagacctggctaatttttgtatttttagtagagaaggggtttcaccatgttagccagtctggtctcgaactcctgacctaaagtgatccacctgcctcggcctcccaaagtgctgggattataggcatgagtcactgtgcccggcccaaaatatgtgattcttaagtgtacattgtagtggatttgatacaggtacttgtactatactaacaaaatagatttatttaaattgactctttttgtcccatttacaactgcattaatagccataagctcatggttttgtagtctgttatatattttccaatgaatattaaaatcagtaacccctagctacctctccaatagctctcttcttccatcctttcagaattttgttcttggaggagaacagcttacttatttccaaatttgtaggctttttttttttccctcccaaataccaagagtcctcaggtcattgtgttgaaacagacagaggagtgacttttggaccacagaagagtttgagagattgtttcaattggactgcctgttttcttgtttttctgttttccaggacaactttggaagaagctgactgctttgaaatcaattcggtacacttcaaaaattaacttgctccataggcatttgtggtacaccagttaaacacagagttctgtgttaggcactaaaagaatatccttagaaagctagctgataggtagccttgtgggagaaaggagtaaagtccacgagtaagtataatcaacaaggcacgatgcagggcacttcagaagacttgagttgtgtgccatgggatcaggcagtaccctacttcagtctgtagatttgttcactaacttgaaatgggagtaaattaaaattcaaactgcactcatcctgtttatgtattcggtttactgataatcacaggttagtaattcagatctcaatggctgagatgtttgggctaagtattgtcaagggattgtcatatctgctttagaactggtttacaatactacactcattttatttacattacaaaagtaatgaatgcttattgtggaaatgtagaaatatgtagaaaaatgaaaatgaaaatccttaatcactcatagtccaactgcctagagactattgctggcctttttgttaaaaatacattttcccatggttaggatcatacttcatgtaaagtattgtaactttaaaaatattagcatttttttcatgtcatcaaatattctttataatattttaatggtagaatcgaagtagattgtatgtatctactgtcctttacatgacagttttatcatgcattccaatttcttgctgttatatctttgaacataaatctctatgaatttttcataatttgtgtatataattatatggacactatttctagatataactaggctcaaaccaattaacacagcctaataaggcagaggcagactgggaggggctggaaaccggcccatgagctggtgtatgccaacaaacacaccttgcaggtgctgccagaaggcctcgtctggcagccaaggcacacaatctgaaaattacagcaacagaccggattctggtagcacttggcatcaggacatccagagagcttgtggagtttcccaagaagtctgcttagatgtcttaagactgagaaaagagggaggaagtctagtgagaagcagcctggccatcagccagcctgggattcagctgaaggacctcggtctgttcaacccacaagcattgaggggctactgtgtaccagcactgtgctgggagcttgggatacttccacaaacagacgcagatctctgccttcatggaatgcatattctaatgacgaaaagcttccatggatggggactgacaaaagcgaagtggcattctggttctagaggaactggatattgagtatattcaagatagactcaggtaaagggaacaaggcagaggccagtgatcagcactggcttctctaatgaactgagctgaatatcagagtggacacatggctagagccacactcatggcaaggatgacttatcaagtctcagagtagagcctacaagtgcatctttctggcctaaggccatattagtccaaacagtgaagatttgcctcagcccacacatggcaggttcagggctgacacctgaatttttacacctggttgtaggagatgggaggtaacttagtgccaatgagtgaaatggagaaaacagaaatgtgtatttagccctctgactagcatgtattatattaggttgttaataaaggtttgttaaagggatgcatgaatttaggagaaaagaaagacgaacatcatggggaaggcatgggagacagaaaataatactaattgatgtagcatagtcattatgagcttgggcagagtcagacagtcctagattcaaacgttagctcttccattctctgtcttcagtttcctcacctgtaaattgggctaataatagtaccttctgcactgtacggtagttaggcaattcctataaagagataagcacacttagggccgggcatggtggttgatacctgtaatcccggcactttgggaggccaaggcaagtgaattccctggggtcaggagtttgagacccttgggcaacatgatgaaatcctgtctctactaaaaatacaaaaaaaaaaaaaaaaacaacttagctgagcatggtggtacatgcctgtagtcccagtgacttgggaggctgaggcacgagaatcacttgaacctaggaagcagaggttgcagtgagctgagatcatgccactgtactccagcctgggcaatagagcgagacattgtctccaacagaaaaaataataaaaaagagttaagcacatttcttggcacacatagtaagcattcaataaattttagctaataaaagtaatgtttaatgtttggcttttgggggatattaacatattacacattctctggtgaggttcagctttcttaacgtcatgaacctagaaaactgggaaaaattactttcataaggatggtgggatttcatatatacacacacccctatacatgtcacttttgttgttgttgttactgaaatgagggcttctccagtttagaaatgaggcaatgaagagtggaaggattaacataaataatcttaaaaaaattgttggttgattggaaatcaaagacttggagtggggagccataagaggaagatatcttcccgcaatccacattaccattataattaccgaaatataggtccacgtagaagagcctggtaaaattaagagattcaaaggtacgtagtttcgattaagctgctaaatagcttcattcttcaatcgtggttagaacagcttctctcccttctgcttatgctaggatggtataagacaaaaagatctagagctagggttctctatcagtttcctattttgtttgggcttctgctcattggagcactatttatcctgagggcatttgtagttctccctctgggcaaagtctagaaatcttttctgcctcctgaaaatctgttgcttgcatggtaatcttgagaaaatatttctagaagtgaatgaaatggccaggcacttcatttaagcagattatcttctaccttctttgactatggaactcaggcctggataaatattctattaggaaaggtgtgatcacagaagatccagtcagcaggtaagaagtatatgtaatacacatctatcgttatggataaggaacagtaagtgggaataagggagcagaagtttcatggaaagtcttgctgaccaacctcaagaatgaaatatggcattgtaactatatccgcccaaataggatgcccaggcttaaaccgtatttacatgcaaaggcgtcccacagtgcccagtattactgtttctttattcaacgtttggacctcatgtcccttcctcatctttgcttatctgaggtcttttgctttctccctgttcaaaacctgctttccgttcctcttgcgacttcctctgtccaggaagcacagactatcactccattctcacttggaggctcttaccttctctccttccagctaaggggtattcgtgtctttgtttttcttcataggaacttcctgcctggcatgagattgccatggatgcctggtggccaggcttgcctttgagctgtgataatgctgatctcctggagtcctgttagtgcacagcacacttttacgttctctttcatgtttggttggcacaaagtgctctggggtgggcagtaggtacttcattatcctcattttatagtcatgaaactggcttagagaggtgaggctgtggggaagaggtgaagctgtgtcagaatccagaggcttccacagggaaaggagctcttgtgtttctcatccccactaggattccagggagcatgaagctccctgccaaagggctgtgctgttaaaatgaacaaaaaggaaagttgaggtcttactttagagcactgcattagagcagtaaccctacttctacctcactttgctgaccttaaacatgatatttatttggtatcacaattggaactggaaaaactggccccttcagggatctatcactgttggttggtaagtacccacaaaactttctagtgcacctggaaatgctgatggagatttttctcactgatcccaaggacacttattaatggactttgcctacctctcaagcagagccatgatctggaaataagccataaaatgtatgtcatcaggtccctccgaggggactatggtctttgttcttagactgttaggcctttcctcagagctgtttatgcttatttttaaaaaattgtcacagaagcttgacttatgtggtcatacagcaggttacagtggcacagagataacagcatatagtagaccctgagagagaggagggagacaaaaacactgaaaatgaaacacagacctaatttttaaaagaaaggcacacagtcaactgataggaggttaagagtgtgctcagttgttacagcacagtatcaaggatatttggaacaaaaggccttaagttagtgtgaaaatggttaactttaaggagtaaaggaagtgtgtaattcatcttaggaaatttgccgtggaaaatggaggaaaacaaaaacccattttgttagttttgacaaggttattaacggatatcagtcaaaatatgttggagaaatttaaatgagtaatgtagattttatttccattactagatactcagttcaccaaagaagctatctgattggcctgtaaaggggctgtatgaatatgtaaagatacttaacatcggtcatcaggcaaatgcaaattaaaattgcaacgagatacactacgcactgtatgactaaagttaaaaagactgacaatatcaattgttgccaatgttatgaagcaaccggaactttcataccttgctgataggaatgtaaaatgatacattctaaagtgccactttagaaagcactttcatagtttcttatggttatttatacacctaccagatgacctggcaaatctacttgcaggtatttacccaggagaaataaaacacacgccagtaccaagatctgtattgaatggtcataggagctttagtcataatagccaaaagtgggaaatgatctacatacttatcaaatggaaaatggaaaaacaaatcttgccacatccatatagcagaatacgactaaacaataaaaatgaatgagctactgatacatgcaacagcatgaatgaatcccaaaattgttatgctaagtgaaagaagccagcctcaaaaggctgtgtactgtgatcccattaatatcacatttcagaaaaggcaaaactatagggatggagaacagatcaatgaactaggattatggggaggtgatgtgactacaaaggggcatgagagaactttttaggattaattgtggtggttatgtgactgtatacatttgttaaaattcatcaaactgtacatttaagatgggtgaattttaacatagattatacctcaacaagaaaaaacaaaatttggaaattgcattactaaattaataaacaacctatgcattttcttttatttgtccagcctttcaacaaaattttcttgcacgcaaacagtctaccaggcactgtgcttatccctggggatagaaatatgaataaaatgagatccttgccctgatcacttttagttccagacccttttgcattaaaaagattctccaagctaatagaaggttgctagtgattggttttcaggaggagacaattttttttttttttttttggcagttggggaaggaagggtgcattgtttatttgtatctctgaagactctgaaagtcacttcaaatgacagtgatctgttgtaagcgctagtagaataatagattctgtcatcaaagggattggcacagtttatggtaaaaaaaaaaaaaagaaacttataaagatcaactatacaggattcaagtttttaaatttaatacaagctaccttcctttcatactctgcttttccctaaggaaattactggagtgtttgaagcccagaaacttgctgtagtccctagaaacaatgtggtgatgtcagacttgggtgaataaacagtagcacctgttcaagacttcatgagtcttttttctccccctctagtcttttttggcacagcctgaggttagttaatctttaaaagaaggaaaacggaatgagccagaaggtagcttgattctagactatttttagaaggctcctccatgctgctcctgagtgccaggtttttgagagcctggcagggcaagccattgctggatgccctaatgtggccatgaatcagctctaggtcctcgcaggtctctgatggccaccagtcctcccggaagatgctttctgtgctgccctctcttctctgtcattctcctccatctcccaggcatcttttccaacattctgttccactcactccatatcctcaggaaggcgccttccagtttctacggtcacagtgcagaggattgtgtatgtgtgtgtgaacagagaggagagagcgagagagagcaagggcaaacaggcaggctacttgggtgattttcctaaaagccaaatctcacattattcttccagttcttaaaacccttctttccattttaatttgttctaggacaagcaccctggtgtctggtgcacagtcattgtgatcagccccacccactgtccagtgctgtacttgacacttcccacccctcagtcagatacttttgttggtgggaggtggtttaggaggggtgatgataacagtggtgggagagctggtgaagaaacaaggcactggtacttgaagacttgctctcagctcctggaacaggctcctgggttgtccagtgtggttggccagggaaggaaaggaaatgatgattaaaagacaaatacgcagttggagaaaaaaactgcctttggcgggaggcgctccctgtgctgtatctgtcgagtaactgagtgctgagcacgatggggaaagggaaaggttactatctggggccttgctaaaatctttgaaagaccttgtagtaggataggggttgcaaactgatggccagagggccaggcatgtaattctcatgagtgaaatggccagtttgctcagcccaaaggggacagccactcctcattttccaattattgccgtgggaatggggatccagtgttgtaggttttttttttttttttttttctttctttttgagacatctgagtctctgtttcgcccaggttggagtgcagtggtgcgatcttggctcgctgcaacctctgcctccctgcaacctctgcctcccaggttcaagcgattcttctgcctcagcctcctgagtagctgggattacaggtggctgccaccacgtccggctaatttttgtactttttagtagagacggggtttcatcatgttggccaggctggtcttgaactcctaacctcaggtgatctgcccacctcagcctaccaaagtgctgggattataggtgtgaaccactgcgcccggcctgttgtcagatcttagattcttcttcttttttttagaaaagctagactttatgtaaaagttccaaaatattcatatttaaaattaaaaagagacacacacacacactccctcccacccccaacaccaactattaggatcaaacaaaatattttcaagcagaatatagttcgaaggccatcaactggggcctcttccctaagagttgtggctgtaacatcaaagaacatcactgtgcttttggcatttggggcaaaataatttttctttttgtggcactcactgtatatcacagatttctagcatttccaccccctagtcccatccaatattgcttttctgtcgttctgacaaaaatgtccccaaattttcaagtaacttatagggtcagctgaggttttcccagttttagtatagataatacccaagcatctttgtgtttcctttgctgggaataatctccggccaaatataacacttcagttcttggtaaaagctaaatttcacatcattcttttatgtgtctagcctttcttatcctcagtcacccttcctctgatttctgtgggttttgtttgggtgaatgcacctggccttcaggttatagctgaatcaggaggtagttggctggcagaaggattacctggagacagttacacatctcacacctttctctggctatagcagccctgactcaacagcagatattctgtcctgaggttcttcccaggaagtgccgtggtgtgtgaagctggcagcgttccggccattttggaaggttgtcataaatggtggcactgcgagctgaggttgggtgatgcatgctctttaagaaaaggctaattttctggaaagaagtttggctatgcctaaaaatgttcatccatctctgaggaaataatgagaaatatgaaaaggctttatgcacaattatattgtttgtaaaactaattccaatagccaaaaacagtaaacaagttaaatgttccacgtaggaaaatgattaaacaaattttgggctagctatatgatgtaatgataagtggccttttaaaacaaagtttatgaagaatttttaatggtaggggaaataccatataatcaaaagatgataggatgtattactcatatacacacagttagatataggtatgcctatttttataggtgattttccgtcttctctatacttttccaaatagtctacagtaaaaacaaatattgctttttaaaaaaataacttttaattttagattaatttacattaaattaaatacaaaagttgcaaagatagtagtgagttgcagttacctatccagattcccctacacttttattacttttaaaaattagaataagttactttaaaaataatataaaatggggttttctagcatatattatcacgagatagcttttcatagtcatttaggtatattgtaaaagaggcgttcaaagaaaaaaattacattatcaaaaaggcccgtgtgacttagactatatttattaaaaatgctacatttaactgagatctcatgcatttcacacatcctggatggaacactggagcgttagaaaaccctctttaaatcatttgtcctaaagtgatttaaatgaatccattgcttatcataggcttgcttttggatttgatgccaaaatagacttgtatttgagaccaaagaagttattcatctttcctccttgagctatatatttagttattccttctcagacttccttagccatataagtcagttttatatgagtctataatggatatgagttttagatgcagtcatctgaaattgaatttaccaagtagatgctattttaatactttgttttgactgatcaactcgccaaaactggaagctaaaaataatacaccttgtcattttagcaagtcaagccatcacagaaaatattaagaaatgacagcaactggtatttacagggctctctttgccatattcctaattgggaaccctttaggaaagggccagggagtggctgtggatctggggtagaaagtggcctgtttttgaatttatggagtagcgcactgtcagggcccctttcttcactcagaaatgaaaggagctggttcaccagagggtgtgagaactcattaaccacccccagtgcttcccacccagcaagggatcagaacatgtgctgctgtttcagagcatcacaaaatcttgttttcatgtgaggatttcaaaggcttagattgttcaatttgaaaattttgtcacagaagcgaaatgggcacctctataactcgtggtggtgttattttgtgggaggaccatccatgtctttttcccctatattttgaaatgaggtcaaacggacctgttccatccactcacttggcatttactcttctttgggtggggcccctgggagtgttttaattcggggtcgtagggtaagaatagattaacatggcatgacaaattggtttgctacaatcataattcgaaaggtaggtcagggtctgaagggcagagtagtggttctcattggggttgggtttggaggatatagtgggaacagaaggatcatatgtaagattcacccaagaaggtttttggccgctaggttccccatctgcctggttaagaatcccccaacaataaaatgcccctatacctcctccagcttacaaggcagaattcctgtgatgtgtagggcaaaacaaccccctactcttttgttattagtattctgctgctttctaagtaaatgttcttaactaagagaaaaatctatacactctatctctagaaggccagctggagagggagaagaaaagaaaattaagagacaatttggttggctatcattaatctttgtttagccttatgggaaaataagccttccttcttctatctttgttagcaggtagattaagttggttaaagaatactgtagtccatgaaagaaaagacaatggcctttacaaaggtattccaaagcagccgaaaatattttttttctttcagctattttgctgtctaagactcaatgacacttgactgatttggggtcagtatctaataagcgcatttcccagatgaaaaaccagcacagctaggccttctccacagagcctatacctaggtctatcgaaggaagaagatcattcagaattttatttttgcaaaccttcaaatgttaagatctgaataatctatttaggacagtcagaactgcctaatggaagttgcataattgagtagaattaaaaaccgctttccttcaggtcctccctcctttcccccatctgtgacaacctttgacattgcacagattttcaaagtcgtactgtaagattagtgccagggttctttcaaaggaggcttgtaagtgaaaaatctgttttcgcatccctcaaagctggaagccataaagaaaagaaaagaatatgcttttaatgaagtctttgcaggatcagctccttgcaacttcagttgttcatgtgaatcaaaaatagcagaaagtaggtcatattgtaaaaatgaattaggcttcacttcacattttattgactttactaggcttttttcattcacagtggttgattgttagctaatgactggcataaataaaaaggcatttattctcttattttccttattttgccatctacttctttagaatatcagtggggcacactatgtgcttagggatttaattttttcatgtatcattttcacaacaaccctgaaagctggaatttttatgctcattttatatgtgagggaactgaagctcacagagtttaaggtaaatgacccaaggacacacagctcattagaaaagatctgcagtttggacacatttctctatctggaggccctgctgttttcaattacattcttttgatttaaaaatatatatttttgatatatattagtgggaaataattaaactgaagtaatattgccaaatcttaattgcctcatgagacaatgaaaaatacttaccatggtattaaataattttttaaaatgataataacatttatttgagcacttagtagggaccaggcattatgaacgagtataggaaacagcaaatacacaaataagtaatagttaacgtgtcagatagtgaagctactacagagaaaaataaaatagggtgtaaggagtgtgtgtatgtgtgtgtgtgtatatagcaagggattcttgcttcagagaaggcatcaagaatagtatgaaatttgagcagaaatttcataaggaaagtgcaggagcaggtctctcagacatctggatgaagattacagaaataacaagtacaaaggccctgaggtgggtggggttgctgtgtttgaggaagaaggaagtggccatctccacagcgccctccattgtttccttagtgacttcctgccacagccaccagctctgtcatttgaatgcctttgtcctcaaggggcagagagactcccttagagggcatgaggaaaggcaggcagaatccacccccacactggagagggtggggagccagtttcatttacatatttaaatatcttcctcacaagcaataaatctcaaatcattttaattgaacatttaaatccttctcactggtaggtatttcaggcattcggctttatgccaattattgcgtcatcttaaaagagaagcttttaaatttattaaacccattacacttgaatatttgattcctgccaaaacataatttaaaatcctcactttaaaataatttggtaaggattagtaaacctaccacaataacctaaactgtgtgtctgcagaaatatcacccagtctctggataggggcaaactggtcctttgaaagggacttttcatggtagccccacgcaggcgaatctgcagtgtcccagtcatctgggctgctgcaacaaaaatatcatgaactgggtggtttgaataacaaacccttacttgccacaggtctggagcctggtgagtccaagatcaagcctccagcagattcagtgtctggtaagggtctgcctcctggttcatagatgatccgattcatagtcttctcactgtgtcctcacaagggtaatggcttctctgggacctattttataagtgcactaatcctatgagggcagagcctttgtgacctaatcatctcccaaaggccgcatctcctaataccaacaggttgggaattaggatttcaatgtaagaattttggggtgcagacacagacatttagtttataacatgcagtttgtctaagaagtggcctggcctgagtcttggagattctgattcagtaggtctgaaatagggttcagggttctttttccaaacaagtgatttttttttttttttttttttttttttttttatgagccaggtttgggagccacagatctggtataaagttgatattggctctatgtaatatagaacaatggagtggagcaacagtttggtctggctaagatgatgaaggggcacccgttacaccttcctttatgcagctatattagttgaggaaggctaggctatgctgcggtaacacattacacacccccctttgctcccaccccgcccaccaaaactcagtggtttaatattttgtggtctgtggctttctcctgcagactccagagctactgttctggatgagcagctttcctccaggcaatgccacgggcatcctggtaacttttgtccagtcacactgtgtcccctagggcctcctcagagttgcctccagagtcagctgaagagagagcgtatccatctttgtggggtgttttagcggccaggcatagcactgtccagccctccagcccataggctattgggtagaaccagtcccttggtccctcctagacatgaggggaccgggaaaggtagctctcctgtgtgctcaggaggcaagagaaatagttggtgaacacccacatggcattggctctacaattgtaacccatagtgcactgcctgatgcaattttttgcaggtcaccagtgtttttccacttgagtctgcctgatactacaagccacttcatactcaggatcatttacctctctgcaaccctggttcagcttagcatgaggaagaaccagtttggttgaactaagtcacactgaggtataattgcataacagaccccctaattgtcccagaaatcatttttatcttaaagtaggagtctcatcccagggatagcttagcttttgtcttttctttaccatagattctctaaaaatttaacagttttacaatgcttcttgcattattggcagcaggggttttcaggggcagagtagggtaggcatcctgtaggagtagatgattctaagtatggtgcttgtgagttggggactttctggacagtctaaaaatataagcagactaggtatgaatcctaagaagagcaccctcaagggcagaggtagtttgctcctatggtagcacaaatcctaaatactcaatgtgaacaaataaattaaacaatattattacctataattgcacagactggtgtttctcaaaggatgatttccagactagaagcatttgcattatctggaattttttttttaagtgaattgttaggctgtatcccagacctacagatttagaaattctggtgcagcaatctatgtttcaggacaaactgttagatttaaattttagataaaactttgcagcccaccaggtgattctgatgcataccaatgtttgagaatcactgggatagattttacctgctgattatcattttatcaaaatctaagtaattagggaacctcagtgggagtttttttctttttttttcttgtgggagaaggaaatgcacataagcctttcaggacacttgttatatacgcttctgtcgttttaggttaaatggctgctgcttttgtgtgtctgtctataatactctgtaacgagaatcagtatcttgaaagataaaggcaattcaaagattaacaattatttttgtatatactacataataaagccaaagaaatacactaacaaattttaaaaacatttaaaaccaatggttgattcaatgcctttgtagttttcctcttggttttactgatcacttttggtaactttcctctttttctattcaaggttctgggtggggtaatttttaggggcttgaaatatataatcttgatattggaaacatttccaattctcctcttccctgccacataacatgctgtcttagtgaacacttctaaacaaatttgaacccacgaagacccaagggcatcattatggacctcagttgttatgaattctggatagagcagatgaggctcgagaagagtgggcacaattctgcaagggctctgggacttgttttctgacaaaagtccctgatgtcagcaaagtttgtctctttttcattcaagaggtagaagcaggttcccccgagtactatgtacctcctagcccttgtgcaaacatcaattaatgaatcaaatccccaaataaaccctttccagagtggtcctctggcatatcagaaaactgttatcggctccccgaaattcttgatagtttactgaccttggctgtttgtactggccacaattaaagttgccagataaaatacaacaccctcaatgaaatttaaatttcagataaacaataacatttaaggataagtgtgttccataactaaaagtatgtaatattttattaagttgaatttagaattaagaatgaacatttgaatttcagataacagataattatactcattataagtatgttccatattacataatagttacaggacatactaactttatctaaaatttaattgtgtttcctgaagttttacttgttaattagttcttattagccacaactcatgtgactatggcaaagggatatttggaggctactcagatgtccagagcttcttaatccctagacgtagccactagtcagcaaaggcattttgcctttggtctctgtttataaaaccatcattactttataattgccactccacttttggatgtcctctcctttctcctctgttggtgtttgtcttcctggtctctgtcctgtttgcagagagaaaggctttcctgttagaaacagcaccagccaatctgagttcttctcttttgttttatttatttatttatttatttattttgagacagtctggctctgttgcccaggctgaagtgcagtggcgccatctcagctcattgcaagctccgcctcctggattcacgccattctcctgcctcagcctcccgagtagctgggactacaggcacccgccagcatacccagctaattgtttgtattttttttagtagagacggggtttcaccatgttagccaggatggtctcgatctcctgacctcgtgatccgcccgccttggcctctcaaagtgctgggattacaggcgtgagccaccgcgcccggccctgagttcttctctttaacaaactggtctctttctgacgactacgtaaatctttccttttggagctagatgatatttggatatgtgtgggtaaaaaacaacaacaataacaacaaaactgacattttcgaaagcttagctacctgcagtcctcttctatggttttttgtatttggtgaataatagaacctttttagttctcagagttctttgtgtaggtaagggtggcccatctaattaccaacaattagatgaacaagaacacctgaccctcgccagctcaggttctaatgagaaaccagtgcagatagtgtcagatacaacagggctcactcagccatttgtatgaaaataacagaaacctagtagcagccatgtaaagtcattttgttctttctgtcctagattccagttgctgcttctctctagagaccttttatgcttgtttagttctctatgaagtcaacaggaacatcggataccaaggaagcctgtaagagtgagagactctgacccaatttaaatgtcctcacagagttcagttactcaaaagaattcaagccttaaaagcacagagccttgaagttactagagctttacccaaatgctccataggttcctggattgcagaatattgctgaaatcttggttttgcccttcctccctcctctctttcacattttatttgggtgacgttctgcttgggaatgaccagctgtcactgccagtagctactgggattacattgcagcatgggcagggtgttttcgttttgttttttaaaatgccaatggatatttactggagctactgtagggattggcagtttcatttctgttttctgtggaggggttttgggtataatagttggattagaaacactaagaaaatcaaatttaaactctcaatctattgatggtaccaagcactaaccatttgacattaactggaaggagataccatcttaatcagaggctaaaatgctccctttgctctagatcatagcttatgaagagcagagtttgaagacagagacagtcaggtggtgtcagtttctgtcattctcacttggattcctgtgcagtatcttcacactgtttatttttaaagaattttcaatctgatgatactgaaattacttcagatcttctctaatctcatccacccttcagactgtgtttagttcccctgatatgtactttcataggttcgcgaaattgtaatgaacatattggggtgggagttctggagggcagagatgatgtccattttcttgaccccgaaattgtcagtgcccaacactgacctcggacacagtaggtgctcaccagatagatgaatgaattagattctagggcaacgtaatccatgcggtgtaatccacaaatcactcttatggcaatacattacaagtaatttttaagcctgatagagttttctgaaggtctaggaggggcatacgtaagttacctatgtgttgggttatgtgaagggaccattttctactcctgccccccagcatacttctgtcatctttacccactgagtgtcaacatggaatatgaagaaagactttgcaagtaagatgttaggaaaataaatttcatgtgctaaaacagatattggcaaacatttttgataagggcctagagagtagatatttcaatctttctagaaatacggtctttgtcacaactaatcaactaccgctcttgtagcacaaaagctgccacagacaatacacaaaggaatgagaatggctgtgttccaattaaacttcatttatggacaccaaaatgtaaatttcatacaactttcccatatcatgaaattctgttcttttaaaacgttttctccccaaacacttaccagtgtaaaaaaattcttaactcactggctatacaaaagcaggtagtggatctgatttgaaccacttggcagagtttcacaaccttgcacttaaaaaaaaaaaaaaaaagaaaagaaaacaacaataataacaacaacaaaaaaaacactaataacaaagccaaagctttggtgaggaaagggggcactttcattttatcagccttatagctttcctgagcactgaaatgagggacatagagccttttcttagtggcttatttttacaccattttgtgtttttctgtatgtttgcctacctgcatatgtgcgtatatggtagaagtagaccaagttttcaagttacgtgtgacatattttcatagcaatttggaatgatcaaaggaaattgtagaaaatacagtatggtcccagttatttttttaaagaaaacacattatactacaaaaatgatgtactttatatatgcttgtaaaaggttctgaaaggtatttactaaatgttaacagtggttacctgtgaaaattgggagtgtcatttttgaagcaggggagatattgatctttttctgacttatttgacaattttaaatgagaatgattcttgctcagataatttcactatttgtgaaattaaaattaattagtaatgtattgaactaaaaaaaagatatttattgaaagaaaacactgagcctgcttctgtgaatctacaaaaaatctgtgattttaatgacattgtaattttttcatattgacccttagtgaaatacagcttttggaaaatcccttctctatgagagcattgctaaataaggaagtgtttaggttttgtaggagtaaaaatagcttctccagggatgttgatatttaaaataatgcaaatgtacaataaaatcccacaatctaaactctggattcagcccatatacccagagttttagaatacatttctgactaaaacacaaaagaccttgaaagcaggtgctgtctttgtcccctgataccaatgtgttttaataaggttccaccagattttcaaagtctttggttaaattggaactgacatttatgctaattagctgggtttgggagtgaaacaggtaaaattgaattacaatgggctccaaactatatttatttttaaaatagtggctctgagggatatttggttctatttgtcagttatttcatatctcgctactttctatcattcccttcccgcctggtgtgttaatctggtaatctgaaatctttttgtctgcctgtaacataataggctgttttcctgtagtccatctgtctcctacacgaggtgaaagtacttttcagaaatggcttgggttgatattattaatctttataagcagagaattccttgaataatttaacagccaaatggcatgagggggacttggtataaaaatgaattttcctgtcagctttaaaaattacagcgtggcctgccttttatctgtgcaactcaaatatcaaaacaatggatgtttatgctctttatacagttttctgttttgcattacctaagacctaagacgatgaagaaacatttagacaattttggtttacttttttttttctgctagaaaaccgcaataagttaattagccaaaagaaagtccttcttgttctctgaaacaacagatgctgcctttgaccttggaatttaagggaaaatctatttttgattacatgtcttgaatttcttggatttgccagtgttagggcagcagttgtgattgagtgcttttgaaagtatatgcatgattttcaaagaaatcagtctgcacagctgttgctaaagaaatcgttgttctccgtccttccagttcattactatataaggttttaaaaattattttttccccctacttttaattggagttatcctagttacagatgtcacagcctctgagctactggtcttccacccgacaccctgcttcgttgcaaaggcctaaggttggagtatgctgcatttgattggcagggtaacattgttcctctatgctgggatggggaaatacagccagtcctgtgtttaggcaagccagcaggagtgggactattaatagccaactatgtgttttctctcagacacagcctctttacagtgctctttgcttgcctatcttttggaaagtcatgtgaatgcagcaaaagctttctaagaaatatgagggccaaatggcattactctgcgtgaagtatgcccacatgggattattagtattttgttagaagaccatttagcaagtttgtttgtttctgaatcaaaatccatagatgctcattgaacattttttgtttttttccataaatcatgtatttgagaaagacatcttgatgatgggaaactcttaccttggagaaacaaagaatcaagtagtgactttatcctctagatagtactgaaatcagaagtactttttccctttaagtgtcataaaacacaattacatttctttccacatattttcaacctgagcaaattgacagaccaggtcagcttttttcctgggtcattttcctgtgtattttctttttatcttctggatgtaatcttttatttgtagaccattttagtgaagcccctagtaacaatttatttaattttattagtcaatttataggcagagggcaagacacattagaatatcatcatgggtactaaattagaaaatttaaatcaaaatgtctatgttctttgagctatgcctgctaattaaagaagaggtaaactgctgaaatataataggccaacgtggaagggtccagaagaaccatggaggaccccctttcctctggcttgatcaattataagagagcaaatggaagaggctatacaactttctccagaaatgggttattttgcaggcatgagcagtcaggtgcatattgaatagccacagattaaactctcctctcctacgctttcggggtcatccttcaagatgcttttagctaacctccaagattgggtgagggctgatgctctaaatttcagtgtttagagactgacccttcctgtaaggaggtacttaagacatcctgtcttctcagatgaatgcttctggaaggcaacattggaatatctattagaatgatttgatatacaacaaggttatgaccttttggagaatacctcagtctcttcagggcattttccttcttaatttctggtaccttaaaaaggtctcgttccttttggttgaatgccttgagaaacgtaaggctataaaggaattttaacaaacttgattctctaatcaactgctcataaatccattttattgcttcaattatgcaaaataaatgtttaaaatttgtctgtcgggtcagccagttacccggtcaactaacctcctagccaacctgctaacctcaatgaatatgttgctctgaaactctttttttttcccccaaatcttcccaaagctattaaaaaataccaaggaaggatggttaaggcatgttttattagccgtagtagttaaacttgttaatttatcagtaaggggaaaaacactctttgtaattttaacttgtcttcatgctaaattccttccagactgtggttagaacttaactgcagaatttttgcccaacaatataaacattttctataaaactatggaaagttgcccattctggaaaaaatctaaagtacaaaggataaagcgtttctcaagatagaatttcatttctggtgtttttgcatgtaattttaaattttattttatattttattttgagacagagtcttcctctgtcacccaggctagagtacagtagcaggatcaaagctcacggcagcttcgaaatcccgggctccagaaatcttcccattttagcgtcccaagtaaataggactataggtgcaatcatctttcccagctacattttttttatttatgtattttaagttttatgtagacagggtcttgctattttgaccaggctggttttgaactcctggcctcaagtgatcctcccaccttagcctctcaaagcactgggattacaggtatgagccaccatgctggccggcatgtaatttttaatactaagtctaggataaattttcttttgcactcattgggatatgtgttgatacattgttaatctttggaatcccactggaatgaaatgtgtttcattagtgcttaaactaagatgtgttaatttgagagtttataaaaggaggtttaagcctagtgcattttcaaagttgctttttttcaattaaaaaaattttgatatcttggcaaaaggataaaatcgatagaccatgtaaagaactgcattcagttttaaaataattaggttttgaagatttattctactgtcttttatgagtaagaacatgtctaggggttttaggaggataggtttaaacaggtttacaatatttccttataagagctagattatgtatacaataagaattaacttaagaaattttgctttgaatttctccaagattttctagggccaaccaagcttattctctttaaacagaaatttaagaccattagtaaataaaaaccttaatatgttttggaaaatgattacttggactcagtatttttttgtggtgtatatgctttggcttgtgtttaaattatgttacgcctgtgttttgatcaggcattaaataattgaaacactcatgttaaataattatgcaactgtctgatttagaaggctggaaagcagcagcaaacctgtttccagagacatttcaatctataggccaggttcaggctaaactatatagtatgactctccttctttctacactgaggtatagaagcagcatagggttggggtggagacagacctagtacaaatctaagcctcttgtttatgagctatttaacttcatgtaagttatttgagccccctgagctttaagaattagatgctttctaaatgtcaagcactatagtagtaataagcacacacgtttcctttccttaggatggttactgtcccatgggaaaggtagacacatgggcacaatttcaatatattctcaagttccaagaagcatactcaaagtgccatggaataggaacacgctgcctagcagctcactccttttgggcacacatttgtctgatacaactacgtgctaggacctggataccaatgtgaacagaaaaacacaatcctaacccctctattgtcttataacctaaataacaaagtgatgactgtaaactagaaagtctggggcctaacttatagggttcgtaagggtgaaaagagctttctttccctttcttgtcatcttcattctgttcactcacgctctgtccagattcccagtctcccatttgcctaagcgggcaaagaggtagttgtttctcttggttaacagttctatataatgaatccctttacagatgagtgactgaatacttcttcctaagaatagttgcattattaccgaagacttttggtggcaccaagaccatagtacatgtctctccatttggcagcatttcagccattgagcagtcctccatggatagctggagtgtctctcccacatcccactatcatggtgcttggctgctatccagatgcctgtgatgagtgatggagtccctggtgcttcctggagagaacaacaaatggtagtcttgcaccaccttgattgttaatatacttggtctgtggacttcccatgctcaaacctaaaccaaagaacctggcctgacccggaacaactgctttgttacaggtgaaagtccttgttattactttggtagttaatcatcttcccctgggccttaaactccaggtcattctctggagaagaaatttaggacctgtgatattatcctatttaagtacttttcagatacgatcttttaattataaaagatatataattatatattttatatgatatatatcatataattatatattttatatgatatatatcatataattatatattttatatgatatatatcatataattatatattttatatgatatatatcatataattgtgtaattataaaatgtaatcgcttgtatatagttcttagttccttaggcaaatcaagtaaatagtagttgcatgggtaaatataaaatacgcaaatactccttatagtaatataagaactatcattcaggcaggaggacacaaaagatcaatgtatgaaccattcctatatattttttccttttgaagcacaggtaggagcaaatcatttcccttctccacaaagctcagtggcttcttactgcactcagaatagcctagtttataggcctctgtgagctgcctttcttccccttttcatccaaagtgtttttaaatccctttagatactctttgctccagcttgcctgggctattaactgttctcccgaagaccatactttatgtctgcaggcctttgctcatactgtttggtcagcagggaataaattttactccttattcatttataaaatcctaccgatcctccaaggctgagctcaaatgcctcctctttcatgaaaccttctatatccctactaatcagaatcaattatttctttctctctattcctccttgttggcctattgtgtgtacctttattgcctgtataggcttttctcatttctgcttgtatctaggtaattcactcatctatccatacattcattcaacgattatttcttgaaagctttatcttgtactgtgcaagaagatgggaatgtaatgggaagcagaaaatggatgctgcctgtgctctgggagcttacagtcttctggcagagatgggtgataaggtgataagcaccaaacccacaaagctaaaactgcagctatgggaagagcggggaagacagatttatgggtctctgtctctaggctgtaaactccttgacgccagtgagagcctctttcttggttaagaaggcagtagtataaaacaactgtgaaatgccctgtgtcatgagtttgtatctccccgaatatatgaggaagtcctaatacccagtacctgtgaatatgactttatttggaaatagggtctctgcagatgtaatgaagttaagatgggatcatacttgattagagtaggtcctaatccagtttgactggtgttcaataagaagaggagaaaagacagacacagacacagtggggaatgccacgtgaagatgggagcagagatgggagggatgagtttgtaagccagggaatgtcaagaaatgttggtaaccacaagaagttaggaaggaggcatggaactgtttcttcttcagaacttccagaaagaaccaactcccaatgacaccttgacacctggatttcagactcctcacttccagaactgtgagagaatgcatttctgttattttaggccgcccagtttgtggtagtttattatggcagctccgggcaactaatacacccttctggagagaagttcatgagaactaatttaatgcacaacaccatggtgcactaatgtgtgggtcaatgattgaatttggatgaaagaatgaatagagtattgtgtttgctctcttcagtggtaagagatcagggtgagttcaggatatttgttccatttcagttgtctattaacaggaaaaaatgtggattcacagttcacgtcatcatcagttgagaaggctggctgaataatggcccgtgtggttgtctttagaaataaagctgtgtttttgtcactgtggccaagggggatataaataagctagtcactaaatgttaaaatggtggcaactcttccctttctgctttcaaagcagaatcttagtcctcacatctcctacccctgcttcctcaggcaattcgtgtttttccctctggttgaaaggctcacttcaggataaagcaggagggggggtttgtggttgttgttactaatgacttttagatcttgtgttgcattttatattttcagaacattttacagttgttgattgagttccctagcactcaggaatttgtgatattaaaatgctttttgtttgcaaaggacaaagatgttcagtgatacttgaaagctacactaatcagatattcatgagtatggggtgcggcctgacctcccttctgcctcctgaatccttctcctcactctagattcaggacagtgccacctctataaatgatcccctcaagcctcataactctctatcgttttattgtgttttattatttatttatttattgtttgtgtgggttttccctagtagattatgaggttttggaggacaggtaaccacactcacccagcaggcatgcaggaactatctcttgaatgaacaagcgaattaatgagtgaatgaaattactagaactgacttaggccaggaatttctcatcttttagcagctacttcccattttatacatccaagatcatatccgtgaaaccacagtgagtctttagacaaattacagagaggcagaaatgggatggcaacatcaacttggagaacctctggatcagccataggctctacatggatcttctggtctcgctgtcatggaggattgagtcatattttcaaggctgtcctcttgagaccactgctcagaggtgccagtcaaaggtctcagggtcataggcagagggggaaggccagataggccactgtggctctgagtatagagggataaggctaaagtagaggttctcataatccagaaatcgtctctgatgctggaagtcttcagctgcactaagagatgtggttgtaaagggactccagcaacagaaagcatagccatcctcacctcttgagaatgagctttgttttgcttatgttattttacttttcatctatatatctgcgtgcttatgaacatcctgtaatatggcaccaagtattaaacatttatggagcaactgaaatattcaggatagaatgtttaaattagcgctggtctctgccttccttcctgcctgtgtgtttctctgttttgtaccctagcccattccggcaacgactatagagcatcacacttatcagatgatgtcataccgtgcccggatgaaagctagttctcaaggcactcagatcatggcacaaaacaaagaggaaagatgtgtctttaagtcattcatttagcactataactgcattttcagagggaacttctatccatgtttattctcaagattgaaggactcagtgcagctctcgtggtgacagattggctcttcttgtgtgttttttctcttgctgtttagacgtaaggaccccttttctcccacctcaacatggctacatgtttgttatttcatgataatttttaaaaaaatcataagtgaaccttcacactgttagaattatttaattgtaagtgaatatcttattagaattatttttacctgcaagactactcttttatgtaacaactgtctaatgacaaaagtggtaattatatactttgctacctacaaatgataggaaaacagagtaagctatttctggggccctctctgccactcattctgtgaggcctccatcacatcacctgacccctcacatccacagctttcctaatctttaacatgaacaggttgaagttgaggatccctaatttcccttccagatccactgttctgtgattctaggtatgtgtaacccagctatttaaaaaaaaagaaagaaagaaagaaagaaagaaagaaagctaaatgttggtagagagtatcacaaaaaaataacaaagatacactttaaaaaattggtcaagctgcaatccttagaggcaatattcctggttttgagtttataaactacctgctggtaaaatctcttcagtagtttctacacatttgcattcttccttcgttttcaaaacactgtctcggtgactgcaaagtgattcccctgatgtataatctcttattcggcgtagcaccctgggaggatgcgagatccacgtggagaagttaagcacacacagatctgcaaggtcagaagtacattaaatggcacgctgtggtccaagactttcatctttaagcatcagtaattgccatgaatactcaaggaggtgccctgtgtgagagctgctggatttgagccataagccatagttcaggaatatgaatcttgtgaaagccaaagtagtaatattgtcagagacacacaggtaaggccatgaatgaataaactggacatcgtgacattccagctgaaaaaagagcaatttattaagtttcagcaccatagatgaaggaaactggtaaatttactggatgtattttaggaacttaaaaattgatgatgaaacaggaaagagaccccagctaaaagaaaacttctggcacaaacaattcaaagcacccagttaaatagatcttctgacccattggatacccaccaagaacaaggcaatttgggcacatccaaagtggtttgtgtgggtagtcgttaaaacctgagtattacttcaattatctgagacctaacggagggcagttattctaaatagtcaggctaccaccctctagatgcaactgttttttttaagtttgaaaacggaaatatttaaaataatatactacatatagttacatagaactattttcatataaaaataatatttttctgataattttggaagaattagaaaaacacagagctcgcaaatggatcatctcactatccagagataacttttattaatcttttgatgtatttccttccagtccccccatattttaaacttattatatattcatttgtggacatatttttaaaatcagatatgccagtctagcccttttttttttttttttttttttttttttaatctggagctgccgttagggacagctgaggaagtgcagagcaatgccacaaaatgtctcccctccctttttttctccacagcccagatggctaagatttgtggtgggtgggcaggcgcacccgcccccaacccccgaagtcacatgtactcttggtggctttggcacttcctgaccttgcgtgtatgtttgctgctggaatccttcacactcttgccaatgcggctataaaaatctaggtggctgagtttttgcttatctgaattacaggaaagttgatgatgaaagagggaaatattaatgatgggttttgttctctaaattcctttgtaaagaaaggatgtgatttgttctattcttccactcacataacttgttaaaataatgggaaagccaggaaaaaagtgtttggagaatgatggtgaatacttttgggttagttgggctcaggtgacatgcttgttttctgggggaaggttctcaatactaagagattacttccaggtggcaacccaatgtagaaaaatcagcgtgtgctctggaatcagacaaacccagatctgaattctggtttttcttccctcttttgtgtcatcttaagcaagttacttagtttccgtgagcatcagtttcttcatctatgtactacaagtgatggatgcatacttctcaaatgtttagggagcttaaatggaaatatacttggagttcctagcacacagtaggtgcttactcgtgagcttgttccttctgcatttcccagctgtttctggaaagtgtgctgtcatcagcaagtgagtgaataataattgtatgctaatatttacccacacaaatacttcgcgcaaaactattcgtataatgttaatcagtgaaaaaggttctcatcatgtattatgagttgaattttctttcccgtctattaacaaactttgaatgggaaagctactgaattgaattttttttctctctctctctctgctatactgtggggacatgcttttatatttgcaaataaagctcacatatatctttttattacattctcaccatcccaccagaattttaatgagtaggagcggtgagtggagattgagattcaggggccacttgtgtttgagctgacaagatatacacatttggggaaacagaacatgatctgaattaactgggaagcacatgtttcataagtgcttgatatattcctgaaagaaaattaaaaagtaaatatttttgcttgttgcagccattctaaagagtgtgctatcagctttctttttgtttgtttgtttgttttttaactctgcttatcaacatgtaaggtgagggactagtagactttgtattataatgcttgaaaagaaaagctttatttaaatatcaaatatgaacatgtaacaagagattgcttaacaactgtgtagaataggaaaaagaattggaaaattttcatacaaaaagtaaaagaaattgaggggagggaaacaaatgaatccaaactcttattttcttttctctgttaactttcaggaaggccaaaatgagatttaatgtactgtatgaagtatcttgtagctttgctgttttgttcatttgcttacccttttatctctcttaaattttaatttctaaatctatagccctacattcattaattgatttggttatcaaacatcttttctgtgctagttttaggagaaagaaaaatttcccctaaaattgtaaattttgatttacaattgtgactgtaaatctcataatcttggtgggttgcaatcctgtaaacaaaaatgatggctcagcagctctataagaggctgcattagattcagtatgagcccagtcccactgtttgtggagggagaagatgcagtccagacaagtccatagcttcaactgtgagtcatatagtttgccaggcagagagctatgggaggtattaccaaagaggcagtagcatgtgtcttttatcatggatcatttcaattttttaaaaaagtaggtatgttataaataataatgaaaaatgagtaaagaagtaaaggtggtaactaacatgggaagaagttaagtaataggtaaggaagtgtgtgattaagagctccagtgagtggctgtgatgatgggatttcagaaaaaggatttctttgcaaaagcagagaggaagaatagcagatggtgaatgagataaagtttttctccccaagaggacaactaggaagcaaaaatccagagaaaggaaaagtctgggctactggtgaaagctggacttcaagaaaaatagtttaaggatgtttaagttttttagtttttagacacccagctgcttgtgtgacaccacattgcaaagttattatttagtaatattttgaatgaaaggtctctcttcataaaacccccaccctttacaaactattagtctcagaaaccctttacattcttaaaagttactgaggacttcaagaagcttttgtttatgttagttatatctaccaatgtttattgtaagatcagtaattgggagtttattaaatataatgaagcatttttttaaactttgattttggttcaggggtgcacgtgcaagtttgttctacagataaattgcatgcttcaggggtttggtgtacatattatttgttcacccagatggtaagcatagtacatgatagatagttgtttgatcctcaccctcctcccatcctccactttccagtaggccctgttgtctgttgttcccttctttgtgtccaggtgtactcaatgtttagctctcacttattaagtgagaatatacagtatttggctgtcttttcctgtgttattttacttgggatgatgacctccagctccatccatgttgctgcaaaagacatggtctcattctttctcatggatgcatagtattccatggtgtatatgtaccacattttttttttccagtctaccaatgatgggcatttaggttgattccatgtttctgttactgtgaatagtgctacagtgatcataacatgtgcatgtgtctttatggtagaatgatttatattcctttgggtatatatgctgtaatgggattgctggttcaaaatggtagttctgtttttaagtgctttgagaaatcaccgaactgctttccatagtggcaaaatgaatttacatttccaccagcagtgtataagcattcccttttctttacagccttgtcagcatctgttgttttttgactttttaataaccattctaactggtgtgagatggtatttcattgtggttttggtttgcatttctctaatgattagtgatgttgagcattttttcatatgcttgttggatgcatgtatgtcttcttttgaaaagtgttcatgtcctttgcccacttttaagtggtggtgtttgttttttgcttgttcaattaagctccctatggagtctggatattaggcctttgtgagatgcatagtttgcaaatattttgtcccattccataagttgtttgctttcttgaaagtttcttctgctgtgcagaagctctttgatttaattaggtcctatttgttaatttttggttttgtttgaattgcttttggcatctttgtcataaaatctttgccagggcctatgtctagaatggtatttcctgggttttcttcaaggatttttatagttttaagttttacattgaaatttttgatgcatttttgagttgatttttgtgtgtggtgtaaggaaggggtgcaggatggctaaccagttatctcagcaccatttattgtatagggaatcctttccccattgcttgtttttgtcagcttcgtcaaagatcaggtggttgtaggcgtgtgtctttatttctgggttctctgttctgtttcattcatctatatgtctgtttttgtactagtaccatgctgttttggttactatagcactgtagtatagtttgaagtctggtaatgtgatgcttcttgcttgcttctttttcctaggattgttttcactactcaggctcttttttggttccatatgaattttataatagttttttctaattctgtgaataatgtcattggtagttcaatagaaatagcatttaatctgtaaattgcttgggataggatggccaatttaacaatatcgattcttccagtgatagatttttcaagtacaagaatatataaacatttcattagctgcagagtgataacgtcatctcgtggcacatagcctctggaaaatttcactgtacaattgtgaagaatgagaatgaaaaagtcttataacattatagtattattataaagatgtcttgacctcatggacccctgaaagggtctcagagatcctcagaggtccccaaaccactttgagaaccatcccagaccattgacaggagatgtttatactcaagatttgggatgattgtgctgattctttcatttagtcaactgtcagttctttttccaggataaataggcttatacgcagttttgaaaatgaaggctgaatttcacaaatcacttgtggtctggaattggtactactagtggtaaaaaagtaagaaaactcaaaacaacaaagaacgaaattcaatagtttctaatctttcagtaactattttgcacagattaggttagacttctgagtcaaatgaatgaagagaatgcatattaatcatatatcacaaggaacttcttgaccccttagagtaagtgaacatggaatgtgtgtgcagtttctaaacatggaaatatgtaagaagaggccttcccttgaagtcctggttgacatggatgaggctggatgcagggtttctatttgatgatcctgagcctggcatgactttcagcttttgagattctgcccagagtggtagcacagaatggcaatttttgccaccaccagcctgtttttactactctctcacctcaccaccacccataaaatttaatagaaaagaaataaatagaaaataggttttggaaacgtatgtgaaggacgatttggtattagggctgagtgtttttagactagctacctttttactatcaacctctggccgtggccatgaatttctcggtctaaatcttttttctgaagatgcacagtagacaagcctccctaaaacatgaagcatgctgttgactttgttcccggggcttgtgtctgccaagtctgactagtcagttcccatcgctgctggctgaggtttttcccatcaccacggcagcagaacacacttgccttctctctttagatggtttgttattttaagaaaagccgagcatggaatcgctgggaatcattgctgcttctgaccacagagaacacgttttccctactggttgtttttcttttcagcttcctggggctttagtggtatttacatttaggccctgtcattttgctttttcatgaaagcccatttgaatgaggcacttggaatccaaatataattttgttgttgttgttcaaaaggaatccaaacgtttaagagtctcaccattggtcactgaaatggaaagattaaaaaatttcatttgcttagtttttcttctttaaatttggtaaaagtcattttgcatgccctgagaagcgcagctggcatctataacctgccttcctactttataaaatgtaattttgtactccccactttcagatctgtgatgcaaagttggtgaaagagtcccgaatgaatatccatatgaaatattttctttttctttaatttaaattttaacttttactttagcttcaggggtacacgtgcaggtttgttacataggtaaactcatggtttgggggtttgtgtacagattgtttaatgacttgagtaactgagcatagtacctgacagattttttttctgaacttctccctcctcctaacctcctccctcaagtaggccctaatgtgtgttgttcccctctttccatctatgtgttctcattatttagctcccacttataagtgagaacatgtggtattttgtttcctgttcctgtgttagtttcctaaggaaatggcctccggttccatccacgttcctgccaaggacatgatctagttcttttttatggcttcatagtattccatggtatatatgtactacattttatttatccactctgtcattgatgggcaattagtgatttcatgtctttgctattgtgaatactgctgcagtgaacatatgcatgcatgtgtctttatggtagaataatttatattcatttggatatatacccagtagtgggattgctgggtcgaaatggtagttctgttttaggttcttcgagtaatctccacattgctttccacaatggctgaactaatttacattcacaccagcagtgtataagcgttgccttttccatgcaacctcaccagcatctgttaattttttactttttaacagtagccattctgactggtgtgtgattgtatctcattgtagttttgatttgcatttctctaattgttagtgatattgagcgttttttcatatatttgctggccacatgtatatcttcttttgaaaagtgtcttttcatgtcctttgcccactttttaatgggattgtttgtgttttgcttgtacatttgtttaagttccttgtggattctggatattagacttcgttagatgtatagttcagaaatattttctcccatcctgtaggttttctgttcactctgctgatagtttcttttgctatgcagaagctctttaatttaattaggtcccatttgtcaagttttgcttttgttgcaattgcttttggcccagatgaaatattttctttaatgggaaaagagtgtttcaggtcctcaaatgttcctgcactcattgtagccttttcctcagtggtctggttgaagaaaatgaaagaaacaaataatatgtgctatgtactggccgcattaaagtcaggttatgctttagctctctaagtgactagtgctgttaatctagtgtttattagcactgttttcaggcacccttctcacttaaagcttgtctgtggccccattttctttactttttcctttttttttttccctgtggcagagattttcaatttcttttttttttttttttaattatactttaagttttagggtacatgtacacaacgtgcaggtttgttacatatgtatccatgtgccatgttggtgtgctgcacccattaacttgtcgtttagcattaggtatatctcccaatgctatccttccccactccccccaccccacaacggtccccggtgtgtgatgttccccttcctgtgtccatgtgttctcattgttcaattcccacctgagtgagaacatgtggtgtttggttttttgtccttgtgatagtttgctgagaatgatggtttccagcttcatccatgtccctacaaaggacatgaactcatcattttttatggctgcatagtattccatggtgtatatgtgccacattttcttaatccagtctatcatggttggacatttgggttggttccaagtctttgctattgtgaatagtgccgcaataaacatacgtatgcatgtgtctttaaagcagcatgatttataatcctttgggtatatacccagtaatggggtggctgggtcaaatggtatttctagttctagatccctgaggaatcgccacactgacttccacaatggttgaactagtttacagtcccaccaacagtgtaaaagtgttcctatttctccacatcctctccaggacctgttgtttcctgactttttaatgatcgccattctaactggtgtgagatggtatctcattgtggttttgatttgcatttctctgatggaatggccccattttcccccatcaccatggctcctcctctgctttccttgtggggctttcacattcttggcacctgctgacctagcagcaggcatttttctgccacttgtcaactctcatctgactgtggccaccttgtttccctgcagacatccatatgtactcttctggtctctctttttacataattcctctcacctctgttccttcacatattcctcccacccccacctcctctcatggttcaactcaggtcacccttcctcccccgggccttcttcagtggaagtgaatccatgttggctgtcttgttcttcagcgcctctgcacatatccagtctacactctataaaggttccttgcctcggactatctcacctgactcacagtcataatataggtcctggtgttgccttcctctgaggataggaccataggctagcaatgatatttttcttaacaccaccagaaaacaggtggagtcagggggctatgtatagagtgtttactcatacctagtagcttttgaagagttgatcctagaagaatagtgaaatatacatgtttgacagattggagatgcaaaggaaaaaagtctgagttgagccttgggatgctcagttctaaggtttttatgtgaaggccatgccataaaatgccccaaattcttgatggaagggcaagcatttagtaatataattggaatgtgttgaagtgttacatattctatatgcatatgtttacatatataataattttctgtatttagtgaaacaaggatgtgtgatgggctgtcaaaagatgttttttacttatgttaatcagttctacaccagtgtcagatactttgatacctgaaatatgtgtttcaaaatttcaaataaaatttatgacatgaagatatcatagattattaattgaaatcatgctaatgtcatatattaggccatttagagtctggaatttggggaaggatggaaatgaatattcagattctctgaagcatagaaagaggcagggctgactgtctccaacttaaatttttttttcctagtagtaactgtctatttactttacactataattgaacaataaaaggtaagtgaagagttgttttgattctgtttaagtttaggaggaatattattttttacgtgtgtgataaaaactttattttgcttgactttataaatgttgggtaagttggtgttagcttcactggctttgttataagcaattttgttattatataaagtaattactgacaacctataaagaaaaaataagcacattataatctgaatctgattttgcattgcgtagacacaactggaaagactgtttatgataaggaaaccagatgatttgagcaagagagacttgggctggatgtggagcagatggtggaggagatggagaccctcaaatggaaatagctctatatttcctgcaggtgcaaagggctttataaaagggcaatgagagagggtagaaggttagaccttgagttctcattcttttataaacatttaacaccttctgatttttctctttagatactaaaacattatttacaaagaattaatgactttcctttaaaacatataatgaattcattcataggacttctgccagaatttaaggcctatgctctggactattcagcaaagaattcataattcaaaagaaaattttaaagtctaatgttcgggttcccattggagccaaggtttggttatggaccaatgcaaggatacaggtacacttacccacattgacccaaagatgcactgacattgcccctgaagttgattactgagcacttcatagtatttgagttgtagattttgtgctattttactttggtctatataacaagtgagaagttatccactttctgaagcatatttattctaagtctatagatacactaaacagacaaatctctttgagtgtggcagttgaagtgtcttgatccattccaaactaggaatgcacctcctggactgtcctgtcattaagatgaggcctgacccctatcagagacaggcttgtgaggccaagaacacaggcttcatccaagtggccccttagcattgccattttccatgacccacaactgtaacccaagctcagtcagctgctgtttttcacccccactcccctccaccccttttaaaatagaacatttcaaattaagcagaagaattgtgagagtaatacaatgtacactggtaggctttgcatctaaatttgacaatgtgaacatttcgccaatttattgttttgtgtctcctcccatacgtatgtatatgtatgtgtatacacaaattttttcccctgaaccatttgaaagtaagttgcagacatcatgctatttcaccccaatgtacttcagcattatcactttagaacaagaacatgtcacagtaccattaaataccaaggaatttgacaccaatacaatatgccatttaaacacagtcccttctaagatttctccattagttcaaatgattactgtatagctgcttcttttgatccaggatcatgcattgcctttagttgttctgtctctctttagtcttcttcagtatagaagagttccctacatttatgtcttatctaataatgcagtgcagtgttgaaaagtccaggctaaggctggatgtggtggctcacgcctgtaatcccagcactttgggaggctgaggcaggcggatcacttgaagtcaggagtttgagaccagcctggtcaatatggtgaaaccccatctctactaaaaatacaaaaattggccaggcatggcggtgtatacatgtagtcccagctactcgggaggctgaggcagcagaatcgcttgaacccaggaggtggaggttgcagtgagcagagattgtgccactgcactctagcctagatgacagagctgagactccatctcaaaaaaaaaaaaaaaaagtccagctagttgtttgatacagtgttctacattctgtatctgtctgcttgctttctcacagttagaacacagttagattccagttaattactattgccagagcaccatgtaggcaatgcttatccttcttgttgcatcacatcaggagtcacataatgtttgctcctcccattcttggtggtactaaattgaaatccttggttaaactggtacccactagatttctccattgcagagatttctcctttgcttttttgtaattagtaagtaatccatggggtaatattttgaggaccctgtgactctcccgatccaaacctttacccaaagtttttgacatccatccattgagaattcttgcctgaatcatttttattttgatggttgctgaagaccagagccttttaattgaacactaattgttactgcaggaaccaggaaagagtggaaacggagcttcaaggcagaaaccgcatcaaggaaccaattgaacagacatgtgtcctattcatctttgtgccctttctgcctaacatcatgcctggcacaaaggaaggtctagaaaaacattgtggttgagaaaatcataaaaagaacagtacttgacgatttctttttaatgaggtctaacagtatctgcttagaacattaggatatttccctcggaatatgatggatatttgaatatttcatcaatatgcactgtgagttttatcagcatgcagcatttcttctgtcaccatcatttatattgaaagcacagatttttttttcactcacaattctctgcccagaatcatctttaaaacagcatatttgtaggtcttataaggaaaggatgttctcctttccagaaataatgtcagatgcatacatttttccctttctctttctgagaaaatttcttccttacaaccttcaagatatgtcatgatgattctcactctcagtaggatatctgtaaacttgcaagaagcaaaaccatactcctgttcttcctggccccatagggcatgaccgtgctgtgtgagtgccaacagagaatgctgctgtggttgcaccattttcataggtacataggtttgccagccataaagttacttataaatgtgctcatatctaaagactcatcacccagcgtgtatttttctggacctcactcccaagtcagaaacattacccgtcttagagaactttgagtttgcatctaaagatggaactccatttatctttgtgagacttctttctcacacaattcctgatgtttagtagtttgtaaatgcatttgtgtaccattcgtgtttattaatattcaggaaatttagtgttagcattcctgttggttatttaatttgaaagatatcattcatccctgtgataggtgtttctggttccctggaatagcagaagtatgaaatgccataaattgtctccttgtacgttaggtgttgactttctctcatgggttcttccaaagcctgtggctaccactcagcacacttaagactctgtcaagaagaggtgctaccaaatatcttcaatagggcctggattgttggagcctcctaacaactcagtttgtaaacttgatgctagctttattaaaatatggaggaagctgaagcagtgggaaacctatctgacttgtttttttctccaacttcaaatcagaaagctatagtcctggttggccccattttgttctttcaggcaaaagaaagatatcccatcagaaaaccatctaagctgaggctgagcaacaaatagttatcataaaagtcacctttcattgtatcaagtagttaagcaatgcccaagctgcagtgtggtcactgatagggcagctaccatgttggctctccacacttccatagatccgtctggcaaggcaacaacaagcccaaatgaattcagagctttgttacttacacagacagcaaaatcaagatcagtatgccatcagctccttgcctccctagtcccacacacaggatgacaccaaactggagaggccagaagacaggtggcatgacaggtgggtcactttgccctagaggagccacctctaaattacagccaagtagttttattggcacagaagcctgcggctgtgccctaaggggaagggggtttgcaagatgcaaagtcctgtacacaaccaaaacaaggaagatggatgggaaaggtcttgtgcagtctcccacaaaatctggaggtagatgagaaaccgcctcacaggagctccccacaaggctgcttgtcttccttcatttcaggaggaatttcagggcatcccaccaagacttcggtcagactgtggctaagctttgcctctatggcctataaggggatgtgcaaggtcaccatggtgccatgatggagccattccttgcatattgcccttctcatctatcagcatgggaagaagtttgcagaaatgaagcatccagagttttgtgaagctggttaggtgaaaaattaaggcttttagaccttacacattatttttttcaggataggatagatgtgctgcaggaacagataatccaatttctggtggctttacacacaaaggtttgtattttgtttattgtacatatccagcaagagttggtagtagtgttgtattccacacagtcattcagggacccaggcccatggcagcagtttcactatcctatagccacaacatctgcaactcatgtccccctcagttcaccatgataagaaaggacacagccagaagatcatgtgccagctcttttacactttggcctaaaagggacacaaatcacttctggccacaagttactggtcagaactatatcacgtgatctgacataactgcaaggggctggaacatgcgagggaacagagggaatatttaataagcatttttgtttctgccacagacatatatttccccaaagtcaaactatcagtctggctaagtatttttacaagtgaatattcgcaaaaaaagttccatttgttaatgcttaacattttacaaactgctttcactgtaattgcccttagaaaaaggtttgggggaaggggcatacctaaggctaagaccatgaatgacagtgttcctgacctcagaaactacagttgctccatgtacagtacttagatagaaaccaacacacactttagcctgtactgattttggtggggactcaaaggatcattttgtacttgttcatattgaatggaaaccaagtggtgtttggaacaccatcctaaatcatcagaggcactgtgctattctagaagcagtttgcatctactattccaaccccagatctatattgtaaggaactaaatccctttcttggaggaaatgaaatggtgttagtattgcaggtgcagattttactctccacataagtcaaagtagagatttaattgccactctttagaagtgcaaaacaagagaatgtaataattagaactgtcattatatactttttctttctctgatgttgatattaactggttttaaatagtttctaacctttactttgatataattattaaatttttaacataaaactcaaatttcattttttacacttaaaatgctttaacagatccatgttaagttagctgatgaagatatgtgaaagaagtaataaaattatattgtttaatttttctcaaagacatagaggaaaactgtctccaaattttatatgacctatcagtgataaaagagacatcaatattttgttgggatataattaaaaactgataatttgggggaaaacttttaaacagcctttccccaatctgtacaattttgacgttatcatgtgcagccctgacaggagttgccaataaagttagttttattaatatcacttgagggaaaccagcagtttctattggcacagtctgagctccagcaggaagtcatctctttttctcagtgcattacttacatgtgaaagttggggtgggggtgcaaaagaaagtatatattgagcccaacatatcgccttatttgtctcccctctctatgggcatggcatctgtgttttgaagagtcaatgggggagaaaacagttgtgttagtgcttgaaataggatgcagtacattccctctcttcttgtcttctcttccttccgcccccggtctttccccttttggaaaggggagttatcgagagactgagatctcagagccaacactgaaaacgacaccaaattatagctgtgtccagatacctaggatcttgactggccttatcataagaggcaaggactgcggtaaactgcacatcagggaatttgatttcttggtaggtttaaacagctgaaggtagaaggaaaaaaaattaagttcttcctgttatattattaacttatgagaacagcgaaatctaaaagaaattgttctgcatagttgaaagtaaagatagaatactcaatatattttctacaattcatctctgatagaggagaaagttgttttgtgagggaaagccttggggaattacttgtgttctagataaaagtgtcatttaagaatttattatggaaaatttcaaacaatcaagagagtggatagaatgaactgacttgtaccttacttatcttcaataattatcaatattttgcccatcttatttcagtaactctaccaccaccccttttattttttgaatgaagaattttaaagcaagtcctaaacatcctgtgaggtaacttgctccaaatctcataatgagaaggtggtgaatcaggattgaaaccttggcagtctggctccagaacccacagtccatggaaagaggacaagtcagctgtgaagatcgcttaaatggatttgttcttaaaatcaatgtaactaacaagcaagcagacattatctggggaacctccactccaaactgtctttgaatctaggggttccatttttaaaaagggtgtgttggggggaagggtaggttcaggatttagtatcaggtgccctttttactagagtagcattttatgggtgtactcatgaaacaccagttaatttgccttggctgcctctctccaaaacatatttatagaaattaatatctacccaggcacttctgccaacagttcaggaatttaaaatagtgggggtcaagcacaggtcgtggctgagagaaggctggaagtccatgagttctactgtgatctgacaaaatatgaggagttgactctttaattatagcattttgggagtaactaaaggtttgacacatactgttctacattgtttaaaaatatactgtttttagagtacatagaacagaacttaaatgactgctaatacctcagtgacactgaatcaatcatttgaattcagttacatgtcctgagccaaagcctagtactcgaccttgcattaggccctctgtgatctgtgggcgtcaaagaaagatcctgggaggggcatgtcctgcttttaaagagctggcactctctcttgggtgaggggtggccacggaggaacaggccagatattcaagaagtggggttggtggagttgccccccagccagatggggctacctccctggtctgtggtggccacacattgctaggacacactcaaaacaataccgtggcctccaggcagccacagtgtaaaatgttcttaatttccctggagagaaggaagaaagagctttcaattaacatgaacactggctactttttcaagttacctaattgaactgtcagaaagcaaagactttgtggagagggtgagaggcaggattggtaaattgtgattacaaagctgctgggaaagaaagggcagttgggggacaggagatgtgacagcttggagctgcagtgggcaccccagattcccgtggtggaggtctactgaaatggatagaacactttggaggactgcctgtcagtctctgcatttcttggggaggggcctgaccatgggatctggaaggcaggcaggaaggagagatgctaatatcttaagtcatccttataaaacaaagagaattttctgagaaatgatggttccttcttctcctctgctttgaagaaacataacctagtgcatagttccccaaatcttagggcagttacctaaactttatgctcatggaaacccaaaacactttttctcctaggtcagacccatttcctggcctgcttcacagtgaagtgtggccatagactcagttttatccagtaatatgtgaacagaaggatatatatctcttctaagcctggcccatcaaactgcccacactgtctgctattctttttttttcctctctctctctctctctctcttccctggccagacctattcaaagtgatcttgagatctctgttgaagatggcagagactttgtcatccttaatctctgaatgaacacatggataactaccacaaactagaaacacccaagtagcgttattggcattttcatgagtaagaaattctgtatgtaagctactgagatttgggatggggatacatctgttatagcaattagaactatttactacaatctttccccattcttatctgtatatgacttatactgtcattcattattattattattattattgagatggagtttccttcttgtggcccaggctagagtgcaatggcgcaatcctggctcactgcaacctccgtttcccgggttcaagtgattctcctgcctcagcctcctgagtagttgggattacagatgctcaccaccacgcctggctaatttatgtatttttagtagagatggggtttcaccgtgtaggccaggcttgtctcaaactcctggcctcaagagatccacccacctcagcttcccaaagtgctgggattacaggtgtgagccaccgcgactggcctactattattatttggagacagagtctcactctgtcacccaggctgcagtgcagtggcatgatcatagctcactgcagccttgatgtcctcagctcaggtgatcctcttgcctcagcctcctgaagtatctaggattacaggcatatgccatcatgcctggctagttttttttgttttgttttatttgttgttgtttgtttgtttgttttgagacagagtctcactctgttacccaggctggagtgcagtggcgccatctcggctcactgcaacctccacctccctggttcaagcaattctcctgcctcagcctcctgagtagctgggattacaggtgcttgccaccacacccagctaatttttttttgtatttttagtagagacagggtttcaccatgttggccagactggtcttgaactcctgacctcaggcaatccgcctgcctcagccttccaaagtgttgggattacaggcttgagccactgcgcccagccggccagttttatattttttattttttgtagagatgagctcttgctgtgttgctcaggctggtctggaagtcttggtctcaagcaatcttcccacattgatctcctaaagtgctaggattacaggtgtgagccactgcacctggcctattatttttctttaaatcaagttattttttatgaattttgattttaaaaagtaaactttatgtcattatcacaaataaaaaacaatatcactacaaatagaaggtaactctaaaaatacattgagtggaaaaaaaatgttattcatttctagctagatgctatttcctggagaaagttctttgcatgagacctgttgtctctgtgttgaaaaggggaaactagccactattagaaaggtgtcaaagacatattaccacaaaactgagatgcattgcttggcagaatcagaagagttgaaaaaaattgaaaataatttccccatagttatgtgattccatgctatttaatgttctgtctcagtcaccttaagtcatctggtttaccagtggtgcacatcctacccttgggagtgaagacttactaaatggagaccaggtttggctggaggcttgaggatgagctgaaatgcataatagaagatacattgtgaatcttgtaggcgtggagtaaaatgagacttctgcaggcacaggaagactagccaacctatagttcatcatttcaagtttgattcttgatatatagataaaagatttttttgttaatcaggatatttgtggtttcctcctctagtgtgttggaataagctttgaacacactaacctttccacagataacaataaacttgggacaaaatgcaaaaaagcaactacttgaaggtttttgaaagtgaaaaaagtaggcaaacaggttttgtaaagcagtgggcacctggaaaaaaggactttagtggggtgagttgtctgtttttgcagaatgacacagggcagccgaagttgtgattaaaaactcctcactttcttgtctgagtggcaagaagaaagagtctagggagcctgtggccattggcgagtgagaggggaaaaccagaaaggagagagtcagacaaggagagcccaagattgtgagtataaactctgcccaagtctctggctgattcttttttttttttttttttttgagatggagtcttgctctgttgcccaggctggagtgcagtggcatgatcttggctcactgcaagctccgcttcccgggttcacatcattctcctgcctcagcctcccgagtagctgggactacaggctcccgccaccacgcccagctaattttttgtgtttttagtagagacagggtttcaccatgttagccaggatggtcttgagctcctgacctcatgttccgcccgcctgggcctcccaaagtgctgggattacaggcgtgagtctggctgattcttgagccatacatgtgttggacaaaatcaaagcagcacagttaatggtaacagagctggactgagatttgatctgttgcctcctgcacacaagacagggtttgcagtttaacaaaactaattgcttgttaaaataaacattaacactgttcaaaggaaaataatagaatccagagtctccacaacaatattcataatgtttaggatacaatccaaagttactttagctacaaagaacctggaaaatgtgacccattctcaagggaaaatggatagaagccaaccttgagatgatccagatattgaaattattagaaaatgattctaaagcaactcttataattgagataaaggaaaatattcttgtacacataagtgaaaatatagggaatttcagcaggaaaatataaaatataaaaagggacaaaagggaaatcttagatctaaaaataatatctgaaatttaaaaaatcctctgtatgggtttgattaatagcacagtagaagtaatgaggaaagattcagtaaacctgaagataaatgagtagaaaggatccttgatgaataacggagataaaggattttaaaaagtgaacaggatcctagacctgtgggacagaatgaaagcctagtatgtgtttaaggtttcagaaggaaaggagaaagagtggaacagaaaaaatattgatgagataatgaccaaatttttccaaattgaatgagaaacacaaatttacaaatgcagaaagctcagtgaaacccagataagataaatacaaaaatgtcacaccaaagcatatcatagtcaaattgctaaaaattaaagagaaaatcttgaaagcagtcagaggagaatggcacacaacatagaaggtaactgatttaaatgatcatggacacgcatctggagctatgaaggccagcagagagtttaacagtatctttaaagttctagaaggtttgggggaatgcaatcctgtcgaacaagaaatctgtatccaatgaaaatgtcctttgagaatagaggcaaaaatatttttaaataaaaagaaatataagaaaactcactatcagcagatctgcactacaagaaatgctaaagaaaatttttaagctgtagggaaataatatgagagggaagcctggctatttcaaggagtaatgtagaacatcagaaatggcagatatctgtgtaaataaaaaatattttgttgcctctcaatttatttacaatgcatatgattaatagcaaaaactataacattatcttatgggatttattatgtacatagctgtaatgcatatgacagccatagcataaagtacagtactatggcggtgggaggatgtgttaatggaatatatggttaaggtttgcacgttttctgtgaagtggtgcagtatgaactctaagtagattgtgaaaagttaaggatatatatcctctaaaacaacactaaaaaaataatgctaaaagccatagctaaaaagacaatgggtaagttgaaatggaattctaaaaaaaaataggtggagtgtttatggtatgggtaaactaacatactaagatcgttgatcattttggtgctatgggcttgtcatggaattcatcatatctgatttatgcttccttccttcctacttatctggctgttttcattgaactgactcgttccataaagtctgttataatttgccacacttgttttcttatctccataaatatgtgagcttcatgcttatagtgctgtacattcagtcattatggtgatgaggatttggaagtttcagatggagagaaaaatacttaatacctatcttctgcagagattgtcttttcttaaagataagattctggcaaattacaaagatgactgtgggaggcttaaaagtagcccatgatatgttagtagcaggtacatggaatctaatgttcagcatatttgatttttcttaataaaattcattttgacatataataataattgccatttctcacatatctattgtgtgccaggcactctactgagaccttaacatgtgatatgtcatttaatactcaaaatagagtcaatgagaaaaaattatttccctatttgcagatggtaagtaatttgtcttagatcaaataaccctctctgtagttaatgatggtggtaggattcaaatctgggttggcttggatttgaacctcttcccatatgtcacacttcttcctgttagatgtttaccaaatttaaatgttgacatctgctttgtcatcatcattcaaccataggtatttttgagcacctgggaataataagttgcaggaagatgcatgatcgactgttgatggttagagtagtacgtgccttctcaagagcccaaagtgctacaagctgtttttcccatcctcttctacttctatcctaaaaacattacctaccctactaaaatctagtaccattcatcaaaattattcgttttttccactgtgcagaggaataaactgaggcccaaatgaatcgtattagaagagctaggtgggaaaccatagcctaggctcagacctaaaccgaggcctttctttacactttttttttttttttttttttgagacggagtctggccctgtcacccaggcaggagtgcagtggcgccatgtcggctcactgcaacctctgcctcctgggttcaagtgattctcctgcctcagcctcccgagtagctggaattacaggactgtgccaccattcctggctaattttcatatttttagtagagacggggttttgccatgttggccaggctggtctcaaactcctggcctcaagtgatctgcctgcctcagcctcccaaagtgctgggattaggcatgagccacctagctcaaccagccttctcttacactttaaatttgaatccctattctaaaaatttagtggtttaagacatgttttctgaagtgttccagaactgaactgctcctggcaaagtcaggatagtgagaggataggaatagaatctatatgagccagtcacattttttcctgtctcatctctggaatgtcatggcaggatatcagatcagtagtgacatttacaggagactgaacatttttaactggaaagatgaagagtttttaagaccttattaaaaccaaactccaatttaacttagaaccatagccttttaaaggtatgatagaatcttagagaacataattctcatattctctttttacaggttctttcaaaggccaagagaggttgaatatctactttagaggcaggacacacaattagtctttgcagaaccaggtgttctaacttccaatttgggacattcaccattttttcattcttacccccacttcatctacttcttgagctaatgagctatttgtgaagcttcccttatgcctcttgaactgcttctgctgctctcggaagtgtgcttagaatgagaacatatacattataatttaaattattggatcagttgaacaattcgtccctgcaggtcaaattcttcaattgtgatcaatccctatgagtcaaattcaaatttaattttttaaatgttttttttcaaaaagatttcatttcattctacttctccaaatagataaatgtttatttcaagaaacactgccaaatattgttagtgcttcaaatctgccagccattgacttttttttttttttttgagatggagtcttgctctgtcatccacgctggagtgcagtggtgcaatctcagctcactgcaacctccacctcccacgttcaagtaattctcctgcctcagcctctcaagtagctgggactacaggcacacaccaccacaccaggctaattttttgtatttttagtagagacggggttttaccatgttagccaggatggtcttgatctcctgaccttgtgatctgccctccccagcctcccaaaatgctgggattacaggcgtgagccaccgcactcggccagccattgacttcttgaagcagcataatttgttgtccgtggctcctgaatgttcctcatgccaccagcccttatggtggatagtacaacaccaatgtattccttggaaatctgggatcatctggaaagttcgtttctgtgggtcagacttttaattgattgttcaactgatcattccacccaaatattttctttttttttttttttaaattatactttaagttttagggtacatgtgcacattgtgcaggttagttacatatgtatacatgtgccatgctggtgcgctgcacccactaactcgtcatctagcattaggtatatctcccaatgctatccctcccccctcccccctccccaccacagtccccagagtgtgatattccccttcctgtgtccatgtgatctcattgttcaattcccacctatgagtgagaatatgtggtgtttggttttttgttcttgcaatagtttactgagaatgatggtttccaatttcatccatgtccctacaaaggacatgaactcatcattttttatggctgcatagtattccatggcgtatatgtgccacattttcttgatccagactatcattgttggacatttgggttggttccaagtctttgctattgtgaataatgccgcaataaacatacgtgtgcatgtgtctttatagcagcatcctgttttgaaatgactagcctggttctaccattcacttcaagcatcatttgaacaatttggccctttatatatcaaataaatgtaaaggaaggagttcactgactttgatgatcttaaatagttttgtcagtactgtaaatactgatctcgaataaaatactaaatgaaattcaagaccttagttgacctgctattgcactagatttgtttggaatcaaaacttatagtcttttaaagccatatcactgtaaaatagagtaaaatctccagtaaagttctagattattcataacacatagtggaaattgttaggagacttccatgccattactccaagttaaagccaacattctaagttaaagccaagtatcctgttggaatcctgttggattcaggttgtgcacagctggggtgaccttcttaaatgttcttattctagagtttgcattaaaagcaaaggaaaagctgcaaaaatagttgattagatacatctgagtccacattttagatatattgaatttgaaaagaatcaatgataaaaataggacttgacaacataactaatagttgaaaattttcttaacaatgaaaatgagaatttttgttcaattttgagggttttttttgttgtttctgtttttgttttgttttgagtttttcagttggcctatgggaagaaatatttgcagcagcatataatacccagaataatcttgaacttgccctgaggactgtagggaaaacccctacttgccttagcatgttcttggaaacaataccacaaagtgatttatgtttttctatgagaacaacattgtgaaagcagcatcttttctgaccaaagacttggcatcatataaaccatcttaccaacagtacgccataaaaacagatatgaatacaaaaagtaaaattctagcatcataaacctaagttaaagaaggtttaaattgctgtagcaattgatcattacaagaggactccctgactataacagcacacagagctcttcaaactacaacattgtgtcataaatgagattgtgtaaatagaagtaccttgcataaccctggctggtaactggtatcaggtaatgttgattgagaacaaatattaaatatctgtttgctctccaaggtgacatttctgcctctaaagttttatgtttcaatttacaatgtctacttcttgtttgtttgttttcttgagacagagtcttgctctgttgcccaagctggagtgcaggggcataatctcagttcactgcaacctctgcatcctgggttcaagtgattcttgtgcctcagcttccccagtagctgagattacaggtgtgcatcaacacacccagctaatttttgtatttttagtagagatggcgtttcaccatgttgcccaggctgtacaatatatactcttatattcttagactatgaaaaatgacttaaattgtggagaagtatgggaagaccttcttcttccagagatacctgaatagatccttccctattgaatttccatgtaacgagtcagggcattcatgaattgtcctattttcagttagttttctaagtactatagtagggactcctcagatatctgttacagtggtggatgaagaaggaggagaaggagaagtttttaaagtataatagctaacctaatcttttgtctcttccaccatctttagttaattcagatgttctccttcaatggctcatcatcagacatatacccctctcccctctctccccagcaaaggctaaccaggaaatatggaatagtatttattttgccatagggtgtactagacatctcccaagaatgctaagataggataaggctgtatcctcctgatccttcaggatgagcaggccaaaccatcaaatgatcaaattccagaatagccaatttgccccgaagtgattttggtaaagaatccatttggaatagtatttctcaactctccgactacatcagaatcaccaaggcctggggcctgccccagacactgatccagttgttctgtggcgagatggcagttaaaaaaacacacaagaactttcaagtgattgtaatatacagccagagttgagaacaattgggccagagctttcttatctgccaaataatggaaggcagaatggaggaataggggttaattttattaacatctaataaattgatttaaaatgaaaatgggtgcctcttaataataataatactgatttggtgtttatcatcttacaggcactgtacacacatgaacacatttaaactgtgccacagccttcactgtataggtgagaaaacagtcctgagtgtcaattaacttagtcataacaatatagctgctggcattaggatccagctctacttcggaaaagctcatcagtttccactctaccacaccacctctacacttttactttctcatctacgtttttctttgaggagatgcagttaaagtcaggcaagctaacatatattaccactgataacaaattcagcagcctaagtattgctgaggaatttaagtggctgatgtgtttgttccagtcttgggtagaaatgatacattatcaacaatttatttatttattaacaatttataaagaaaacagttttatcaaaaaattatcagcttgaattttatgaatgaagacagatgattcctgtccatggaaaataaatagtctgtatcctttaaataatttaaggcacatttcttgctaatattctgggtccacctatgtcttgcattgaaaaagtatttacctaatatcttaaagcagggctatgataacttagttctcaaggaaagaaggttttaaaaataattttctctgctctccatttctcttactgtaagcatgtggcaaagtcttggcatctgctcagaataaattttctgcttcctttctgtcttttagtcagcgcacgctttctctgagttctcccccttactccttccctgctttagtaatctacaggaaaccagaccttactaatttgagtgcttgctcttagaattacttattactgtattaatacatatttgctagagtttgtggaggatttgtattgctctaggtgctaataaaaatgtgtaaaagacaggccccttaaataatgtgcaattttgagggaaacaacaaaggcaaaaggatttctttgggactggctatttgcaataaattgctcatttgattttattttttattttttttttagcatgcaggaggtttattaagaaatgcaatgacggcaggattggccagagagagaagtcaagacatgatgcattctcaatggaatgcctcagctgaccatgtggggagttctaaagacggactgatgattcagagtgccccatgttgatttatcagtaatttgttttgagctgccctggaaagcgggtgtgaagttggttgagaaggccccagatttctcattttaaaatgctgcatgtgagaggacatttttcacaaagaactactaaattaaaaaattggggaatagaaccctactatgaacggagtgtgtttcttctattcaggcacatatttttgcctaatatccagatgctgtttccaaagctattttttcatgaaattgtgttgctctagaatgctcaatggttctcaaattttagtgtgcatcagaatcttaacaatgaggggctaagacacaaattcctgccctcctccctgccgcccccctccagagtttcagattcataggtctcggttgggtctgagaatttgcattcccaagcaagttaacaggtgatgctgatgtttctcaggggataacgggcaaatggtgaaacccagaaagttttgtttctagatatgagatcccattgtctttgccaatgaagctgtgctgtaactccatcttaacaagtaaccccaaattatacccacctgaaagacctttgtgggttgtggaaaacctggaagatggctgagagacagtaccctcgaagtagttctgaggagattgttctgcttgtattcccatgcagcgccatcactgcctgacttccttatgtgtgtctgatttgaggcagttctctaggaaccagttcctggtgctgcagtgccactggcagcttcccagggcttccagaaccctagtggcatggtgggaactcctgttcctcacccgacctctccacagccctggacctgtaaggtttcttccaggctacatggaattagatttccacttttccttggttcacagggggcaggagccaggttggaacggctgccaaggagactgtcttttttcagagcccttaactggcagtcagcaagaccgaactcctctgctccttggtgaatggtgatgctgattatttggaagctttagcaccaaagtttgaaattcccctaagtgaatggttttggcgatccccttcctttagttatactattggctttctctcatgttcatttaggttgccaaatcttctgtataatcctcatcccccatcaaaagagaaaaaagaaaaaagaaaaagagtagttctatttttgtggaaaaagaggaaagaatccaggaaacatttcagagaactgtatgttttcttagttccttctctccagacacgaaatccaaggagtatttggtcagttgctaacattacatgaggggcttttttttttttttaaagtaggtataaaatttaacttctctgcccacctcctgacaagaaactgtggaaaatatccagtttacacaatttgaataaaattattccttgataaaggtcacgttttcttattcataagaatcttcacaggaagatagcatggaaagggactaataggtgcccaggttccactctgattgtgcagagaatataaggcgggcccaggctgtaaggagccctcctacatcattctgctggtagaattaacagcagcaattgcccaggtctgttgtaagattaggattctgcccaccctctggagctgccaccattctgccttctctttcttagagttttgtattctaagtttttactttgaatcttgagaatagaaaatagttttcagtctcttgagattttacatagtttgtccatgagcttcagaaatgagttcagtgtaactgcttagatacctcgatttatctttttcagtttcatttgttatttttaaaatgctttaagatacgattaagaggccgggcgtggtggctcatgcctgtaatcccagcactttgggaggccgaggcaggtggatcacctaaggccaggagttcgggaccagcctggccaacatggcgaaaccccgtctttactaaaaatacaaaaaaattagctgggcgtggtgtcaggcacccataattgcagctactcaggaggctgaggcaggagaagtgcttgaacccaggagttggaggttgcagtgagctgagatcgcgccattgtactccagcctgggcaacaagagcgaaactccatctcaaaaaaaaaaaaaaaaacaaaaaaccattaagagaatctgcagatagttcctttggcagaaatgttggttaaaaaaaatcttctggctgtgcaccaagtcagtgacctataaatactctgtgctggctcttctttctcctctttgtgattcgctgggatacagatcttggactaatgccttgaagaaaatgttattttgatgataagcaaatatttcaattgattctagaattgaagacactgattgtggactggatgatttcttctagcccaaaattcattctctagattaacctcaagtctgctgtaagtgggggagaggatgccagttcacattatcacagttaccattattattattattttttggccaaaatcaaccttcatttcttagtgtacatttctatagttactaattcagtcaggctcaactgggttctctgcttcaatgctcataaggctaactcaaggcatcagccagactgggctttttttctggaagctcaagtaaaaaatccacttccaaagctcattcaaatggttgggaaaatttattgtcttgtcatcacagtttaaagattgtactctacaagggtagcaaacactatcctcgttgaccttcagggttgggactgtgtgacttgtttatatatgtgtatatttgtgtgagagagagcaaaataatgtatacttggtacggtttagtgttaactgttgggatatcagaaatataaataatacttaaagtgtactgcccattccttgtggaagaagcacctgtaagcactgtatgtacagtgtattcctttatttaatcctcacaaaagtcctatgtggtagattctattactatccccatttgtagattaagaaactgagacttaaataagataaatagcttgctcatgatttcacagctgataaatagcagcaccagaattgaactaacctctgtcttgaaaacaaagttcttatatactgtgctaccctgaggaaacttctagttgaaaaattgtggtctcatatggtcaaagcttgttgactgtgtaatgccatttctcttcctcaccaactttaaggttttttatatgagaaagggcatgggaggctgtcaccgacctttcttctcttctattacaatgctttaccttcagactgccatttttttttttgaggccaaagagaaatagaaagtaacttctatccaagcaaaacctggggaccctagatctagtccatctcaattgaaccagaatgtttcctactaatagataaaatctatttttgtttaatactatgccattccataaagacatgattattccttagcttctccaaagggatacttactgaaagtgtagctgagactgtttattcagtaggttcctaagcaccatctgctttactgagtgttctagattttgtctaggttattcctgtagagccatggtcagcattatagtaacataacagcatatatagtaacatatagtaatagagaaatatctatttttactttatcagtaataaagtattagctctgatttatggtaacaggatagtcttaaagcttatagatctgatattaagaacattttatataatgttatatatcaacattgtcttttaaagtgatggatgcttttatttcatcttttggtttatctctgaaagatcattcttttggatacagttttttttttttttaatttagagacagtttagacttcatagtgtcatgataattttcaagttggtatcaacaggaataacaaaaggaaccaagatttgaaacatctgtaaataacaataacttttattgaccaacaatatagtatgtgccaggcacagtgctaagcatgttagcacatttccttacatcacactatgagctgtaaatattgtctccacttcacagattttaaaaactgaggttcacagaggttaagtgcctgatccaaagacacataacttgtaagtggtggacccaggaagccagagcctggtacagggtattctgttgcctcttagaacccaagatttttctcacccagttcaaaaattctcatctacagtggtcagcagctgtgagaactgttgagtctcagtcaagactcacatgattatctggttcctaggcaagggttaaggccatgccaagagatgtgaagcagaaggatgtggcagattgactggtgtgatatggggtgtggtgcccatccattcatgagtgccacatagccgggagggaacgtgcgagacatagattctaattcaaaagggaacagattccagatgggaaagtacttggctaattgtattcaagttagctcacacttatagaactgtagaactgtaacatttcctgagggcaggagtggatggatctttttctttatggtgcatgaactattagtaggtatgtactgatacctgggggagtaagatagattctgaaggagtctagaaccagactacatgtgtttgaatcccagttttacctcctattagctttgtaggtttgggcaatttaaataatctctctgtaattcagttcatctcatctgcaaaatggagatgatcataatacccccatgtagggttgctgtattaagtaaatgataggtgtgaaatgcttagaacaaaggcatttgtcatcatcatcatcatcgtcattgctattgtcaaaaaatgttaagtgcacttaatagttgccttggatagagcagctcaaagccctgaccaaattatgaaccattttgagagtcattaaattagcagtattggaaatggatgccaatagccagagttggcaagggggtggctatgtggcacaatcatgtatttgcagtgggagggcaaatcggtataattcttggaagatcagttaggagagctgttatcaaatatcctaaaaaagtataagtcctttgacctaggagttctgtgtctaaaaacaatttgaccaaaagcctaaactgtctacaaggatgttaaatgaagatattaaaaatatatagaattttatgtttatggacatggaaatatttgaaaacaaagtaaatagaaaaaagcaaactataaacactttataggaggatctcattaaaaatatgtcttggtagatatcttcagatgacttttgttttagtttattttaaagctagaagtaatagattaacatcccactttcaaaatttgtttacctttaggttttttttttctttttgctagttagacatgattttgtccaataatgtctgcatataaactcttcatccaaataccaagaattaggaaatcctgctagaagacttgttctcccctaaaaagaagaattgtgtaatgcttcctcatcagcctgcctgaggtatgcaacaggctccaatcaataatagtgctcagtactgtacaatttctcactaacttggggcagtatcatttaaaaatatccccctccaccctgaaattctgatacaattctataccctctaacatctcatatccactgagaatcccagatatggaataaaagtttttgtcacaagcataagttcttttgacagtcaagtggtttctgtgcagaaagacctactgtgaactagctaatgctaagaggtatgattgtttgatattaattcttaatacataatttaggcaaagtcaccccttgtcatttgggaggatactcctgttttttaatggtttccttagcagactatcacttactttcctatttggtcttcccatgaattggatttacctccaggttatatggcaatttaaaggattgtgatgagaaagaccaaggtcatggcattcagactagtgtggctttttttggtttctttatgtttttaaattttttttatcttttttaaaaaaataagtatctataggatatctttgaatgcccagctgctgagtctttggcctagaatgctgaatacttatgttgatgttgataagcttcattctcatatccacattgagaaacaagcagaaattcattgttatgtgagcatgtaaaggctgctcttttttggacagcatgtagcaattaaaagacaagggctgggttcttactgtcatctgaaaggttaggagaattctagtctcatgacagactttttccattattgtgaaagggagagagggatcttgtgcatatacccaactggggcccacaaatccccttttacatgtcccagtcagaaaacattagacactaggtctcgaggcatgtcatgttcgtccccatcgggtgagctatatgtgcatgagagaggcagcccccaacttagaacctgttttgttgtgtttgtttgtttgagacagggacttgttctgtcacccctgctggagtgcagtggcatgatcatggctccctgcagcctctaatcctgggctcaagcgatcctgccaactcaacctcctgagttgagtagccacaggtgcacagcactgcatctggcttgactctttttaaaaagtcagcttggctatagataacattttcccagaaaattagtgtttcaaatcagagatctgtaaaccttttctataaagggccacatagtaaatattttaggttttgcagtctgtaggtctctgttgcaactactcaactctactgttgtagcagaaagcagacttacacaatatgtgaacaaatgtgtgtgactgtgttccattaaaacttcatttacaaaaacaggcactgagcagggtttagtttgctaacccctgctataaacaattattcatttcctaaaccagcccacagaaactcctctggtaagttgctgatacgttgtacatttacaatattattttctctgaaatttgttttttttttaatcaaaatagtgttaggccttgtctaaaagtaacacatttctaattaatacttcccgaacctgttccccaaaagcaactacttttttctcttttagctattctgaatgttatcttcaaatctcaatgaaataggcttttattgttgtttcttaatttattagtgtcttagtctgttttgtgctgctataacagaatgccataatttatagagaaatgagaataacttataaacaatagaagttttttggctcacagttctggagcctaggaagtttgagatctcaaggtcaaggggctctatctcataagggccttcttgctgcatcataacatggctgaaggcaccacgtgggatgagagtatgcacaagggagagaagggaagggggccacgtttatcctgtgtcacccacccctgaaataatcactttaattcattcgtgagggcagagccctcatgacctaatcatttcttaaagcttccacctctcaacagtgttgcatgggagattacatttccattgcatgaacttggaaggacacatttaaagtatagcaatctaaagcatagactttctgctaaaatagataggaatttagttttccgatatcctcacatgccaatttctccgaacacatgatataatttgttttttgtttctctactttttactgcaataaacattcatagtttaaaagtttacttcttaagtatgcatcttgatgaattttttattaccaaacagtatcttttagattccctactttgtaaaattaggctcttggcacccctgcactctccacttctttttacttttatataatacagatcatgatatttcattttattttgtaagtacatttaagtctttaagctttatcaaaaggttaattctaaaaattgaaaatcaataaatattatttgtgacctatttatagtggagctaatgatcattatagtttaattttcttgttcgtatggctgtttgtttttatggaatttccaaatgccattttcccttatgcttttgaccctttaatcacagcttccacttttgacattttccgacatccaagttcactttgatggagttttttcccagcccctcctccacaggttcctccatctttctgctccctaggcttgatgcttacctgtcactctggaagttcctccttcagatccactggttcctgaaaactatcctgtcttcatttcaggttcactccttcattttggttgtacatatcttcaatgatcttcctataaaagggtgtggaggggctaacttttcttagtctttgaatgtttaaaaatgttttgttctattttcatctttggttgatgattaggatgaatatagaattctaagatgaaaattattttcgtccagctcctttcttcagcatttgtggagtgggtgttgagaatggagtggaggggaagagtaacttctcagtaggaactacatttgtctgcagtcttcaggcttgctcttgaaaagtctaataccattctaattcctattcctttgtagagggccagtttctttattttcctctatttttttaattttttattatttatttatttatttattttgagacggagtcgcgctctgtcgcccagcttggagtgcagtggcacgatctcggctcactgcaagctccgcctcccgggttcacaccattctcctgcctcagcctcccgagtagctgggactacaggcacccaccaccacgcccggctaatttttttgtatttttagtagagacggggtttcaccatgttagccaggatggtcttgatctcctgtcctcatgatccgcccaccttggcctcccaaagtgctgggactacagattttcctctttttatatggaaacacattttatgataacttcaaattctgaaatcaagtcataattttgtgagaaattagaatcttttctgattcatccttctatttaattttaaaaataattttctattagtaagattttttctagtttacttcttccattttcatagcattctcttcttgttttatggttataatattttcttggctctcttttaaatttttgaaattcttttctattgcctgtcttatgtgtatttccttcagaactatttcctccatttattcatctcatttgtattctttcttgttggaggctttcttcatataactggtaaccatgattggctattcataattaagagtgaagccattaaacagctgccttgtgactctctatgtgggctttgttttatgatatttgaatgagttggtgtctgaatgtgctttttctctgaatcttccaatttctttttaaaagattgctccaaatttctttttgtatgtgtgtgtgtggttgggggtaggtggtgtctgggttgatggagaggaggagagggaggagaaaaaagagagattattagttggcagaatggagaggggcatagggtaggggttaatgattggttgcctcacatacatgatttcagataatttgtttttcctgcctcacagctcatgctcattctctggccttcgaagaatctcaagttttgcccagttttgcaagattaattgggtcctgcccataaatttctacactgtagattcttctgccctgtttcattaattatcacccttccattttgtctcttttagaaagaggcttatttggacctcctcaggatattatgccattttaaatttcttaactcaatttagtgaggttgattaaagaagagaagatcaagatcaacttgtgtggtcaattggtagtcacaatattgttttctacatttctattttgaattattagacaatattttattctgctgtccattttatagctgcatatatgttggcctgccaatttaaccttcatctatctgagaattacttgaaactcaggctgctaggaccatatttctatcttatattataacatttttatattactttacttttcttaacttccccctcctggcttgtgtgatgcttggctgagactcaaggggctgtagaagatatcttctcattcattatgcagccagtagctatgagttgcttctgaagtggtttccagtccttcctgggctcggtctctataagcaacctgagagagagtggctcagtttatctataactctgacaataaattgtattttgataagttggagtagcttcatgtgatgttccttgcttttcagccctgaaaaatccagacatctcagattaattcttgagaattacagaaaattggaatgaggatgttcatgtttcttgtgtgcctttccctttgttaagcgttttccttgtatgctaaagaatgctcacaggttggtcttcctctgggatagagggccctggggctcttgtttcactttaaacacagaaataaacatttttgaaaatggaagctaactcactttctcactccaatttcatattgctccttgtggatatatgtctatattctgtaagatgaggtagagaaatcaggatattggggtgacagtgcttaatctcttaggaaaacttatgtcttcattgttgtttcaggcttcttcatgaaagtttaaagtaaatcaggctgttaattcacagatattctcactctaatgtccctcctggaaaaccaaaacagaacaaatagtttgcaaggttcattatcagttgtcatgacatctcttaccatttctataccactttcttaaggctctattcacatttttattttttaaaaaggtcgggttttttgagcaacataaaactttgagtctcaagttttgagactctcagagttaaaaagttattaagctataggctgtggagagggggcagatggaagaataggactcgccagtgatcatctctccacagaaacattaatttgaacaactatccatgcgtgaaaataccttcttaagagctgaggaaaccaagtgagagatcatagtacctggttgtagcataatatgaaaagatgcattgaagagggtaggagggacagttctacattactcacttgcatcacccctaccccagccccaggcagcacaatgcagaaagatactgtccactttgggaaaagagagggaagtaagcacaagactttgccttgcaccccaacaccaggcccactacagtaaagcccagaaccaggaaggcctccatggcccaagactatggctggtacccacagattgaacctccagactcaccttggcatcaggtgggtccctgtagctccaggctttagacttttgaggcagacttgatctctggtccgcatctctagtgggctgactctagcacccctggaatttagacagttgtcagcagcacagaggtctcagtggcctgggtctttcagcttgctctggtgctcccctgggcttctaacttgtgtgagcgccacactggccctagcagccatgggcttctgatcatacatcagatgtcctgaccagaatctctggttgggctgttgaaggtgttcccagacaaagccaatctgtgaagactggaatatctatttattcaaatgcacaaacatcagtacgtggccataagggtacaatcagggaaacctgacctcacccaagggacaaaataaagtgccagtgactgacactaagaaaatggagatatatgaactgcctgacaaacaattcaaaataatggttttaaggaaattcagagaacctcaagaaaacacagaggaacaactcagtgaaatgagaaaaacgataagtaaccagaatgagaaatttaacagagattgaaataaaaaaaatcaaattctggcactgagaaatacaatgaaggaaatgaaaatgcaagacaaagcatcaacagcagaattgatcaagtagaagaaagaatctgtgaatttgaagacaggttatttaaaaatgtacagtcagaggagaaaaaaacaaaagaaatgagaaaaacatataggatttatgggacagcatcaaaagaccaaacggacacttcagggattttccttcatggctccccaactgtctcgatgtgtacggtgccatcttaggaaagaccccttagcaattcatggctgaagagctctagctcataatttaaatgtgaacatttctttctcaggcctggcttctggatcttggaattctccagagattgatactgcaattgccttctctgtcattgaagcccttggtacccacaccttgccctgcagacctcaacaggaggactttgttagtcccaacaccagtcatggctccagtcgggtgggatgggggaaagtcaaagacagtctgtaagtgatgcatgtgtttgcatggtggccaggaaccagcagaggaagctagtttgtctattcttttctctcgctgtcatcacgtagtgcctttaccatctccgggtggtggctataatcatatggactccttctatggacccagtttcctgaacttcccagaaagaaacaattcaacaattaagtttaacaaatgttttgggtgcctgttgtgtcaaggaaagcacataaagcagactttaattctttaaggggttcaggcaagaatctaatgctcaaaggtaattctgagaattaaacataattggaacttagttatttaaatctaattttttttgtaaacagatgtgagtcctagcatcttacatgtcaattaattttttcttttaaattcgggtttgaaagttatatataataggttgtagcacactgttctaggcacatttctggatttagacatgattaagacatggtccctttcctttaagaacttaatacatataaataacaaaagtcaaaacagtcataaatattttaataaaatagctttcccataaaaagtgctctgggaacacatgagaggtagagattaattttgagaagtgtttttatggaggaaatggcatttggttttaatcttgaagaacaagtaagatttgaacagatggacataagtgtttccagggtgaaggcccatctttagcataggcttggagacaggacacacaaggtgagttagagggtgtgtattggataggtcatggaaatgatgtttgaaagttgtctggatcttcttgtaaatgagtctcggtaccaggcaggggagcttgaacttgatgtttatgatcttggagtgaagccaataattactattttctttttaaaaagtatctggctcttagaaaattctaagaataatgcagaagtgcaagtaaatgctagaactattagagttggcaacacaggtaggaaacgtgcgcaattagaaaagaattgttgcagaacttgaagactgaggtttcaaaccctggcacagtaagaataagcttgtccttagggtaagccagaacccaatctctccctctcagatgtagtgagtctctaccatgtatcaggcagtgtactcagaggatgcagagtgagtgagaaatatccctgaattcagcttagcagtagagccagaaaggtaaacaaatgagtgttgtattaaatgcacttgcaaagtaccattgtgaaatgaaataacaggaacaataatgactatcatttaaaatccacttgttatgtgccagactctgttgtaatcactttacatctgttaactcatttaacctctatgaagcaggaacctttattatccccattatgtagattaaaaaactgaggcactgagtgtgaagtaactttcccaaaatcatccaactagacagtggtatagaggtaggattcaacccctattttttgtggctaacaactatacctgtcaggaaacagctggggcagtaggcaggggtgagagaggagtgagaaaagatggggatgggtatttcaggaaatgaaattaacacatgtaaaggcataaggagaatttgagaaagatagttggcgattagagacgaattttactttgggtctgatttcaattgctggtgtgatatttaggtgggaatgcctcactaacgatgtgggtatttttggagaagtcaccaggcattttctctctggcctctttcctctccatgttaacagtcgctctatagtggtgctccacatacattccatctctgtatgaacagggaagtagctgtcagtgaggaagatgtagtactgtcttctagccttttcctaagtggtccaattgctcattaagaatccactccaacttagtaaccaaacagtattgtaaatattgatactacgggggtattctcatgacccagttgcccccagcccttaaggaacttaaaatttagtgagtgacctacccaactgtggcagtatctgagtagctccttctaaacttagaaagatggggttaactaaggataaataattatcttcacagtttccaagcagaaattgaactgctcaaagtaagtgtgtaaatgtgggtgtatatgcatgtgtgaatatgtgtgtgggtgtgtgagtttattttctattgagatggaggaatcataggtaagtatgactgatctcatagatgaagaagtaaaaagcttcctagttattcagtgtacttaaacttctctgaaacttattttaggttaatgaaggaaaatatttgaggttcttgccttagaagaattgccttagtagtccctcccctaaaatgtttttattctgaccttgatgcaagagtcagtaaagaccatttcagcagtgattgtcacatatcaccttccctctaaacatgaagcaaagtgaaactataatctctccagcataggctgtttcagtggtctttcatgtaggaagctctgaagtaacaccagccccagctgtgctttttgggataactatttcataataagaaagaaatcatattttgagacaacagcaacaaaaagctgatattgtgtctgtggttctgttttgagtgccaccactgaattaaagctatccaaggaaatgaaacatcgaggttgggggaacattgtgtgatgtatgttggctgaaatactaaacactccagtataacatcaatatataatttgtatggttacaaatattattggcataaataattcatgctgctgctttgtatttacttgattaacagcgtctttgtcatttttgtcagtcatgatgccattgcaatcttgcacattgtgtttaaagaatactcggggaaatgtttcaactgtgtgtctggatggtataatgtatttattcatttagtcagatgaaatgaaagagagagtgtttaatatgcatgcctgcattatactagctactctctaaataaattacagacagtattactccctttcattgtaagaaaaattatagtttgatttttttcaagtagccaacatgctgccattttgtacttttaattacaaatttttgaggtttttcaaatgagctttgaataatcctgaatatttttgtattgagatgtcaataggaaaactttggtaacttgagtgggctatatcaagtgagaattgaattactctgcaaaagaaggtaaaataagttttctacttgtgggtgaatatacttctggaaagtataaattcttgtgacagagccatgcctttgaatttgcatcactccatgtagcagccgttgttttggctatggaagtacttcccagagctgccaactgtaacttcactggcattgtctattttgtccctcttccaattctctttcctacttcctggagcctggacctctggcctgtccaatgccttcccttgcagcacaccacccagcccttctttctttgattacctttccctctgtctttctcccaaaagaaaactccattcctacagctagtctctgcttgaggttagatttcatggggtgattgaagtaattcatgctcaggtttggatgactggtatcaaagaaaaccagagctggacatcagttaaagcagtacaaagagattttactcaggacctttgcaatatagggaaagagaccttagtatagaacagggttcaattctgaatacaccaagtggcagggtggagatttaaagccaagtagcagagtagggaggtcaatggatagaaaattactaagggagtagggataattcttgtttactggcctcacaggattctggctgaaggcaggctaggatgatcagatattacgtgggggatgatgggggctgaggaagatgatcacatagcaaaggtgagggattctgcctaaaccaacttgtcaggactcttgctaaaattaggcaacataaagacacacacggaagtccaaaagtcgaggcctggttgggaagaggatttagaagagcctgactaaaagtttggtcaatgagagactgtatcactgggaagcataatattctatgaggaggggttgtattttaaatgaggagcaaatcaactcccaatcaggctcaagttttgagacggttttccagaaggactcctcagagtgtagtcttgatgtggtgcaatggaagggtcatgctgaatttcttctgatgaagaatgaaagggtggctgaggctctggggccatcagcaaggcttgcaattggcagggagtggatatgaggtctttcttgaatattgttgaatccgtaggtcctagtacagaccctggcataaatggtgggagctcagtaaacctgttcaataaatgaacgagtttcacagatgaggaagctgacacatggagaacgtggagaactttgctctgtttcctttcacatatcagttaggtaaaaagttgcctttatttctcctgccctatctaaaaggctgtagtcactagataattgccagtcctttgctcatggatggcactgtaatttatccttacgataagatgttattaataggctgatttccatataagtatttagtctctggaatcagaaagatgaggacaaagcattttacagtcacactagcacatttttgaactcacgtccatttcccatgactggaacattcagcttatgaacatgtagccaatggagagaaggataaatcagacctgggagtctctgagttttgacttcaggctcctttcagtcttgccaagctgcttttctgaattaagtatattccctttgctgtatcttgtttcattttggaagagactggccctttactttctctcagaacctgctgaggcaggaattctttggtactgtattgaacaaagccaggtaaagagagcagcccttacaccagcagctttggctggatttctgagaacctcttggctcttcttagcaagatgtcaattctgtacttaccagttcttctaccgtgactcagattgagtgaatactactataaccctaagatggttagatcaaaaactctcctgtaatttacattctgaataataatttttaaatgaatcctttaaaaaagttaaatgcatcctaagaaatagaacatggatttatctgtgccagtttcttatcaagaggaaaaaatttataatgctgaaaatgccatttgccttgtctaggcttctcattataagagaggcattttacatggcaatctgagagtgaaatgtttttggattttacactggccaggctgttctgaacagactctgagtgaaaatagtcaaatatgataatcatctgctttggagaacagaaggaagccggtttaacttaagctggactgattttttaaacttggaagacactgacttctggtttctcaagaaaggccagaggaaggaagtgttttcaaggcactctataattttttcagattgttttaccaaatttctgcttggttccttttgtataaaatgtactctattcctgcaaaggctcaggttttcccatggaagcatgcagatttcacaactctgttgaatgagataacttggcaaatctcacagacgtgcagtggagcagagtgacataatgaggtctgaagaccctaagtaggcgtttcaaatgcataaagaggagcccagtcattctctgtgtgcccaggtgacagcctgggttgggggcaacctaaggaagagtcattcctctctactttgagaaaagatgaaaggaaactgagagggaaagattcctccagaaggtgtttgctttgttttcccactcttatgtattagaccctaatgtaggctttttttatttaaaataatattggaatcctttatctccttagcagttacctcctgggaagggtggtgaatgacaatttaattcctggaaatgttagcagcttacaatacttttgtttcattttctaaaactcaagtccacagtcctttgtcaacaatgatctcaactgtggaagagaaacttttcctttcctgctattttcttcctttttctcttctctttcctcctatcttccccccatcttttcttctttccctcctttttttcctctctcaaccctgacagcttcctgggcccgtgccgcatttacatctgccaccttttgattctagattgcatttggaagtatgctgggccatgtcatgtatctgaattggaggtgccatgacagcctggccggctatgtctggggaccccaggagccatgggataactgaacagccaactgcagattcttatttgataattctttcccttctcatgattttaaaaaggaaaaaaaaataatgcttatttaaagcaatcactagtgactcagatcaaccctccttaggactcaaccactgtccagtctctttttaagattccactttccctctgtttccccagtaaccttgattaattacattaatattggcttatcacatccctggtagctttcacaaaatgaatcaccttacaaagataattttaattaccattcccttgcaacctttaaccattcttgcatatgtattttgttggtagcatctgcttgaattgcaaatgcaaagaaattaaacactttaagagtggctttcttccagttttgtttttcaccagttttgaaatctctgtctgcccaaattaatgcaggtctgagaccactcagttcatgtaactacctgttgtgtcattaaagacaaaagaatccagttccactgagaaggctcttctagcctgtggctcttctaaaaagaagtcagtgtaggttttgaaaatgagcatccacacatctttaaaatgatcattgtctgcttagaaatcctatccaaattggtcctaagtcacaattcctctagattttctcctattatttgaaatattttcagtttttgattcttcaaatggcaagcagctgtgccaattttcttggattttgtcatttgccagctttttcttttgaaaatacactcatgcaccatattctgcttcctggtgcctacatttggggagtacccgggttcactttcacattctcaaattgcatgagaaatagcaggattttcccttcttctagtagatgcctaatgagcactcattttgtgtgccatgccatgccacgtggaacttctggtcaaggtgttccgtaaggaaagggtgactgttctcagtagttggcagcctactgggcctaatacagcagcctctgaagggagccccgccacccactacctctctcatggcaggggtctgaaataccatgggtgaactcggagaacattccacagtgtttctgggcctctgtctccttaactgtaaacttagttcatctaaatgtatctccaagatccccttaccattgcagggctatcgcttccttcttctgtgttaagagattatccccctttaaaacacaaaattgtactttaagctgtgcacattcattgattccacagcagaagcaagcttatagaatttctaatttgagagcttctggagagtgtgagggaacccgggatgggggccttagaaagcacctgcagacaaatttccttctgtttcacactgctcccaagtactgaccagcctgaccaacatggagaaaccccatctctactaaaaatacaaaattagtcgggtgtggtagcgcatgcctgtaatcctagctactcggggggctgaggcaggagaatcacttgatccccaggaggcgaaggttgaggtgagccgagatagcaccattgcactccagcctgtgcaacaagaccaaaactccgtctgaaaataaaatatatatatatgtgtgtgtgtgtgtgtattatacgtgtatacaatttggtacgcaatgtctatatgcaatgatgtataaaacatacaattcttttcctagaggagtgaatagtgaatagtaagttcagtgagggtcatagaaaagtgaaaatatattacagtatttctgacaagagccattattagaggaaagcccaaaggagtatgggaggccagccaggtaaggggtgtatatatatatatatatatatgtgtgtgtgtgtgtgtgtgtgtgtgtgtgtgtgtgtgtgtgtgtatgtatatatatacacacacacatatatatacacacacacacacatacatatataaaataaaatctcacaaactccgtagcatgcctcaggtgacctggtcccagcttttacctctctagctttacagctccctgcctcacacccagtactccagccttattaaaacatttgtgttcctgccagtgtgccaggcctctgcccgccctgccctccataacctcctccaagtctcagtttaagggttgcttccataggaagcctttcctacaccacttgctccatcctagggtaagcaccccttacctggctggcctcccatactcctttgggctttcttctaataatggctcttgtcagaaatactgtaatatatttttacttttctatgaccttcactgaacttactattcactcctttaggaaagaatttttcctaaaggaaaaattcctaaaggaaaagtatgttttatacatcattgcatatagacattgcctaccaaattgtaggtgttccataaaaatgtgtcaaatggataaatgaataaatggagattttttaaaaggcaacatcattgaaatttgaaaaccccctcctttttttctctcaaaattgttcctctctgttgacagagttgcagtctggtacagtcagtgtaaacgtcttatttctcctaatgcccttccttaacctgctctgattcttgatttattccaaaagttaaatttgaaagcctttgggcatgcaaatcccaattcatatcctcctatgaacaaaactccctatgagtctctggtcacctggcagagttttttttacaagtagcatcacatatgtcaacactggctctactaactaaaatagcactaaaaggtgccttggtgagaatcccatactttttgagctggaatagaccttcaagtttatcccaacttgcttgtttttaaggctgggaatagcctggtgaattttcaagatgacagcagttttcagttggaaggcttttagcttctctttaggctagcttacctggacagtcaatatggctttataagttctatgtgtcagatacaggcatgataatgtccagcactatgaaaagggctgtctctttctatgagtgtttcatcagaagggaaaattttccagacacctccaatggatttttgcctcctacttcattgacccatacaggtcacaaccaccccttaaaccagtcacttgcaagagggctgggattatcaggatagaccaggatttaaacaaaaaccagaaatagtgtggttttattgaggcatggatattagaacaaaattgaggttccctcatcaaggaagaagggaagaattttttctggtaggcaactgactgcttagtaaaaaacgaactggcatttttttgcagttcttcataagtatattaatacaactgctttccacagtgctttaaccacagagctttgcaaatgccactcctcttgagaagccaggaaaaactactccaagattaggaatgggcagctttatttctcacttgttgcttctgttctgaatgcctgaaagaagttgcttccagacattgatcttttatctttcagagtattttaaggagctgtgtagaatttttgtttgatttatggactctgggggacaagacaaattgagatgtgaaacaccagcttttgttctttctgtcaatctaatcactttcagatgaaagtgatgaagaatgacattcaggctgatatcacagaggaggtggagtggggtggggtggggtgtgatgtgatgggaggggtacatgaggacaggcaaacactaaatctggttgttttattaaaaaggtcagtgaaatcaaactgagcagacagtttttctaaacaaaacgaagggaaggtaagcctctaggtctaggtcagtctgccctcactctagcatggttcatcagcacagttgtgaaaactcccttggagaggtgagcagagtgaggccactgtcactatcttgctcccagtgacccccagagtggctaaccactgaccccgctgctgggttaggattgaaaaggttataaataatagtattcatatttgatcctagttgttcataaaacctggcgtcttgttatccaggaaacagctcaaatgtcacctcttcacagaggatttttctacccaaaccaaagttttgtgtctcctcccggcaaaccatccagcccttgtgttttctctcctgtttgattctctgaataacacacatcattatctgaaatggtctgcatttgtttatttatttgttcaaacttcattagaagagggtgcctcgcccattgctgtagccacaccacctgaagcaatgacccataggattgggtgctcagttgttgaatgaatgagtcatatttatacaaggaagtcatactctgtacaggaagacaggaaattaaaatagatttctttacactcggaattatgacatggctgtttgccttgattttatcaaaaatgatattcatttatccatccatccatcatccatccatccaaccaacaaacatttcttgattacttaccaggaattatcattcctgctggggttcttgtttgaaagtagattgacatttagtagggaagacaggcatgcaaataagtaagtgggaagttgtgactaaaattatgtataaggagaagaggaagcaatcgattttgcttggggagaaatatcaagaagacttgaacacagaaagtaatgcttgggctggatcataaaatatgtatgtctgtttactaagcaaaaaaagggaaggcaatcagcatgagcaaaggtgtaaagatgtggcatagtatagaagggtgggagaaatgctatagccacaaagggcaagagagtagccttgtatgggtgaaggtgggaggagaggcatggcaccaaagctgaggctggagaccaggcagaggacctcaatccttccacacagtaggcttttgatagaggaagaaaggagagccgacaaaatctctttgaaatgtgactcataagcttttaagtaatctgttgctagtggtgataggtttttattaaaatacctaatgtaagataaacctttatataagagaaactttaggaaaatatttgaaaataaaatttgcaatatttcggtaataaccctcgttatcttgtgagaagttacttaggaatagctttaaacaactagctttggaaaaacatcctatttgaccccaaggaattttgtaaagcattttagccattaaaggaaaggaaggttctattgagtttttaaaatgggctgtgtgagcccatttgtttaaactaaacactgaagtgtcttaggttttaatgagcctaactgaaaatttagctaaaaacaactcattggaaaccagatggtgcagccaccattgtgagctgagctcaaaccccttgttttctcaagagcatgtcaatttagctccacagaactcatagtacaaagatgctattaattatgggagcctctgtaccctagtcactctctccatccaccccggccaaatcaacacatccttcccctcttggaaattaatgctttcattaaaatgtgtgtgtctcttggggaggaggtggggatgggaagggatgccatttccccaggttttcatctgttagggaaaaaagttattcagtgacactgggaaaagcacagtaaggcagactttattcaaggtcattgggagaggcacaggaaccattgcaatagcatcttgcagcgggagagaaataatggcctcaattttgaatacagcttgagcaagtgggaatttatagcctaggtgctgtgtgggggttagcaggtggaaacctactaagaggaaacttcaggattaagggggattctggctaagcaacctaacaggactcttgctgaaaacaagcccgggtgatcagacatcacctggggcatggtggaggatgaggaacataatcagataacagggattatcagctattgaggataggtggttctagctaaactgacttagcagggttcttttgctaaaactggattttacaaggaagtgcatagatgggcctaggaggagattcagaaggctaactaaaggttggacaagcaaaggattgtcacatcctcttatatggcacgcaacagccaagctctgcactacagattaataccttgagggctttagtaaatgagggcaagaagagggatgtaatggatctcttgaagagcactgggtgagggacagacaaggacaatgaaacagacaatgacagagttcagaattatgattccatgatattataaagggtgcctggcttattaagaggttgtgcttttcagttgtggataccactttccagttttttgccttaatttctattaattctttaccgttggccatgagattagccaggcaatttgttttctcctccctctttttgtatagtaatctattgggttatttctttccatttgtgagtgttaaggtctttccaacgtgagggtgaagcaaaatgtaaggcactggaatcctttccaccttctttgttcaagggcttagtgttagaggctcctcatatcttcagtggtcctgactggactcctgtgaggggtcagcttctaggccaccaggcagagtgttcaggaatagttatcaattgccaatagacaactgctgactcttacttaaccctaaaacctgagtcttatcccatcagccgtgggtgcgttcctaatggcgactcttgaaagattcatgtggctgccttctggttaaaggttatgtttaaatattaggtctgtccttccaactttttgtcaacactctgcctgaatgtaaagtccaggtttgagatttattcccccaacatttataaagtacacactatgtgccatatacacacacacatacactctctctctctcgtgtgcatgctctctctctctcttatataaaacacactgtccttgactttgtgggatgtaagctgtgcacaggaaaatcacaaaatgtagattattacagcacactacaaggttgatagacccatgaatatttgtaaggagaagtcaaatttcagtggcgtgtttgcgtgtgtgtgcgcgcacatgtgtctgattattttatgtgtgtacatgagagagactgaacttctgagcagtccaaggagtaaattaattaaattggttactgggattataatgagattatcatcattgaattgtcttagctgatacttcaccaataggataaaccccacttccagagtttcttagagggtcaagtgaacaggaagaaaaattatgggaaccaggtggagtgggcagaaggagggcaggtcctggcatggtgtccctggaagaaatggagcgaagtcctaaattgggcctgacttggaagagcttcctttttatctattttaagttgaaacttggctgaccctgaccaagaggagtctggacttggcttttctttactggtctcgtgggttccttatgtagttgctacaggcagttgtgaggagagcctgttggcattcctttctttgattgacatggggcattggaaaaaggtgaggggaattagaaaacagctagaagaagaaacaaatgagtcatcctcccatctcctaggcctttattacttgcattttctctctgaaagttgattcaggtcagtagggaaatcattagtgagatagtgtagctctttaaagatttcttacttattgatgctgaaggccctttgtgatgtgcattttctttgttctattcctccacagtggtaggagttctagataaaatattaatcataaaggtttttaaaaatcatttccaattgcacagagatattaggagttatggccacaaagccttggtacagctatattttactgcccacgtgtcttcccagagatgacacatacgcttttcattttgctgtcattattcttcatgagatcgcagggcatccatcatcactgtggtggaaaaatgaagatgagggacaaaagcaccagtctctaagcacaagatgatgtgtttgtctgtagtggctagggacaatctccaaatgcaggaaccataaaaggctctgtgacttgtacctcaggaatgagattcatcagcaatgaaatcagaatctcaacagcagtttgatattgagggattttgagaagctgtgtctctgtccgcatgtgtggaattccatccccacgggcagtgtaatgccatcagaatctgagctgggatgaaaaagtagcctgctctccagaaagtcacatcaagtgtggcttagtttatggcaaagatgaatggggtgttgatgtcccaagagaaggggatcttggcggacagtgcttttggctctttgttgctggtgggaaccccagctaggctttgaaagtggcatgggttctcaagtacctgacatgttcttcatgcttttattgacgttagaatgttgttttccattctgagaagccagatcacaaggacagagtgctgtgatgagcataaatactatcaaacaaggtctacagcaacagcaatagttattatgtcatgaacatctgctttgtatttcacaaagactctgtcccagttcctatctgagatggggagatgttattctcagatgaggtgactgaagctgagagtggttaaagtgtcagggtcacatgtctggtagggttagagctgaaatttggactcctgtaatgctaagtaaatttgcatgctgccatgatggccagttacatggaatcatttaaacctctttttacattaagcctgtggaaaatgaattcccagttctagagtaccgcctgccctggttctacagcatggttccttgcttcttctaagtctctaggaccttggcagagtagcatacagtggtgagcagtcttcttttgagatgaaatgggcccagggctgcctccttcatgacttcattgttcctctctcggcctgtttctgtgcagccgcttgtcatgtcagttccactttaaaaccagagtaaacagttcttaataggtgctttttaagtttaaagaaagatggaaaggatgttcagacctagggaagtagacctgtctctcagcaggtgagttattctgctcctgatgtttttataccaaactgaaaatatacagtcacacactcacccctggggaagtgcagaggactctcttcatggggggccagtgttactcttctgtcctgagtgagcattcagtttattttgatccctggcctcaaactcaaataccctactgcagtcaaaaagaaactcccaagtcagaatggggatggtcagaattcatccattcctgccagtggtaataaatggcttctcttttgggtcagtaggaagtaaattggatgactcctcagctagtcaccctttgtaaagttctttctgaccttgaagcttagaggaaattggctggagggcaaaacagtatttcctaaagtgtttatgaagtagctccccatgattcttcatggccagcactctgtcctttgtatctgtggctttgttttttagtgttcatgaagtattggagaaaagagttccccaggcatctcgtttggttaagaagattgcatctccccattgggacatcctggctatttcccagcaaaatgctctgcctccctcgactgtaccacataagctaattaacctctttatcgattctctttctccttattttaatttcagctggtatttctctaggccctgggccttgggaattgtagactcatttgttgaacttctggcagtgtgaaaatttctaatagtttgctttctgttcccatgcatagtgaagtaggcatcaaagaaaataattgatgaaaaaaaacaaggcttggaaaaaccccgaaacaacagccatgctcaaaagagggaagaggaccattgggtacttattttttttttccttgttgggagctgttttccttcttttccctctgtgtggcaaagtagtaaatggtcgtcttattagctgctcagaatactttattctataattctatatgtttctgtggttctatacaactgccttcctttgagttcctcctggagaactagaccccttcccccatcaccactaagccatacccacaatcaatataaatccaaggagatgggatgaatttcaaaaccatagagggcctagaaagtagagaaactgttgtggcatttacggctcttcaatgtccttccaaacagaagaatgtttctgaaacactgagcagcagccacacctggggtctctaaaggcactccaggatatgaaccatgacacctgataatgtgcaacaaaatgagctttgttcttttgggcctgtggcacaaaacattcctttgcccgtgttcaggcacctcagcttgaattcattttgtttactgactaatcagacaactttgtatttattctctgctgcttttgaagaggtggtatagtggataagtacttaggctaccttttttggaaatttgcctctgcaagatgctttaaaatctgttgatgagcaggtgatgtctaggtagtgaatagaaaaatcgctttagcttatatccggagtttgcaaaacaggaaactttcaaaatgatttgtagtttgattctgaaaccatcttagctctagctaagatggttgtaaccagacagcatttgtcacccagggagctttagaaaaatctactgtttcctcatggggagtagagggatagattttcaagaatctttttggttcatttgaatgtgggattttccataacctaaagtaatgattaatagtttctctgctcatatcaggttttgttggccagatgtttctttcaagaacttcaatcctttattgtctaaattgaatcagcatcagataaaacatattgcaacctcaaagtccattgcaatccagcaaaataagatgtggttatgaaccaaaattagaggaagaggctaggatggcactgaaaattctaagtgattttcagatatgttaaaaatggctttctcaaaattttgaatctttggaaaagccatatgattaatctacatgctaaatccctttttattttacttctcagaacacaattcccaaagccattaccatactccaaattataacgtttatcttgcttattcaaaaactgtgaaaaatcagatcatattttctgaaaatagcttttctgtacttatattttgcatatcacttctgattatgaaattgaattaaaggaacgagtcgctattgtgttatctgcccacagattattgcaaaatgatagataaatgctgtactactaggatttccatttagcccttatatgttagctgtaaagggagggatagacacatgtatctgtattagtagttgggagtcttcatccagtaatggaaattggatcagtaatgatcattgttttctgccccaaagagaggcttataggattattaatatgaatactacaaaacatctgggtgatgcttgtatctaacagtttatcttggtgatgtatatccagaaactgaatttacagttgcaggcaggaaatctgggtttatatttgagactctgctttatatggggaagggtgagcaaatattaaaactctaaaaactgcattctccactgctctaggtaaagcctaaaattctgtaaattagttgatcattccttcatcttgtagcagcctgatagaggaagagtgtggtgtggtctttggggtccgaagaatttggagaatggtccttaagaaaatcaaattatctttttaagactatttggggttttattctgtaaaatgtctttagtaatagacacgctacattaagatcaatataaatgaggtatggaaggtctttgttctgttgttccacaagtactggaagttactattttcttgctaaaataaacattcttaagaaaaaaggaaatttaatattaatcatttgcactttgggatgaattaagaatttaagagcagatattaaaaacactaaatgtaaagagggctttaaatggctggttgtctgagtcatgtccagaaaaatggatcctgaaagacacacttcataattttgctagttgtgtgtttttatttaaactcttgaaggacagctagttacattctttgttttattgatttctctggaagttttaatatgtagaataaagacatttcctgctgttttccaaccttcaagaatgaatttttaacttaattttgtgagttttgctctttaagggaaagagtggctagatttgtttgatcagagtttcccttggggagggtagagaaacggtgatctgttcagagaggattcgggagaaggtaatatgtttgttacttcaatttattgtagggtcttgatggtccatgcagcctaaacttcctagccgtgacatttgagataactgggggtggggtgggggggggacctgtcttctgatttcttttcttttttttttcaggcagatctatgagaaaggaggtgaattcagcaatttggtcacaagcttaaagggagggttgggaggcagaggagcaagttgagacctcatcacaggttttgcttttagctggatttatcagacaaccatatgtgagagtgaaagaattaagccagagtgaggggtgcctgaaatcagagacctttcgcacctcactgaggctgcaagagggacagctttgaagtcatggtttaatattcccagatactttagttatttcttttttttttttttgagacagtcttgctttgttgcccaggctggagtgcagtggtgtgatctcggctcactgcaagttccgcctcctgggttcacgccattctcctgcctcaacctcccaagcagctgggactataggcacctgccaccacgcccggctaatttttttttttttggtacctttagtaaagacgaggtttcaccgtgttggccaggatggtctcgaactcctgacctcgtgatccactcgcctcggcctcccaaagggctggaattacaggcacgagccactgtgcccggccctagttatttcttaaagttgactaagagtggtttccttcggccccaaaaaactatgcattctaaaacatgaaatgcttctctacacccctactccatttaaattttctgaagtgcccatttttcctgtcttacatggtgaaatcctagctgtttatttttatgttcttcaagatttagatggtgtcaccaggaaccgagtgctctccccattccactaccccatgattttcttacaaaacccagattaagtttctcccagataaacagataaaactaacctagctgatttcttatatcaaagttaacattgtgaatgtcaaagaaccaatgctatgcaatgatgtaaaatatcgctctaatttaattcccactggtaggccacatgtttgcttcagtattttaccttctaagctgggagaacaatgcagagatagcacagctatattttaatatgcatgttacccaccttgaattaacataaggcagcttcctaatgctataaaatggaaatttatgacactttcagatataatgtcgtgcacacgatatgagtttttggggtggttttgtttattcctctcttctcctcccctcatttttaattacatctgcctatataagtgcacagttaattttcatcggctgcccatatagcttgagttttctacttcttgtgttcggaacacttatctatagttaagttttgaggcttaaaagtcagtcatttatttagcacctactgtatgcccaacaggttgtaactaactggtgaacataggtaaaatggaggcattttctcacccacaaactgcttgcaatgaagatgtatttataggggaggggaaacaatggctgaaggtaacataggagattgttttggctgttaagtaaagagatatgacacacacacacgcacacacacacacacacgcataccagattttatctatgcaaatgaacatttaccttagagaattgcacgtatttccttcaaaaatgttgcaattgccctataaatttgggagctactttcttttggtgatgaaatacacaaaccacaaaatttctttttggtctgttatcatatttactttctaacagttttatccaactcaatctttcaccttccttacccgtttagaatgatattaaatgtaaaaaattaaatatactttttaacaaagatgagccatattatttttctatattcaaagggatgtgatgtaggtaatttcagaatgatttaaacatcaatggtattagtgcctagagacaacattcattttgagtacaagttttgctagttttgctaaataaaattgggtacattatttatattaagtatcaaatagtgtatgtgtggaatacaggttcttgataattaggccccaactaagtgcacatagtctgtgggtctaagttagatgaaaaatgtcctaataaggagcaccttgcaatggcccttgctctgtgcttcagccccagccaacttgcccaggacagaggaactcatcccaagactgtggcaggaaggttgataactattatggcagtacctgtttcttacttctgggcctagctatcagttcatatcatccaagatcattacccaaacatgtagacatcatctcaggcctctaacaacacaagtagccagcctcattttagaacacaccagaggactcttgacattctaaattgtcatcttttaatggactcatcccttcttccttctttaggaagttctcatatctgtgtcccggtctctgttgtctgttcctgctgttctctgctgtctgtatctgctgttcttcccagaccacaggcaggttccaacatgtgctttaatttagtctcatctctcataggatgttgcccacctttaacctgtctggtagttgatgtgtgtacatgataccttttgttgggttattctggttttccttctgctgtttagatgagagcttcagtcattctttggtcactcaaacactttcagacataataacacactaggcttgtgaccatttggtatttggggtctttgaataatgtacactgtattttgacagtggtctgggacaccatcaattgataattgttgcagcagaggattgcaagataaaaacaaatctctgtcatgaaagtcagaaatcccaaatgtagaataataatggaagtttgtagcatttttagagcactatatggtttacaaaactttcacattagctattttagttcttataacggccttaagtatcatttctctgattttagtgtggaaactgagatctaaagagatctgaatgatttcctcatggtcacacagccagtgagtgacagaactgaaggtatctgaccacagggcctgtgttgttcccacctcccacagctgaaggagttggagttcctacttttctctgagctagctgcatggctttagagaagtaggatggaaggggttaatatcagtggacatgaatgtctctaatattcttcatttctaattttttaagtctatcaggtttggacacgaaatttttaaagggcatgatttagatttctaggaatccctgtttctgaatattttgggggactagggcttaggttacatcttggaatttttaaggtactggagctatttaacccaaatctcactaccacaaagaagctgtccatccatcaacaccattttcccaggcaaacaagactgggtcagtctctccaaggcctgtcccatgaaaattagagggtgctggcattaccagaaagcaaagcttccatccaggtatggatgagctacttctgagaagggagtaatcagtatggactgaagtaaatgggaattcttcctgaacatgtgccatcaagctatagagcagaagttgggtgaaatttgaaaggcggagtaacaaaggcagaagcatgcaggcatcgctaagagcttggccttaccagctggctgactttgggactgtgctttgctctcttcattagtataatgggggtggtagtagcacctacttcacatgggcaatgtggggattaaatagtaatcatgtaaaaccttagcctgacaagttgatatacagtaaaagcaaactattagttactagctcagtaagaaaccaggatagctaggaacagttagggagtctaggtaggttgggttgggtgggttggattggttccaactgacagggaaagacgctacttgcctcaagagtggatgaaataaatagctatggaataactgtatatgctttcctgcaggctcctcacttaatatatatcgtacaagacagtaatagctaatatcataggcagcaaatttgacatttgttcatttgtctttttgtaatgaattatttgaggtgaattatgctgatgtgtaccaccatcattccatttgaatatgtgtcttaatgtataatgtcctaagggctgcccaggactggtgagcagtaactcactgcaggaggcccctaatttgccatttccacaccactgccccatccctccagcccccttaagttggcagcaggccactctgtcttgtctagtaatggtgatggagagcctgagtgattcttaatcaaagaaaatgacaactccatttacatttgtacagatctgatattcacatttggatgtatgcctaaaggtacctgggttgaaaatatgtggtgtaacattgctttatcttcctaaatcatcctgacacagccttggacttaatagggagtgggacccagaattatgaaataatagcagacatgccactggaggctgaaatttatgttttatgagataaagtggttcttaactatttttgttgccatgttcaatagctagttacttttaatgtttctataataagaaaacagtatgcaaagatacactttaacagaatttcataagctcctacactatgggtaataaccagagttctgaaaataaaaccgttactttcacttgcattttaagtcagattgatagctttctttcatttataacgtcgtcctagtctgaaagcaaaatcaccattttattatttcttattcaaaggctgaaagaaaaaggtaccaagtaaaatgattttgtatgacaaggtcaataagacttggcagcaaagacttggattgaaactttagccttgccattaaccagctgtgatgttgaataagtcatctagtccttgtctcacttgtaaaatggtataatattgatactatagttatattgctattacctggaatgacaccccactcttattattcacaacctggactttttatgacccaggtctgttttgcttttaaaatcttaaatgtacagcatcccaatcttagaccacagcctttgatgcttccagcctgtactccctcacaccctacacacctgttctttgatgttgactaagccctcgggtcttttgtcagtctctcagtccccatgaaactttaataacttgtctctccagccttgggcctcatgatttcttagtttaatcatttttagccaacatgtactatctcctttatcctttgttcttccataatatccaccttgcagaccccttccctaaggtcagtctagctgtttatttttctgcatttgggctgcacagctcaactcagcactgcttaataatcaactgtgtatgtacctgctcagttccttctcctgttttccctggaatagttgctcccaatctccaccactctcctctcctcccttccgctgcccctgccttcattgttctccacaggtgaccttcttctatgccttttagaaaaactggagccattggacaggtatcccttattgggtaaatatcccacaggtctccctctgcctttcttctcaaactcatcttcttcccacattcttaccttctttcatcctaactcaatgtaaagcttttccctctgtgtgagaggactcctcctgctgtttctgttgtctcctcccttgcccagaattgcccctttcctcccagcctgcagtcatcttcagcgagacctcaggactagtttcatctcttttcagaccaagcaacttttttctaccctctttgcctccacatagtcacctcccattttttccttcactctatacaaactgatgtctgtccctgcattgctgtgtaaggtcccaggggcttcataattgccagattgaatgagctctttttagtctttatttcacttggtcttctgtagcactggctctgaccataccctcctttttgaaactcatcacatcctccttcctgaaactttctctttccttgatttgcagtcatattgctgctttcttttttcccacccgctggttgttttttcttggggttcattgcaagtccttctgtctctgtagactgacttgacctcctgaagcccagtcttctccactggactaatggacacatctgtctggatgtctacccggcccccgaaaaccttgttatgtccttgactgaagtcacttcctgccttcttcatgttttcccgagtcttctgtctcaaagaatggcactcttacccacctagattgtacaagccagagatgttatcttcctggaggacttctgtttctctttcaattctccaaaacaccatctacatgtcctgttgattctacttatttattctttggatctattctcttttcactgccagcctttgtttcagatcctgactggattaatcatctccaaatcttggtagaggacagatgaactgcaatcctggatctgagtggtagcgggtaggaaggtgggcaaggagtggggaagatggtgacagggtgacctttctggaatccagtctgatcttgtaactcccaagtgtaaactctttaacatcgtactccttacgtgacacaggaagctgttcttcattgggactttgtcttctccaattgcatatcctgctattttctacacacatgtgatgtcatagccatacacagacttaagcccttcctcatacattggccagtgcctttacttgttgcttgaaatgtccttccttgtcttccccccagtcttattcttctgatcttttaggactgaattaaagtcctacttttgctaccatttctgttcagcccagtctgagttggttgctctgtggaacttttggccatctgcgcatcataatatcaacttctcaagcggccagcctcctgcaaaccttgtatgtcctagactgaagtcaccgcctgccttctgaaaactccattttgagaaataatagctgaaaactcaagatcttgagggaaaaactagtgctagaaagactaagattgtaagtgaactctgaaaatattttcaatctaatgaaagctcttagaaatattttttttgtttgctaaaaggaagcaataaagaaaatgcagaagtcaaatgagatgctgcctatgttaaataatagatactttcaacaagtcatctaacttctttgtgcgtttccttatctgtaaaatgagggtaacagcataatgggctgtgatgagttaatgtgtgtaaaatgcttataacagaacctgacatagtagatattagctattaataataatttttcatttaccagctacaaatcttacagactatctattatttccagccctcctatttttgctgaggtgattagaatctgttttgttttgaagtatgaatagaaaggcatttttttttttttatctggttctctacccaagtgtcagtgggatctaatttattactcatggttgtggagccatcttagtttccactgttgtctcaaaggtgtatctttttctttgacttgagaatggctttgggattctatctaagcaaattaggctcagggaataaggcagaacaatccaacctttctcaccctctcctgcagcacactcgtcttcctccctcactcacacatagctcctttccctctatctgaagctgcaccctccaggccttctttgctttccttcctgtgtgttttcaaggctgccctacacaagcatctacttccgttcttcatctgctcccctcccccaagtctgtctgtctgtctgtctgtttctctctctttctctctctcttatttccaataggatttgatgttgatttacttaaatcaaaatagtcataataccgaaaatgtataacaaaagaaagtcatgattataagttccatgagggcaagaaatagcattttattcagacctgcatttgaggcattcagtagtgagtaaattcttggacaaaggaaagttaccagaagcaaatgagatgatctatagaaaagaaatatgtaaactgtaaaaattagtacacagatttttaaaatcaatctattcttcccctcttccatttgataatggtaacaccttgattataccaaaatcttgaggatctatttttttttttttttattgttaaagtatcttaaaaagatgtcccaaccttcctgggtaactctggccctttaatcaccttcacaaatctactttataataaaatttaaaaatttatggtttaaatgttgtttcttttatttttagtatgataaggtgatcagctgttctggtgacattcatgtatttgtatgttattacatgtttttttatcagcccattcctgaagctatgaatgtcttgacagttttacccaattgtgctgtttatcaaatcatttcagatcatgctcaaagcattctctaaattctctaactttgatttaggtggtggaatttgttttaattacatccttacctaagttgagtgttgaagaatgaaacttcaaagtctttgttttatagagcccaagtccctacacagctggcacctttatacacaatggagatagaagtacaacacgtctgaactactgcatcctttattcagtcttcttttttccaatcatttgctttaatactgtatttcttgagggtttctaagagtattggcatccaggaagaaattgctcatgaatcattattggtatagttaaatgcaaaatagcagttatgaagtttatacaaatctttttcagtagcttcattgctcctttttcataatcttgtagtaatttcaagccttttgttgaaatctagacaagccctatgatatactccttattaaaattattaaatttaaataattttaataataaatatataatatttaaagagaagcagtaagttgtcatcctatcactattgagttgatttttctaataaagtatatcaaatatgggtgtgtcaattaatgaaatacaataatgaagttcatttctatctcacctttgtaacatagaggccgatggattaaatttcgagttcaaaaacatgatagttttcttaatagtatatttacttaaagccatggtagaaatagtatgtgaccagatgaaaagtatgtactggctaatgtattagccagtacaaaataaattggaatgcagcaaatcccttttttgctatcatttattaagctctttgagaaaagtggttttttcccccagaataagtgagtatgtttgagaagtattagaatcctgatttttttgagtaaacgagttctctcttgagaatagtatagcactaagtaagcacaaagttaaaattttatttctggccgggcgcagtggctcacgcctgtaatcccagcactttgggaggccgaggtgggtggatcacgaggtcagaagatcgagaccatcctggctaacatggtgaaaccccgtctctactaaaaaatacaaaaaattagccgggcgtggtggcgggcgcctgtagtcccagctactcgggaggctgaggcaggagagtggtgtgaacccgggaggcggagcttgcagtgagccgagatcgcacgcctgcattcccaccccggcgggcgacagagcgagactctgtcttaaaaaaaaaaaaaaaaaactatttctgtctctaaaaaaaacaaaattgcagtcctcttcaattgttttctgcacttgagctttttctcgaaggaccttacaaagtaaattaaggaagaatactctggatctaacatcgatggttctttctcaatgagttaataacggtggatttcttttctcacgatttttctttaattattatgtttcctaaaaccacatatattgaagattttcttttagtggtgtcttcccccaaataagatgccatgagttgatcttggccataattgatttggagaaagcctctgaaaatggaaccaacagggaaaaataaaaatacatatttttataaaccttcctctaggagtaaaatccattaaaaatgaagctaaatttgttgtgtgagaaatgtaaataatttaataataaaatcgacttaagactcaggtccctcagaaatgaagacagtgctttatatataatagctgctcagtaaggagtctatgaatttaacttttaattaacagggctaccaacaggttcaaccccagaagatgccacttttatagaaaacaatgggaagggtgctttttggagttgtgtaacaatgtggcttgtgagttggataagaaggtgttttttttttttaatttactataaatattatgttcattttatgtgaaattagattttcttcataagacctttctttgtaaaaacttgaccacatatcaaagggcactgaaatccatttcaacttacagaaatgatgccctttcaggaaatttttattggctgcccttttccttaatagtgtaatagtgtatgtatttatgatatgttgtgaatccctgggcaggagttgtcaaggttagacaactccactgaaagtggagttcgaaagaactcaccttatccggacactcctgtttgcatttcagttctggaagggaaaacaggcataacaagtatttctatttctcttcttcatgaaaaccatgagagctaaaaagatttgcctagagccttattgaaaaattgaaaactgatcaaattctaaatagaacttatgtatttttactcctttagctccactgcatttattatttccaaagatttttttatgggttctgaatttgtttcctaaaatgtattcttctcaaaaagatttttttatgtttaaaaatgtaaaaacagaaataacatgtttaagaagtataattcaatcttttaaagcatcatatgtataattgctacatatttttcagtactcaagcccatgaaccgttgaatgctcatcagtggttaataaatattgtgttattattggcattaaattaccatcagtggtttattaaatctaagacagattttctggttaagagttcctgggatatcatgaggtatattttaatgactaaatccagcaattcagttattttgcttatatgagcgccaattttattttcttaatgtccctcatgcagacagaagccaccagtgaaataaaccattaatgttgcaaacacaagactgctgagttaaatgataaaaaaaaaaaaatgcagattgatactgatcttttggatcctaggcaagtacctaagacccaaccaatgtgattgaaatcagatactggcaactaggttgaaattagacttgatattttcagatcaggtgctgttagaagagatcctgcttatgagtctttgaccatatgcctacacctatttcacaattgaaaatgaggaagaggaggaaggaaggcaattttcgtgttttgtgcaggtgtccttagctgactgaggtcttaacagtttaggcaaattttccgtctttccatatttatgtcagggaaagaggatcaaatgttctctttggttcaaaaagcacagcctcattcttttttttttttttaatttaagttctagggtacaaatgcacaacatacaggtttgttacatatatatacatgtgccatgttggtgtgctgcacccattaacttgtcatttacattaggtgtatctcctaatgctatccctcccccttccccccaccccacaacaggccccggtgtgtgatgttccccttcctgtgtccaagtgttctcattgttcaattcccacctgagtgagaacatgtggtgtttggttttttgtccttgcaatagcttgctgagaatgatggtttccagcttcatccatgtccctacaaaggacttgaactcatccttttttatggctgcatagtattccatggtgtatatgtgccacattttcttaatccagtctatcatcgatggacatttgggttggttccaagtctttgctattgtgaatagcacagcctcattcttaactgctacctgtaaggtagatctgttggctgctgctagcagaaatatatcttagagatgcagttacctctgcttctatactttatattgctaatatttaaataaagcatatatatttacagaaataaatcttcctaggtggaaaatatattctgattatcaggcattttaatttacacttctgttctttattctttagagagaatttaaatagaattttaaaagagagagacaatatcttattgtttgcttgacttatatgcaaggccaatatgaaaggaaaatacaacctggaaaaatcttgggttttttgagcctcagttttaaagtctgataacagtacttgttctatcagagttgttatgccttcaagtaagaagtgctatgaatttttaaaaagagaacagaagtgctgtaatcccagcactttgggaggctgaggcagttggatcacctgaggtcgggagtttgagaccagcctgactaacatgaagaaaccctgtctctactaaaagtacaaaattaactgggtgtggtggtgcgcacctgtaatcccagctactcgggaggctgaggcaggagaatctcttgaaactgggaggtggaggttgcggtgagccaagatcgtgccgttgcactccaaactgggcaacaagagcagaactctatctccaaaaaaaaaaagaaaagaaaaaaaaagaaacagaaggacttggaaaagtgtttccacaaagaggttaggaattcattcatacagcacatattgattgagtacccaccatgcgggcactgatctgctactgaagacagaatagtgaacaagacaaagagaagccgctgccctcaagacatttccctcctagagcaggaaatgcccgatactcatgataaataaataaactgtatagtttgttagatgatctgtaaagcagggaaggaggataataagagttaaagtggagttgaagttttagatatagcagccagaaaaagactattggagaagagtcatttgagactctttgacccattcaagtcaagacctgaaggcagcgagcattcaagtgtggcagaaggaagagacatgtaaagtccccatggtacattggaggaaagggagaaggaaactagacctgcaatgtgggcgagtcggggactgggggggaatagtaggagaagagaacagaaatggaacctcaatcacactaaaagcactgtgataacaccatttacccagccactctaccaagtgtatctacacatgtaatttaatccttactgcaacctagtgagctaattgttttgtatctgttctacacagttagaggttctaactctagacccactaattagtccaagggaacctcatacctctttcaaagcctttcctcgtaacctccacgtcctctatagggcctgcagagctctagctacagatagtcaattctctcctagactatgtgaaatacctgctcgagaagagaagatttccaagagtcagcaagatgctgtgcttacccgtctcacgatccctgatgagtcgacctaaactggaggcatgaaaatgtggtggaaagaagaatttcactggagtcagggaaaactcaccctccttgagacgaagctacctgataggtcacagttggatcgcagctaaatttaactataaatcaatgcatttactaactagtcagctaccctcccattcaggcctacccagagcttggggcagatcatatttacttaaaacagcccttgttctttctcagtgtgtcatcatatttcacccccgcccctcccccaagatttcagacaaaagtgttctcagcattattgtcctgatgggagagtacaggtttctgagaggcacttgactacttactcccagcaactagcttcccagggatggatgtgtttgctgacaaattgctgtagtctgtgatggccatcactttgaaggattatgaatatgtaagagccatcctgcatttataaaacaactttcagttttctaatgtcctttttgtaatatgcaggtctttgctcagaaatcacaatcgcaaatgcagtctgtgctgacacagaagacatctgttggagggggagagatattttcagcctttgcggagatctgggtcttctgctattgcaggtggaacaattaataggccataattatttctttcatacactgtggagagtctatatttggatgttattctttgaccatcttgagttctttaatccttaagtatctaaaaggtggtgaatggtgtcagtgatatagaataatgctgctcatttattttttctaaaaaattgaattttgctttccttatttcttggaaacagatcgcttacagcaattgcaagattcctatatccctgcatttgaagaacttatgttggataaaggcaaacacctttattctcttgtcattgactgttacatttttagcttaaaacttcacatgacttatattttaatcaaacaaaataatatatttctgaattgagtacctgataacttaaaactataagtaaacctttaagaaggaaagaacacgtagtatgaagagttattaagatgtaaatattgttttaaaatgaaaataggatattctttctaaaattaacataattagccagaattgtgtccagttataataaaccaaattccatttagtcctaataatacttcattaggttttttaaaaatttagaatatgctgcttaaatgggaaagtcttagaattggccactcaaaagccagttgaaaagtggtctcagaagtcactgggtatagtattgcctgtgttcttaaagaacatacatttttgggatttaagaaaagattttacatgtaagattctactaagcaaggaaagaacaattcgtcgtctgctgtgcctcccttaagccatgggagatccctgaggtcaagaccttatcatttgatctttgtagtattagtgcctattgcagaatctgacatttcatagactccagcattcattgagcacctatgaaatgtcaaattcttttaaaacatggtttctcaaccttgactccattgacattttagacccaattattgcttgttggggaagggtggtgtcctgtgcattatgaagatttagtagcatccctgacctctacccactaattgtcagtagctgcagtcataacaatcaaaagatgtctccagacaacatcagatgtcccctgggaagcaaagttgccccgctgaaaaccactgttttaaagggtttgagagggagaatttacattttttgggattaaaaaaaaactagtttttaaattctctctcctccatatgtatatatttacaatgtagtatatttgtatatatacaatattatcatttttaatttttttttttttagagataggatctcactctgtcccccaggttggagtgcagtggcacaatcataaaattcaatttttttgaattttatgaatttttttgaaagattatgaatatgtaagagccatcctgcatttataaaacaactttcagttttctaatgtcctttttgtcctctcaccctccttcccagagaacaatatgcaggtctttgctcagaaatcacaatcgcaaatgcagtctgtgctgacacagaagacatctgttggagggggagagatattttcagcctttgcggagatctgggtcttctgctattaaccaatatggaccaggttctccttttgtaatgggactgttaaagaatgttgctgtctccagtcagatgacgtcaatggggatggtaggtttacttctaggtagatctagtttaagtttaaaaggagtgcaagtacatacaagagcatactgcagcctcaaactcctgggctcaagtgatcctcccacctcggcagagtagctgggactacaggtgcatgccactaggtctggctaatttttagattttttatagagacggggtctcactatattgctcaggctggtctcgagttcctggctgcaagtgatcctcctgccttggcctctcaaagcactagaattataggcatgagccaccacactcagcctatatatgttttaggtatataagttttagatataattttaccaacatacatgttatgtgtatgtataataaacatacacattcttacagaggagacatttggctgggagtgctcattgtagtctttttttttttttccgtgggaatcattatgactccagtaagttgctcactaaatttcatctgtcactgtgttcccgttcagatacaactaaagcctattgaaattgatttttgtgtcagtaacagagcggggattcagtaagaacctgaaagcttccctttcattactagtctttttcccccatattactttagatttggtgggccctaattatattccagtcttttccctgctgacatttcttttgttttaattaaaactgctggaggtttgaggacaccgtgggagagggtttattcatcaacagcccaaataaagagccaaatgggtcccgatttgtgttactgccaccccaagaatgatagctgggaacactgtggtcctttgcctttgttttttctcatgacaccagtgtggtcctttttctttctgaacaggagactgctcctgctgctgctgcagaagtctattaagtgaatgagacaggactgtgggtggactggcttcctattgaagccatacattaggcaaaatgaaatgcagcattgcctttttattattattatcatctatttcccccaacccccagcctatcgtgtctgtggtccaaagccaaccctgcccactcccaatcacctggttgtaaatctcagacaataggggccagcttcgggctgcatttggcaaccctgtgcagggccaggggagaggatgtaatatatcttctttatctgcagctaggaggtgggatggagtgagcaaagagtctgccagaggtcctgaggggaaagacagagttgcctcataaagtagtccttagagagggagctattgatttgaaatctttaaaaatgaaccctgtttctccaagaacagttgcatcgtcctacctctagttagtaccagctcgggaaaagaggaggcagaggtgaaaggatgttggcagggcagcgtctggaccttgcttttctcttgatgcatctttctctccctgaccctttcctctggtaagctgttgattatgacatgcagaatgctaatgtctctagtgagcctccagggcctatttcagtgacctagttttcttagttaacacttggaaaagaaaacaaaaacagaaccttgttgagcaaaacactcacatcagatcacatagctttcccctccagttaggacaccgtaagccattcttatggtcctcttttttcttaagcttctgacacgcggaagtagacatttccccaaattctatcaagattctcccaggtgtagcccctgatggatcacaggaatctctgttcattgtgatttgtggcaatttacaaggttcactaggcctagaaacttgatgttttccagtgtgatttggcacctaccctttacaagacgctgtcccaggcaatgttagaggattaaacaggtttaaggtggagttcctgcctttgaggggctttctgttctagtatgtagcagccatgtgcctggaggactgcgttttaagggcattagggacttagggcacccagaggagagagaagtgggttccaatacaattcacacaggctattttaagttattaagggctatacaccctcacatttaactttttccaggttgcatcaagaaccttttttgtgtcttcagagggttattgacccttctactaagttcatgtatgtaaaaatactttttcctggattctcagatttcatggaatactaaaatctcactctataaaccccccccccaccaaaacaaaacaaaacaaaaacaacaacaacaacaaaaacatatggttgttaacttttaaaagttaaaaacatttcattaatgggcattttaacaccaaaaataagaatcctgcttaagttgaatacctcttgttttctgaaaaaatcaccactgggtccttatttttcaccttttactggagttgtatgtaaactttaccttggactagtgttcaggtaccagggttttgaatgatgtttatagccccaggtgccattcttggttcaggggatagggaaggctattgtgctgtgtggggaggagtgggatatttggagaggctgaagagttggctgcatgtacatactttgtcgccatcttttgagcccccacacctaggggggttagtcctcccagaaatgaatgtatgaaagccacagatgagattgggcgtggtgactcatgcctgtaatcccagcactttgggaagccaaggtgggcagatcacttgaggtcaagagttcaagaccagcctggccaacatggcgaaaccctggctctactaaaactacaaaaattagctgggcatggtagtgggaaccagtaatcccagctacttgggaggctgaggcaggagaatcacttgaacccaggaggtggagattgcagtgggccgagacagcgccactgtactccagcctgggcaacagagtgagactccgtctcaaaataaataaataaataaatgaataaataaacaaataaaaaatttttaaaaagccacagatgattgtggtaattctgtggtataaattagatgagagccagtgagagctttggttttgtgctcattttttgggttgagaggaggttactgggaagtgtgttcttggcgcaaggccctggcccagaggctggctcgtctgcttttgagttctcgtcacccctcatcttgtctgcctcgtcactgctgtcacttcagctgtgcgtgtctttcctgggtacaggcattaggctccctgccacggaatctgcatacattaactattgtctgctaaaaattgtgactatttgatttttttccctttaagcatccattttgatttataaactgagccaagctggcagccaggaagactgaagaatcctagtttctaacaaagaaaaatgaaacccagtctcttcttccccacttcatgtctgtgagcaagtctcagctttcagttggcccacccctgaacagtcttgaaagcaatccattttctgtcactcagaggtgccaagcaaaggaattcacagtgagtggtgttgagatggagagtaattgcttgggcaccatcctgagtcggtaccttgctttacctctgccacaagtctgggagccataaagtctgaattacagttctgcacatatggagagcagggtttttaagccaccaacgaatggcacatgtaggccaaggaaacacaaaggctccatttaacctggggaagacttaggaatggacatcatgccaagtatgctctgtgaacattcatgttacttgatcataaggatctttggagtcttttcataaagttgtcttgtctacctctttgcctcaagacatgttgtatcaaggaaaggtagcattcctaaagatgtccagatagatattaactaacctttagtctcaaatgggagtggaaaaccagagttcatgtttgccatcatcatgacagctcagaagtaaagctaaaaccaatttctggtttctctgtgatctatggaaagggaaagtaaactggtctctctgtagagtttaaaagaacttcatccacttaaaatcatcttccaggtttttatttatgagcaaaataattataattcctgcttacaaccccaccctatctggtcccatacactctgtggctggggaaatgtgggggtaagggaaacagatgtagatatgtggatggtaccaagaacccaaacgcaaccctcaaatttcatgccttcattcagtctgtttttcagcaaatatttgctgagtgcctgctgtgccaagcactatgaaggcacaagggaaatacatatccaatctattcccaagtcctcttcatttggcctcctgtccattcccacattctccaccctttccatcctaatccaagtggccatcatccttcacctttctccaggaaggagcatgaccttgggtgaggtggctctttggctaagggccattcccagagagggacctgacagagttgtcaggtacttcagtctgtactcgagaatcttggtggcacactgcagcatctatgattgatacacagatgatagatagatagatagacagacagacagacagatagaataagaacaggtgagccataaaacaacagctgccattactacatattctacattctgctttttttttccattttgatttgatttattttcatggttctggtgatgcgtgttttgaaaaaaaaatcacagtgctggttatgatcagtggggttgggatagtattctgtggaaacacaaaggtggagtactcatttgcaattaggaaattgaagacgacttcctcaataaagtggagattaaatctaaggtagataggaaggagaatgagccactctctacctgtgtgtgagcttcctttggcaggaggatgaagacagtggggggaatgtctgaattttcaacaaagatggtttgcttgagtgctttgccagaaataaatgtatgtgggtgacctagaaatgaaagtattctgtcttccaggctagccttaggctagcagctcaaaaaccctcttgctcttccttagaaaataacaacaataacaaaagtgaagcttatgtggctgttaaaacaaaactgttgttttctcttgcattcattttagggaggagttgaaggagtagggtattgtattaatcgtacttgagtgatttggatttcacctcgatgttgaattattttacatagaacaaggatcagcatagtttgttgcctcaaaagtgagggagaagaagggaagaggggagcagagtaggttcttaagtgtgtctgaggaccaggctgagccgtgaccccaaggctctgcctcccttgttttgatgcctttcttgttcctttctggtggataggctttttatgctttaggacattatctgacattaggcttggggtcctatcagaatatcagttttacttttctagatttagcatgttcactagcttttgccattattggttatttctgtaggaaaaaaataattcagttcatccttttattaaaaaatgactcagcaactgcaatctgataggacattttctctaattttcatggagaatttttttaaactcttttatctccttttagaagttttttcttttcagaatttaatttttagttcttggttgcacatgtggtttttttttttcattcatacatttgtccattttagagatgggatcttgctgtgtttctcaggccagcctcgaactcctggagtcaagccatccttctgcctcagcctcccaagtagctgggtgtacagacgtgcaacactgcaccagcttgaaacatgtattttagatctaaatttagatggtgtctatatttgtattttaaatttctcttataaggaaaaataaattagaattggggtactgttacattttcccttcaaaattctattgcaataacatccccttcgttgcactgcccccaaatttaaaaaataaattattaaaaatcctatgtgaagcaaagatgactggttcgatatttagttccagttaagtaaaatattaaaagtttgttttaaaaattattttaaaagtttggcgatagaaatttgtgatttaggagctggatggtagaagtgggatggaggagaaagtgtcctaagtttagctgtgaagttttggcctgatctctaaaaggagaggattgggttaggctcttaggggccccttcctactcaattcatttctgattttataaagttacctctttaaaaactgtcttacaatgactgtgcctcaggttcctagtgagctttaggtcggctgactccctgccattccctccaagtctgccttaatctggatcataacttggcctgatgttctctggggatagaaaaggcagctcatgctgggcaagttccttcatggccctttcctgatcagcaaaatgtgacagctcagcatccttcctgctctagcgcgtggggatacctttgcctgggagtgatctgaggctgctaattgttccacctccaggatctcatgtaagcccaaactgccatcccaaggtgtatttttcagttagctgtcagacccactgagaactgctgtttcagccgggaaatgaaatttaaaatttaaagtgttgttttcttttccagtgttaccttccatcattttcatagtggctacttaaaaaaacaaaaaaaaaaacaaaacaacaacaacaacaaaacaaaaaacagtagcaacaacaaaagccaagtatactaggttttttaaaagagctgatatcttatttattccaacaagaactgcccactgcctgtgttcgaaatgtaacacacgtcacttttatcccgcctcatctctggccttgagccagtaccatgggctggctcagccctaggctgctgatgggaagaactaggtgttgaggtgtccttgtaacaaattattcactcaaagaggatttcctgcttcttaaggacttaaaaatctactgcaaagtctctcaaagtgcatgctggcagacatgcctcagggactccctcaggaatgaggggagtcgggaggcagagcagactagagttgggcagtcaagtccctgcttgaaccaagggagttcacttaaggttttatttggggaaaaggttgggctgcaaatggagccacaggggaaggaagggagagaggaaggaagaccagagagggagagagggatattaatcctttgaggtccttggaataatacacacagggacatgttcattgatagacagaggtgacgaggaatcgacaagtgaggtatcagaggacagagtactgtaattgaatctggaaagagagagtaagttgtctgaggagtcaagaaggcaaagggcatcccagaccaagaaaacataccatctgagaggcaagaaacaataaagtacatttacagaagcgcaaacagtttgttctcaaggtccacagagtaagagcaagtgggagcctaccaaggtggtatggcagaaagggggtcagctcttggagggccctgcaagccgtgcccagtggtttgtctgtatcctgttacaggtaccattaaaataatttcaaggcaaatcagctatataatatcagacagaccctctgtatttgcctacgtttcccctaccctctttcagtgttttagcagatgaacagccattatttaagacatgatttatagccattactttaaagtccactgttggttacaaagctgttgattcctttgcaagggtcatcattacggcatcacagactcaaaagaggacgctgttgctacttcttccttgtgcaagattgactcatggtttgcaggaaaggtagcgttgctgctctgcaagaaagttagtgttcctggttctgtagcagtggcacttctctccctatcaatcttgtggaaactaaatttctaaatgctgcttgggatggaaagagttggtagtgctgatacccactcactgccctctctactaaccactgagcccagtctccccacgttttgtagatggggaaatgagggcccagacacagccggtggtcatgggcagagcctggacaagaactgggcctctgggattctggtccagggctctttacaaggtaacacgccatcctctccctcgatttcaggaaagtggaaataagtgtgaggggctgtgtctgtgaccatattggattactgacctactgtccccttctttgtgctctttccccagtgaggaggaaaaaaagggcagcagaatgggggtcaaaagcggaaggaagcaccatcagaatcagagtaaatagatttttaaagctgagatatgtgagaagaaagaggacaggcagagtgggcagaagttaaagggccagaggagtggggaaaattaggttagtaagggagaaaagtagtagaaaaagggaaaggatttaagaacacaaagatataggtggtctcaattacaaaattgacccactaatgttttctaccacaacttttaaaaaatttgatccaactaaactagcacattttcaccaacttcaactactgaatctgaatcacactaggccaatcactttttccacaccacaattatacatgcctccttatctgttgttaattcataaacatgccacagcatctatgggggaggcccttactattccaggtactggaaatacatcgatgagacatggtccttgcctttatgaaacatacagttcagtagggaagacaacatttaaaattcaccagaagacaggaccatacataattacggccagcatctgctgacagctaatctgcatatgtcactgtcaagtactttgtatacatgatctcatatcgttctcactacaattctatgcattaggtattattattatttcagtttttgagatgaggaaactgaggcttggaaggttgaggggcttgcctaaggtcatgcagctaggttttgaacccagctgatcttagaagctatattttattgcctgatagcagcaataagtaaaatgtattttggaagctatatataaaattcatgtaaaagtagtgagtatgaccatctttgctgttgtctgagagtcacatgtagacattgtgttttctcaaggagcaaacaaagagaaaataattctcttctgagagtgcccccttggcgctccctactcgtttctgattttgccacgtggttgctgcttcactgtggttctaaagaccaaaagagcccaccttggggaagcagttcctaatgttcaacactgtctccttgatcacaaatttggattgattgctatctgttttagtttaggctcccttttaagataaagataaatgaacaatctcaggtgaattatagcagaatcatatccagttaaaaccatcacaggatattttaagaatgaaagaaaccaaagtttcttcatctaccgagtgttttctaacagagagatacttgtgtattcttccacgcaggcctagctccccttcgacataaatcctcctctcatataagctcttgtcaaatgccttggagaggagttagaaccaaattgttcaacattgcattttttatttgacttgacacccactgtgaaaataaacaaagtgactggggacgttttacaaaataaacactaagtagacatggtgtttctgtgtgtgtctgtctttctctctccccccattgacatagtacagcactgatccaagcaatttttctttattgttggaattgaatgctactattcatcatcagaactaaatcttttgttattattttttcttcacagggtcgtcatgtcaaaacgggccagcttgcagccatcaaggttatggatgtcacaggggtaagtgtctttattttgccatctcaatagccatgcagatgctccttgacttatgatgagttcacatcctgataggcccatcataagtagaaaatattgttaagttgaaaatgcatttaatacacataacctgttgaacatcatagcttagcctagcctaccttaaacatgctcagaacacttacgttagcctacagttgggcaaagtcatttatcacaaagcctattttataataaaatgttgactatctcatgtaatttgttgattactatagcaaaagtgaaaaacagaatggttgtacaggtacttgcagtatgatttctaccaaatgcatgttgatttcacaccactgttagtcaaaaaaaatcgtaagttgaaccattgtaaatgagggaccatctctatatttgtaatagagaagttaatgatagaaaaaaattgttttctagaaaaataatctccctaaatatctaatatctttccccacttgtggctaacataaggaagagtatgcagtagctgactgaagagatcatgggtacatcactctaattaaatttgatacctacacactgccttatgtagttagagtgaatactgtttgccaataatttacataaacacaaccacagatatttgcatatgaatgcagaacaaggatgtgaaggtattaaatgaataatactgagattatacagaagaaatgagtcttaactgttttcccaaaggtctgcctaccactggagtagacaggagcttggatggctctaagatcctagtaggatatttaacatgaatatttcccaaaacaaaatattactgaccaaataatcacaataaacacaaattcttatcattatagagcaacaatgaaacaaaatttctgcctggataatcaaaagcaatctaagaaatagattttattttaaatacaatctaatgttttcgatccttttgctaagcctacttaaaatattttaatgccttttcaagagtacacagcaaaaatctgactcgaaaggattcactggacatcaaaggcatgttaataattttctgttgtcctggggatttttctaagatgtctgtctgctgtacatgaaagctaaaagaccaaagtcttccattcagcccagaagttgattattcaatataaatagacatagaatgaatgagtcacacaaaagaaaataagaaaaacaaataagaaaaaaataaataaataagaaagacacacagtatgtctgtatgtcaaacttcaacccataccttttgggctcactttgttaccttagataagtatatgttatgtgatagttacctaccataatacacgtttcactaattattgtttacaccacacattgtactgacttattattgatctaaattcctctttaagttgtatatatttttgaccagtaaaatattttgttcctgtatttttgttaccatttagataaagtactaattctttttatttgtcttaaatatattatttaagttttaggtattacaaaagttcaaatttttagtcccaattagtttattaattcacctggcctttactgaataataaactgtatgtgccttatattaattcagtttaagaaaacgctaaataacagaggattaagcataatagaagtgtcttgctctcatgttaaaggagtgtaaaggtggacagcctagggatgtatgtcagtgatatggtagagtgaaggatgtttttatctttctgctccatcattctaatgcatggcctccacagttaaggttgctttatggttcaaaatatttattggatttccactgatcacactttatggcaggcaaaaaagggagagcagggggagcagaagggtacaaatgagccccttccagtgaaatattttctacttccatacaacattactacttacttctgctttcattgcctgtatctagctgcaagggaagctagaaaatgtagtcttttattctactaatgtgtctacttaaaaatccagattctatcagtcagaaatgaagggagagtggatactggaatggtcgattagcaggatctgacacaaaaattaaaatcagatactatcagtctctacatagaaacccattataaacgtgtaaacattttacaaagctccaaccacagaacaaatcagaatttgttttgcaattcagctgaagtcatactactgtattttccttggattgaataggatctctgcataatgagatgagcttggcagtttaacaattaatggttgtggaaggagtccaagacattcatgctgtatattaaattctattgtgtggttttgaagaactacagttgagagttccactgatgtcattaatcttggggcataaaatgtgtgttgatgttcaaagtatgactctgaacaatttaaagcctcacaagtagaaccagaaactactcaagaaccactattgctagaccaccttgcttggaattaaaagttacacagttatttttcccagaacatgtattttcagcttaaggaatgtcagttagtctttctaaactgggtttcattaagcatctaagctctacagaagatgatttgagagactgccttctcagttcttccaaggagggtacagaggtaaggccattttacatgcaaaggagtgtcaatccattacatagagtggatgctttatagtatttaggcttaattctcttggggaactcctattgaggagggctagatagtttttctgtgattcagtcatgtcattgatgattatttaaccactgacttttaacgaaggcaaacatggatgcacatcaggaaatggttttcttatttttgtggtgtctgatgtggcatcaagagacttttgtatcacccccttacacatcacagtcaacataagatttcctttgtgaaactcacgtggtgcctttagaagacagtctattctattttgccatgttgtctattgtgtattacagaatgctgtaaaagcttcttaccaattattataattgtactcattatggttgctctgttaaaaaactgaaatgaattctcaaaggtcgtctttgttaattacatgctatgacctactacaaagttactatagtttattgttataaaactgataaagccataagcttgacatcaatttttaaattattgtttttattctatatcacttcctttttggtataaaacagccattgagagaactggatataatgcttatatccttccatttttagagctgaaacacttccaaatttgccaacatttgcttcagaatttgtgcttaaactcagagtaggccttgaagatcttatagtttgaaatcattatggaaatttccccattttgtcacagtctgggatttacctctcagctggatttttgcgctctagattgacctacggcatctaggaggagctggaccctcccaggtagtgtttcttaaagtggaccatcagcatcagtgggcagtcagcacctctgaagtactcatgagaaatgcaaattcctgggcctgctgcaggatttctggggtagcctcaaaatctgccttttctgtaaactcctcagagtgtcacacacatcaaaatgagagtaccacttttctagggtcttgtatttacttctttctggccaccaagtgtgaaggagctatggttttttgtggggttttttttttgataaccctgtaaataatccccattttcatttggataaaaattcctagtgtaaagtagtccctttacagtgacaccctgaagtgcatataggacttaatgaaatactaatattgtaagcttttgcctttacaatgactggttgtgattacactactcaggacatttggggttgtagtaccaaaccgccactcaaactgaatgaagctgaaaagggaatttactagcttgtatgaattaaaacaacaaaaacctcagcaggatgcagagaagtcacctaacatgatcaggattttgtctctctccatctgtgggctctgctttcgtcccagcagcagctgcaggctcatgttttcactacctcattgccattggtcccagcaaaggtgccagtctgaatatcagtggtccagcttggaccatgtccccatccctgggccaattccttactctccagtccacgcctgggctggatgcctggctctggaacctaccgcagggactgagagttggagagagttgatttctcaaagaaaaacctgagagttattatagaaaagagtgggaaagatgctgggtgggcaaaaacaggagaattctatgactataatatcatatattatagtgagtgtgttcaaaactgatttggtccttaagtaaagtgtttctctaattacattttttatattcctatcaaaaagaataataatggtagctaacactaagtgagtgattactacgtgccagaactctttaaaatactttctatatattaattcatttgatcctttcagcagctaaccaagcaggttccatgattagccccattttaggatgtgaaagccaggcattttaagtatcttgctcaatgtaacatggctgccaaaggaaggagtgaatatttcagcctgagcaatgtaaccccatcctttaagtctatcctcttaaccacattgttttcagtcttcaattcatgtagtgtttaatttcatgtgattcttttttcattgatttattcaacaaacatttactaaaatctactttatgataggcactggaaatttaaagatgaaaaaaatggtcttttgcctgctcacagtaacacaaccttgccctaaatatttataaataaagcttatacactttataacaaggctgtagaatgtgtaaataacgttacttgtaaagtttgtcggaactgtgaggagacagtcctcactgaggaagcccaggaggacagtcaggtgaggacattccagccaagaatacagccggtgccaaggcatgaggctgagagggcatgttctggaaactgcacatagcttagtttcgaggttaaaagtgccaagaaggcgttgatacaagatgaatctagacacattaggaggggccaggtcatgaaggaatttaatactgtgacaaggagtttacaaggtttttaatttttagttttctcagtagaacactttgatcaaatagacttagagaaaaacccaatacataaaagaaatgtaagcaggttttcttttcttttcttttctttttttaaaccaagggtgggagaccgtaagtcctggctcctttcctcaaactactactagagccaatgcaagagccagaagttgaacaggagagtaacaccgtaggattgcctactaggaggatccatgctaagctctgcttcactgaattcctatttctgtcttactgaatttctgtaggtgaagcttatgaccagcctccatctctttctgaagagtaaggaagtggtcttctcccagtagtagactgttttgcccattattaaagggctcagtgaatgcttgctgaaattgcacaaaaagaaaagaaaaatcttttcatcttgggttgtttggaagagtaaggtggacacattgttccaagtacatttggttctttcatcccaaagggaggcagttcagtggcataattaatagtatgcacataatattgttaataataataatgacgataggcacaggccaaaaaggggctaatactgattgtttatcatgtcccaagcattgtacttagtacttaaatgagtacttagtactcatttaatccttaaaacaacgtccattaggagaatactgctggtatatctattttacaaaggaattgacagcagagagcccaagaaacttgcccaagcctcatggatagtaaatggcagggttggaattcaaatcgagccagtcagggcatacccacactctccacagacatcttattataggatgagaaatgagagagtattgccagagcatggccttcagattcagagagagctgggcttatattccactcatctccttactgattgtgaccttgggcaaattttaacttttctgagccacagttttcttattggttaatgttgcaagcttgttttgggacttaaatgggatatatcttgtacctgacacataataggtcctcaatacatgattttaatggttagtgccagtaaggtacattgaatcactgaataagacagacaataggaatgaaaagattttagtgtgcattaaaatcctgtagttgtatattttgatgacagcctgatctgtgaactacgtgccaatttgtgttagttaattgctgatatgggtaaatagtttgcactcaccctatctttaccacctcaattacagagttgttagccttaccctgaatagtatgtagctgaaaaaaaatggcttactagagcaggatccaggaaagaaagtgaagctagattccagaggctgaaggctgaaatcacaagatttcattcattcatttacttgagaatgaatgagtgcactgtgctacggagtcatccagtgaacaagacagacatgggcactatcttctggaatcttatattttagtacaagacatttagcagttaaacaatagcagtcacaattctgattaacttccaagcagtgtacagagtatgaagagagaatttaagaagaaactgacctagctgggtggccaataaatgatttctgagaaagtgacagctatgtgagatctacaggacgagtagaccttcgttagccaagtgaaggggtaggggaggtgcacctccagatttgggagcttgaccttcaggtgatgtcagcaaagcttggggattcccatctgaagctcctttgccacagaggccctctggacagctctttgggacttttactttggagccatttatgtagatgtctttagcagacagaacagtctgatcaagcacatggtcaaaactttcaacagagaaaagataaacaaatggctttttttgtcttcctaataccctccacctttggggctattttcagtgcttcaattctgtatgctatacagcatgtagaacttggaaagcttctagggttctaaaaatgaacaactgagctgcccactccatgcacactttagcatctgtcctcttcttgcatacagattagacccttttggtggcttatgtgtgtctgggtctctgcgcatgttcatgcatgctgtgtgtatggcctggatgttgggcttgttgtatgtgtatgctcacatgttagatacattgcttaagtgcaaaaaataggcctgggggctactgtctatacctccaaactaataaaggtgagcaatagtttttaaaaatattttttacatcataatagtttatattcactggtccttttatttgtgtacctcaaagcacttgatcaaaattataattaattcccttagccccctagtggggtggagatgcctgtagatgacaaaattggcatacagaaactggggtgcttggaatcactgacggggctgttcaaagcatgatttccaatcaagttcctcagtagtggaacacaaggtctccttctgcaggtccgtcctttcctttatgctgccaacacttcccacctcatattcattcccctcttttgacttcactaggtcttctcttgttgagctctgttgctcttctttgatttgacttcctcatcagtattttgaatttctatttaatgacttgggaagttcagcttttatttttattcatttatttttcattatactttaagttctggggtacatgtgcagaacatgcaggtttgctacataggtatacacgtgccatggtggtttgctgcacccatcaacctgtcatctacattaggtgtttctcctaatgctctccctccccttgcccgccaccccacgacaggccccattgtgtgatattctcctccctgtgtccttgcgttctcattgttcaactcccgcttatgagtgagatcatgcagtgtttggttttctgttcttgtgttagtttgctgagaatgatggtttccagcttcacccatgtccctgcaaaggacatgaactcatcctttcttatggctgtgtagcattccatggtgtatatgtgccacattttctttatccagtctatcattgatgggcatttgggttggctccaagtctttgctattatgaacagtgccacaataaacatacatgtgcatgtgtctttacagtagaatgatttataatcctttgggtatatacccagtaatgggattgctgggtcaaatggtatttctagttctagatccttgaggaattgccacactgtcttccacaacggtcaaactaatttacactcccaccaacagtgtaaaagctttcttgtttctccacatcctctccagcatctattgtttcctgactttttaatgatcgtcatgctaactggcatgagatggtatctcattgtggttttgatttgcatttctctaatgaccagtgatgatgagcatttattcatatgtctgttggttgcataaatgtcttcttttgagaagtgtctgttcatatccttcacccacttttatttttccttcattaaaagttctttctcatttgaagcctactgactttaataagctttcaaggccagggacaggaactgtgcattatccatctttgcaccccatgcagagcttgctaaggttgaacctggcactggcactggcacctagtaggtgctgcattatgtgttatatatgtgtattatatgtatatcattatatatatatacacatcattatatataaaatgatatatatcattatatatatacacatcattatatatataaaatgatatatatcattatatataatatatattataattattactaaattatatattacatataattataataatatatataatttagtaatgggtttgctgggttgagtaaatgattattgaatgattatatgaatatgtattatatattttataatatatatttataattatatatttatataaaatatatatttataattatatatttatataaaatatatatttatatatttaatatattatattaaatataatttaatataattaatacactaatatagtaatattttatatattaatatgtaataatttaatataaatataaatataaatatttaatatttattatatattaaatatatataaaacatataaaaatatatatttaatataaatatgtaaatatataatatataaaaataaaatatatttatattaaatatatgtaatatatatcaaatatatatttataatatataaaaatatgtatttaatatataatatgtaaatgatatgcatataatacatgtatataatatataatgcatatatagtgtatacaatgtaaaaatctatgtagagtataaatgcatatttatgtaaaaataaatataaaaacaatattaagattagaaagccagttgaaggaaaagcaaattgaaattacagggccacagagaacttgctagttatttttcccaataaccaaagccaaaaggggggaacattataaagtacactgtttatactatcagaaaaaaaaaaaaaaactcattccaattcctgtgggctgttacctgaattgtaaatctaggatccttgaagatataagccacgccatttatggtagactttagccacatgagtgacattattgctaggtttaaaacttgtttacttctgggttacttgagtttgggtcttgttaattcgtggttttcttgggagtcatgcctcagtgcaggcttgggtatgagaaagacatatgtcaaccttttgttatctacccctttagggaactccacttcattgtaagagaaagcaggttagcctactggcaaagaagagccctgcacagtgtcagtctcgtggaatatcctagttctgacacttcatggctctctgaccctggacatattgcttaatgttctttattctacatctataaatgtggataatgccacttctctcacaaagttagtgtgagatgtaaatatattaatcattatttataaagggtttcagaacaatatgtagaacacggtattctgtgcctattgttgttattattaccaggtcttttgcagacaatttttatttttctctttatggcaccaaaagcctccaaagtagaccacatgctacatcctctccagccacacgaccttggcaaacactttctctgccaggaaaatgtttctatcccaatcacactacatcacattttctctttttttcttcccaattgggtaactttcacctagccttaaaaactcagcttaaacttaggtttcttgaggttaattagatcagctaccacatacttctcatggtcgtaattttgcatatatctcattctttgattcatatctgtgtcttccactaaactgtagtaagcttcattgtagcagaacttgaatctgttatgcctattgtagtatgattatattattgacatttacaattatgactggaatatagtaggcacttagtaaataattcttttttcttctttactttttttttgcaactgttattttagactcaggaggtacatgtgcaggtttgatgcttgggtatgttgtgtgatgttgaggtttgtgacaaatgattctgtcacccaggtactgaccatagtacctaacagtcagttttaactcttgtccacttctctccccagtctagtagtcccagtgtctattgttctcatctttatgtccatctgtacccaatgcttagcacccattcataagtgagaacatgcaggattttgtttcctgtttttgcattaatttctttaggataatagcctctagctcaaccatgttactgaaaaggacatgattccattcatttttatggctgcatagtattgcatggtgtatgcataccatattttctttacccagtccaccattgatgggtaccaaggttgattccatgtctttgctattgtgaatagtgctgcggtgaacatgtgagtgcaagtatttttttggcagaatgatttgtttgcttttggatatatacctagtaatgggtttgctgggttgagtaaatcattcttgaatgaattaatttaacttagagttaacatatacagcaaatccaggtgctgcctgcagaatgtcctggcaaagtcctatcaatgctaaaatgaagaggtagggacttagacaactcgttggatgactctgggtctgtttccttaaaactatttgatgtaatagatttattacatctaattatttattacaatctattgtaattatttattacaatctaatttattacagtctgttagatgtaatcgatttaaggaaacagacccaaagctgcataacttgaccctgagataattttaggtgatttacatgtttaattctcatttaattttaaatatattttaacatataataaactgtgatttaaaaagcagacctcaaactgtatgttatacaccaactttgaacacactggaaaacgccagcctgttaatttgtgctgctaggttaccctattcatgtgcagaatggcattgattgtgaagatcctactaaaatttcaaggcatgctcttaactatttcaactatttatcttaggaaatgcagatttttctccatcctatagaactgaaagaaaaatgaaaattaataagatattagagttgatgtataactttaaatttctttctaattttgtattcactagaacaacttcttgtcattgactaattgtataagtagatattgctttaaacaaataaatgtttactgattttaaaaatttagtttttgtcagctatatatttgcatcctgaaaaaaacttctattgcagggagggatttcactattacaaattatttcagaagctttttaaaaaccacattctatatcatagtgacgatcccttcaaattctcgtagcctgtgatcctttaatgataaagtgtctcctactttttgccacattcagtcaatgctgaaggtgagaatgacagataacacaaacacctgcttaatggcaacagctgctgtgaaagcagtgcagatgagcgggagcagagatggttctagccagtgtccacacatctatgggatagtggcatttatgaatctatacaccttatacttctctctagacttcttcctgactagtctcttagacttgctgtaggaattgcatagtttcattcctctgccacggattgagagttaaatgttgggcagactttattacagagcatataactaatattaaatgttttattccatttttaaatgctagcatatcataggcacttaaagtgtgttcccctgtgtaataaatatgcaacttaaaatcccttctttattccttgaaatcaatcataagcaaatattattgtatgctaacaagctcctttaattggaagaccaaagtcagggttctcttctgccctggcttaagatgctcttaaacgcttccgattaacgactttggttttggacaccatggataattgcccttcatctgactagtagttttctgtaaagaattaagaatactggctttggagtcagagaaatctggtcttgaatctgaggtttaacatttaaagtatgagtgaacttgggaaagttacttaacttctctgagactcattttactcgtttgtaaaataggatccagcttcatagctgttctgagtgctcaataagatagttcatacatacctcctggtacacagtaaacattacatgaggttttggctttggctatgttttatgaccacatgatgacaatcatgttgccatcagaggtggtcagtggcttaaaagcattaactggaattatctatttccttgcatttgaaaactgcctatcttcccatgatttctcatcttctagaaggtcaatcccggtttctcacatgggggttgaagggttggttctctggcaagcagtaggagagggccagtctcaaggcataagtgcttttcgggcctctgcttcttcatccgatttgctaatgtccccttgaccaaagcaagacatgtggctaagcccaggttcaaggagaagagaaatggactccacctcttgatgcaggtgggacacatatcatggccattttctttttcagtctaccacaaacactaagcaataagtagatcctgtgatcttgagaaataatattatcttctttatattaatactaaagctacatttaaataagcacttaatcatttctaagccctgagaagtagcttatataggtattcttattcctatttatagctgaaaatgactgacatttggagagtttaaatgccatggctgaggttaacataatgaatatgactggatttggaagtcatctgatttaagtaatccttcttcctagagtaccggacttggcttattgaagttactcttttaaatgtgtgataatttggtaccactactttatttttcattattgcccagtggtcattagtttatcagagggcttgatccttgtgcttaatacttaagatttggaaatagtacatttacaaaataatttacaaatagaggctattcaaattctcgtagcctgtgatcctttatgataaattgtctcctactttttgccacattcagtggcaattctgccactgtgggtggcaattctgataggtgctacaaaggaaaagatacatgatgattcatggggctataactttttcacttataactttttagtttaattctagcctcccttgctctctttgcatttttggaaagcattgtaactcatctcccttgatgggccatattgtgagaggctgaactctttgtgacatggttaaatgagttcttgtctcatctagtaacggtcttccttcctatttcactgaataacttactgccatctgtgccctagactaaaaatctggataaacagtaggcccaaaggcctgctaaattgcatgctgacttaaaaagttgcgtaagatcaaggatttatattttagaactacctaaccatgtcttacagtggttccataactgtgtttggaaacagtgcaatttaaacctaaaattcaagtgatttacattttggccttcctgcccttttatttatttattttttggttatgtagattagtaataacatttactttgtagtacactttataacatacatccgttatctaagtaccacaaaatgctgggacttataatatctttatctcattataaatgagaaaacttagggtccaaaaagataggcaactttcttgggattctgcagccagaaaggaatggtacccaaactcaacatgcaccccatctgcccaccctcttctttctgatcccagactcaatgcatatgctgtccttattgtcatattgcctcagtttacctttgcaaaatgatggagaatgtactgactttattctgacctccagtactatttattttggatttaattacatagtgccttctgttgttatttaactgttttataagctcttattttcttaatgacatggtgagctttttataggcagtccccccctcccctgtctttcccacatcacccactatcctgctaagaatccaggaggcaagcggtaaatacttgtagaagcagcctgatttctcactaagaatgactgatgctaagattgacaggctgcagttggaaagtgatccgtgtcttttattacctcacgtagttgcctttttaatggaagcagctgtcgatgctgtgctgcccacagaaaccctcaggtcgtttttctccctttctatttaggcttccccaaagtacatccgctcacatcctacattcgtccacaattatttggccccatacagcaagtttaaaaatagccaatgtgcaccatagtaagacattggaggtgcgctgtagggacccttcaacaagttgagggctggcgaaggtcattctcttcacgacctgcagtgaaggcgtggggagtttctgatggctgctaagaagaataggtggtcagcagtgtgccttcccctgtctcgccccttgactcccttccccactgtttcggccacatgcttctccttagctcagcatcccaagcatatattctattttgagattacctagtcttcagcttagttaagccatgtgatatgtaacatgcttttacttctcctaggtttgcaaatcccctttgttttttcctaaagcttattttagtaaataagcatggtcagcaaatgtcagcacttcactattctcctcactctattcttacctgttccttctaacatcactaatgctgctctgggcattgggctctttgtagttatttgttcttttagttgcatttattcacaggcactgcttggtgctagggatgttgtagagaacaaaacagggaggattcctgagtttacggttcttaccgactgataaggagaggagaccttaatcaaatgataaatgtgggtggcaattctgataggtgctacaaaggaaaagatacatgatgattcacggggctagaaccaaactgggcagatcagggagctttgctggggaaggaactgtagaactgagatctgaagatctggagaggagagcttacaatatagggagaagagagtcgagtaatgggacatacctccataccaatgtcaacaaatacagcaggtatgtgaaggagtgtaggggctatgaccagatgcagtggggggacttgacattgcctgagagaattaaggaagagatccctggtgaatgtcgattaaactcaatcaggaatggtgagtagagcttatgtgaagaagaggtgggggaaagaagacagcacacgagagactgcaggaagtcccagtaatgcagagacactggaaggaggcagtgcagccggagtggaggagggtacagacaggggacaccatgggtagtttttcaggtcatgataatgtcacatcttgcactcagggacagtcatagcttactgctgcacctaaaaaattatcctgaggtagaaactttctcccccaacctcaacaataaaacactcttctgcagtccaaccaatgtgtatacacatcaagaaaataaaattatgggaggtcaccatctccaccagcactgccaggacctctgaaaagggtccaggttggtggactccaaatcaaaattcatagtgaatgaaacctgaatattaagaaactaactctgtaagagagttgtctctttttacatcctcagtaccaccacatttccccctttctttctaaggtgagtttcctgaaggtgaggtgggtactcctgctttgtgaacttccttagatctagagaacttacctttgctccttttcccatctgactttcatcatcttcagtcaggtacttcaatgaaaggagccttcaaagaaaatgaacctaacaaaatttaaatctgagcgcccacggttttaatatctttcattttcctcaatctttcttataccagatagaatcagtaatagctacttgatggatgtagttcccagaggcctacagtgaattttctctcgatagtctttctaccttgatctcttctaggtgaagagatgagggattgttttggatgtttttgttttgttttccaagagattgtgctatgccagtttgctgtacaaaaagaagagtctcttggacagccaatgtattatgttttagaattgttctttgccctcatatgtaataattatgctcatttgtcaacaaggaagaaaaaacaagaaaaaatttagatggtgttgaagaacagaatcctactaacaaccatagattttcatgacagaatttttatattgttctcatacaggatgaagaggaagaaatcaaacaagaaattaacatgttgaagaaatattctcatcaccggaatattgctacatactatggtgcttttatcaaaaagaacccaccaggcatggatgaccaactttgggtatgtactgccgtccaaatttgctttatttacataaaaaacaaacacggccaaatggttcatttttctatcctcatgacaaaatttgattaactccttctttaaccattagcccccatgatgtccgtaacatattgttttcagggttttctcccatttccttgaatatctgtcttttcaggatctctaaatgttccttctatcccttaatatggaccatccccaaagccaattgttaagttctctgtttttttttttttttttcactaattgacaaccttttattgtgttttattttaggtgccttggtatttacattttatgaattgtatcatttattttgcttctttgagttaggtattattctttccctaatttcttgaatgatgcaactaaggtttacagaaaaaatgaataaactgttccaaagtctacatagctagcagggatggatctaggatctaaccaagctctatgcgattctctgtctatcgctgatgagtgggcgactgaaacataaactttaactctgtaagtaaaatacctaatacagtgtctggtaccaagtagggactctgcaaaggttgttttcctttcatgtttcccctagtccacttaggtatgtgccacagtcctttatctttgacagtctaagaggcagctctaattggctgtcccaccaatgagtttactgtgtttgataccaaagcctgttgctgctgtgcggagccttcctggtttctgtccttggaacttttattcacttagtccttcagcaagattataatgctgtattggtttggccttcccttgccaattttataattacctccctagtatgggcccattcagtggaagcctggactttacaatggcctcctatgtgttgatctacttttctttcactctttcttcttccctctaccttctgtccttccgtccctccttccccgcttcctctctctcaatttctgttcatcccacatgtcgttgttatattaatgcttctaaaaatacctttttaacctcttactgtcttgctcattttccagaggttttgtatgtgcctaacacacaaaatttactgaattagcaagagcctactatatgccaaatactgtgctgagctgtgtggatccagtaatggctatttcatggagaattcccaaagtactcagcctcgggcagaagtaactattttaatgcatcagacatttccaatccagtggggaagacagaatatagacagtgaatgcaatcagtgaccaaaaaagatataaaaatgttagctcataaaactaacaagattttcatgtcatttaatatgagtactcaatctttggaaatgaaaagaaccattgggattttttttttccataaggctcatctccaaatttaaaagaaaaattatttgggggtaaacacattttatatagtttatataattctaaaaaagttacagtaggttttaattgtggcctctaaatgtataatagatgtaaatatgaagattcaacatataaaagtagtgggagaaaataaatatgactggataatcctaaagagagatatatgacaacaaagggatacaccataaaatataattttgatggacttgactatatacatgttttaaatgtcttcttaacaaaaaacataaagtaaaaatgcaaataactaagtaaaaatattcattttataatataatgagcaaagaatttagcagccttcagagatgaagcatttttataaatcaataggaaaaacatgaaattactaatagcaagattgagttaaggaaatggttacaaccaaaaaagtaagcaatatcaattatcagtaaagttgtattaaaagcctattcttactaacaatagaaatccacaagaaaaaaatagataccatttcttgcctagtaggctgtcaaagatttttttttaattataatgtctagaatggacactcatacccactgctcatggaatgaacactggtccaacttaagggcagttggcatacacacacacacacacacacacacacacacacaccccttccaaagcaaacaccttacttttgactccctattttcacaggcaggaatatgtcctaaatcaggtcacttatttaggtaactacataaggatgtatgtagaagttaaccaatagggagtcacttacgggacattgcagacatttaaaatgatgtagctctgcatttataaatggataagcattaacaattttagtaggggctgggtgcgagggtggctcacgcctgtaatcccagcactttgggaggctgaggtgggtggatcacttgaggtcaggagtttgagaccagcctgaccaacatggtgaaaccctatctctattaaaaatacaaaaaaattaggtgggcatggtggtggctgcctgtaattccagctactccagaggctgaggcaggagaattgcttgaacttgggaggcggaggttgcagtaagccgagatagtgtcactgcacgccagcctgtgtgacagagtgagactctgtctcacacacacacacatacacacaaaaataaaataggactttgtaaagcctgttgaagaggttataattagatatagtatgttttcatttttgtggaaaaaatacgtagtaacttggtggggatatctgatataatgtatactaattgtgttgaaaatatttgaggtagtaatttcagtaatttcattttaaaagcatttttcttttttacatctgctttttttttctctaatctttctcttcagtacattttttttagagacagggtcttgctctgtcctccaggctggagtgcggtggcaccgtgatagctcactgtagccgtaaataccatagctcaagcgatcctgctgcctcagccttctgagtagctctgactgcaagagcacgccactatgcccagctaatttatttatttttttgtctcactttcttgcctaggctggtctcaaactcccagtctcaagcaattctcctgccttggcctcccaaagtactgggattacaggtgcaagccactgcacctggcctgaaatttctcttaagttcagcatctgaaccctttctgctgctgcttttgttattgctaccaccgggctgttcttgctcctcataaaagactgtctgctctctgagggcaaggattgtgtcttttgcttccctctgcagcatttggaaggcactgggtaatatgctgacaaaatcattggtttatgaatgaaaattatattgttagaacaaaacctggttgcaacaggtacttttgagagctcagattccctgaggcctgcagattcaacaggatatgatggggtggcatgagttaacatatctttgtgtttccaaaggacttctacattgtcaacaatttagcattttagcagtgactctgaattgccagaagctgcagcagatgacacgtagagaatgatagctattatcctccagctcattatcagcaccctggaagtcccccttgctctccctctcaatcactgccacctcaaggaaaacgggtatcctgactttttttctcccagttgtattaagatataatcaacaaataaaaactgtatattggctgggcatggtggctcatgtctattatcccagtacttttggagaccaaggctgggagggttgcttgagcccaagagtctgagaccagcgtgggtaacatagtgaggcctcatctctaccaaaaaaattaaaatttaaaaaaaaagaaaaagaatttgtatattgttggtgaggatgtagagagaagggaacccttgtatgctgttggtggaaatgtaaattggtacagccatgtggaaaatactacagaggtttctgaaaaaattggaaatagaactaccttatgatccagaagccccacctctggatatatatccaaaggaaataaaatcagtatctcaaagaggcatctgagctcctgtgttcattgcagcaatatttagaatagccaaggaatgatagctattttatagttgtctgtagaaaggtgttttctttggtcagggctatggttctcaatttaaaaaaaaaaagcattaatgtagatttataaccatctcccagcatatcacctgagctagaacagctatttctagatgagccacacctagctattaatttcattcattttgtgagatgggccagatagaaaagttggttttcatgttaagttgaattattaaaattggggtaattggggtgtttatttacgaatcgttggttgagggaaggagaggggtggttaatagggcttgactctttttcgcccttttgcagatcctgagatgttttaagttggaagaagaattagtcatgataaactttgctgggtccagtgaagttaattgactttccccgggcctcaaaactcattagtggatgatgcaggaccagattgcagacatcctaaaacataacactttagcttggttggaagttctgtgaaagccccctggaagtttttgttaaaaactgagcaaaatcttcagtccattttcagataggtacttggagaaagcagcacacctgctggcatctgcatggtgttaatgggaggtattgtactctggaaatgagtcacttcccactagttctcaccctggccaattgctcttctcatggagatggctgttgttgctgggaaccaaaagcctgatgtgtatgtgttcatttatttactccccagtcattcattcattcttccatatatatatatatatatacacgaacatatatatctccatatattcatttatttgtctgtgtgtacatacatatgtatatgtatatattatcatatcatcatatatatacatggctagtatagatacatatatatactggctaggcacaaggcactcttccaagcactcaggatataacagtgaacaaaatttatgaaagtacttattttaatgcagcttacattcttgctgtagactacaaacaataaacataataaataagacaattacagaggatgctggaagctagtaagtacctggtggagtactaattgggaatgcaggtaagggttgcaatgtgttatggactaaacatttgtgtgcccccaaaattcatatattgaaatcctaactttcaatgtgatggtattaggaggtgaggcctttggcaggtgatcaggtgatgagggtggagcccttataaatgggattagtgccctcataaaaagaacccagagagctcccttgctgtctttctgagaagttaacagtctgcaacctggatccagatcattcagggctttgcaggccattggaaagacctcggcttttactctgcattaggtgggagagccatggagggttttgaacatggagtgagggggatgggatctgacccacatactgaaggggtcacttcagttgctggcttgcgaatagaccagatgggtcaaggagagaaacaggagaccagttaggaaactgttttagtaagtgaatccccttcctgaacttgatgaaggggggatctgcaagtagtgagcacttccaaactggaccacatggggaggaattctgccatcacattcaacttaccccacttcaattaaatgcaattaactgcaggtaacaaaatgtggaagttacagctcctacattctgccaggtttgaaggacaaagggcctagcactcgtcagactcgcgtctatgcagagggctgctctgaccatcccttctagcaattgtctagtagcttctttcttaccaaagatgaagataaaagctatgaaaggcctcataagggcaagagcgtcatttcttttcctagttgattgatgtggtgacaaatcaagaaagaactaggaagaagaaagacagaaacataatagttaggaaattaatatcagattacaatattggtgggaacacagtcatagaatataacagtacatacttattccaaggcctctgactcactaaatttggggcattctctgttaataagaacaatggtaggaaatatttatcacctgcttaccatgggccaagtactatgcttgtttactttgtcatattatcttattagatttttgcagccattctgcaaatcaagtattatccctactctgcagatggaggaaactaggctcagagagtccagaagtttgtccaaggtcttatagcaagtccgtgatgaagccagcatgctagctaaccccaagctgtctgattccagaatcaagcccttaaaccctacactcttctcctttggtcatgaaaaatagttctgatatcagaagctgatgttctaaataggattgaagatttatgtttaaataaatttagtttaacttcacctttaatctgtactcctctatttacccaatattcaaagagcaagtaagacctgttagctactaataagagtgctgtaaactctaagaaatacattttgaaaagtgcgttaggtgctttgggaatgttttatcaaataattgcaaaggtcatagatagttgactcttcagactagtggcattttgttaggattacgtttgtataaaaatattatgaattatatagaggcatggcctaaagcaactaaaagcagcactttctaacatttattctctgtattcagactacatgaaatattccccagatatttattttgctatggctggaggacaggtttgcatatatcccactagccaatgtatgtcctgtttcaggtgtctgattgaattataatctgtacgaatcctatcagtcttgttgtagagataaactcttgtttagcactagctctttgtggaaatacaactacttcagataatggccaagtaattctcctttatcaactgctcagggtctgatccggaaatcaaaaaagggagccctttcaataaagattctgatctctcggaaacaaggcaagctctgacacacaacatctcattctgctgcctatcagtgatgagaggctctccattttgctgcatgccattcagacactgggagggagggagaaatactgtttagtaaattaactaatttctcaaaaattacaatgtgaactcacacatattttgctgtcttttttgataccaccataatacagggctagaatatctcgtaacaggaaataaatttgtaatcatcttctgaaatgtagggtggtcaagtaagatagcagatttttgccctgtagcggctcaataatctattcatcaagttttcacacggtacacttgcagagccaagacttaagaaattataccgtgtgcgttttaaggacaaagattctgacagcctgggaatctggagacccagagtcaaacctcgggagaaccaatgtgtctggcatttggattctactttataaaaatgataatattagactagttcttagttggcaaactggcagcctagaggctaaatgctgccatgataaatatgttgagtttggttcacataaggtggtggtggtttaattatgccaacattagaaaatttgagcagtttcacagaaaagtctggattcttgaaaagttttgaaaaataaaatgatctagaaatattgggcctgaaatttcaaatagtagcagtattttagagcagtgtaccagctgtttagagggcacatatcaaatttgcaccagaggccccaacatcccctgttgtcttccatacatactcaatttcatgtattcacattacttgcccagcccctgtgtaagatcgtctcagaataagatactgggatgaactaagaaacaaactcattcaactacccatgaaaggtcctttttagactctgcattgatgttggccacaactcctaaacctaattctgcagtattttggatttacattgttatagcgtcttggcttggtaaaaataatgcccacttcaattttgattgttttaacatttaaatgttaggtactgcagataatgccattaaaaatttaaccacccttgtgtgacgtggaggttgtaggaaaaaaaaaaaattaaccactcatagctgaatcctttgaacagttaaaatttatcttttgttaatgctgtgtatcagaaatgaggcttttaaaacttgttttgattagtgtttgttacttttataagtaaacagctcctttccttcatatacagagcctacgtcacttgtctggaggagttatttagtcttgttatttgtgagcagaaatttttaaaaggttgaatttggcaaatatagatatgcctaacatggtaagaggaatgattgtaaacagtctcccagtttcagagctgccacattgcaagacctatagagacacaaggtaagttacgtagatacaaacacagatctgaagctacacgtaacttaataccttgcaactggtgtgtgttgagctttaatagagctattttatgaattaatgggtgattctttgataagaatgtgcaattgatctcttcttttgtcccaaagaatttcatttgaactttgtttaaacttcttttcatctaagcaaaaggaagacttgatatgtacccaaagttattttgctaatggtccatacaacccttttgattcctttttttagataacttttgagccaaagtctatgttcctatttatattgtgtttctcaaaatcttcagcaatcaagatgattagtcctaaatgctctaaagctagcaatttattttcttttcctattttcaacctgtctgaaaactggctcaccattcctcaccccacattcttctatttgggtgtaacattccgagatgcagagttgcaaatttcttcaaccttaaagttagcttctatgattggatctttggacaaaattgacatgtagtgacttactcctaccaaaaaaaaaacatatatatatgcagaaaattttgcattcatactgtggaatttgagtccagacaccaaatacaagatgcagctaatgtccgtaacgtttctttaaatgctatcgtactgactctgggttgtctgtctcttgagacataggcgacttgagcatttgtagtgggcctgtcctttgggcagacttgttgttgctaaaaatactagttggctcggtatattcaaactgtctttgccatgttcaaggtagagagttgttcactatccagaagctttattacaaagtctaggacacttcccatccttggaactcatctttttgtctttggaagtcttaaaatttatagttcaagcattctctttcccagtcgaaaaatataattcagaagccaagagtttatatatagatagatagatagtacatgctagtttaaaaatgaatgtaaaaggccattaaagttgctttttaaggtttgaaatccccaagctttacttcaattgattgaaatgatacatgtattcaaatgtatacctaccaatttttgtattttgtatttctatacacacattttatattttgagacttaacctaccttttgcacataaagcagccttctgtaccaaagttactgagtttggactttgtttccaccatcataaatcatgcagatgagatctgtggttattttcagccacacatgatgaaaatactctgtgcctcattgatgtttctgggttaaatctttgcagaattgtgttcttggaagtttgttcttcctattatttatttttatttatatttatttatttatttattttgagacggagtttcgctcttgttgcccaggctggagtgcgatggcttgatctcggctcaccacaaccttcgcagcctgggttcaagcaattctcctgcctcagcctcccgagtagctgggattacaggcatgcaccaccacgcctgcctaattctgtatttttagtagagatggggtttctccatgttggtcaggctggtcttgaactcctgacctcaggtgatctgcccacctcggcctcccaaagtgctgggattacaggcgtaagccactgtgcccagcccctattattttcttagggtgccttttaaactgcttggtgcaaacccttctcactttaggaagaccttaatcttcccgcttgcacctcttcctgccccctgcctccaacccctccttttaccataaaagagaagggatctgttagtagtcatttattcttgtgggtgactgactagtgacatttgggaggaattagttcctgtcagggtattctgggtaagtatctgcaattgtgaaataacatcctaagagttcgtttctcattacaggaacttaaaaccaataaactagcaagggagtgaatactttagggaccccaggaatcatccaaacctttgactgcctttgagactaaatcttttaaaattcttttagaggttattagggcaggaaagggaagtttagaagccaccacatctggtgattccatgctaaaggccccctgtctcttgtgaagagataacctcaagcgctgactcagtattctgaaatgtcttctggaatcagctgaggctgaggaccctttacttaaatattgtcctggagaggggagaagcacaggaaggcatactaagtaacccctgaccaacctctatgagaaaacatcctacgagaaacatgacaactgacaaaaactgctgacaatcaaccatgcaaattgtgaagtgtcagaactctttggcttttaaaaattaacctttgttatttagatagtaataattacccatgtctaaataatccaagcaattcttttctctaataagttggttgctccacactgtgctttttttggacacctcctccaggctcaggcctagtcctcatcctgcccccaaccaccttcaacttgaccttccttctttcttctcaagtggtatgcatgtttatttaagtttctgacccagttatttatttaggcggtgttgagtgaaaatttcaaatgttagattcctttaaaattcctccaccccctatcacccctgccttccaaataaaaagatccattgccctggaatgcaccactgtgtcttcttgctgtgtggtacaaatgtaaaacaaaaacaaaaacaaaaacatgtgtctctggtgctttttcattaatagaggttttagaaaaatgtgcccagtgccttttacaaatatctttcagccctgtctcttcaccatccaagtgaagtggacactggggaggtattgatgctatcttccatgtcagaaactctttcttttcgcatttttataaatgcaaaatagaccaaagaatagaaacatcataaatacatcttgagatttttggctgctagcagcattatatccatagtcacaattaatgttcacatcaaacctgtaaggttgatgcttttattttgtattttatcatagtggtagtggtggggagagagacattgctaagcccagggtggttagggaacatacccaaggacacataactagtaattgagagagcaacgtgctttcaccctgctcaagttacttaatgagtgtagactatggataaagtgcagactgtaagctctatttccaaatacagaaaaaggaagttaggtgaagaagaattaacgaagcatttgtaaatcgcttcacccagtgcctggcacatggtaaattctcagtaaatgttagaaagtattattatcccagtataaactctttgagaactttctttcagggagaattttaatgacccattatttcttactagtgagatgtgaagttattgacttatcactgctgagcttggcatgttgagctctgtttctgtttattaatgtgatgaggttacttatggggagggaggatccctgctgtgtggtggcggtaattatcagcattgctgtgtggctgtaggaaccaattgctagcaagtgctgttttttttcttttttttttttaaatcccattatataatttaacaatcattttgttccatagtgagaggaaaagaatttagcagccttcagctggagctgaatgggaaagcaaattatagaaatcactgacagtagtgcctggctagagtaggattgtttcctactgaatatttgaaagtatgttgtccaatctaattttgaaagactcgagtcactgggcttccattgccttccttgggagctataattacatggcctaataaagctcagtggtgggacattttccccagctgatacaggagcaatggatgtattcacaggaggcctggtcaatgtacttttcaaaatgggatttagagaagggacacaaacatgttttgctcactcgggaaaatattcatttcctgctatcaaaagatgtttctttggtccatcctgctggcattgaaccctgatttgctatataatgggactttctttaactttgtattgtggagaatcctaaaaatacacaaaaataggcagaacagtataatgaacacctatgcacccaaaactagccccaacagcctttaatcagtggccagttccaccccatccacatgtccatctatgttgccccttctagttattttgaaacaaaacatgtcattttttaaaattttggtaacataaacataaaatttacctaaattttaactactttagaatgtataactcattatcattaaatatagtcacaatgttatgcaaccatcatgagtatctagtgccagaacatttccatcaccccgaaagaacactgtgtacccattaagtagtcattcctgttaccccctacacccagtccctggcatccactagtctgcttctgtctctatggattgcctattttggatatttcatgtaaatggaatcatacaatatatggccttttttgtctggcttctctttttttttttttgagacggagtctggctctgtcacccaggctggagcacagtggtgcaatctcggctcactgcaagctccgcctcctgggttcaagccattctcctgcctcagtctggcttctcttttacttagcataatgttttacgtgattcatccacatatcatgcatcagtatttcattcctttccatggctgaataatattttattgtatggatatcccacattttgtgtacctgttcttctgttgatagacattttgtttttttctgctttttgtctattgtgaatagtgctactttgaacactcatgtacaagtttttgtttgaacacctgttttcaattcttttgagtatacttctagaagtggaattgctgagtcatgtgtcaattctgtgtgtaacttattgaggaacccattaactgttcaccgcagtaactataccattttacattaccattagcaatgtatagaggttccagtttccccacatcctcaccaatacttgtgattttctgccttttttcttcttaaattaacatccatcctagtagatgtaaagtgatatctcattgtggttttggtttgtattttcctaatgactaatgacatcaagcctttctacatgtcattgttagccatttgtatatcttctttggaggaatgtctattcaagtcctttgcccatttttaaattgggttgcttgtctttctgttattgagttgtaagagttctttatatattctggatagtagacctttatcagatatatgatttgcaaatacttttcccattctgtgggctgtcttttcacagtcttgatagtgtcctttcattcacaaatgcttataattttgataaaattaattttttcttttttttttattttggtgcttgtgcatttgttgtcatatctaagaagccattgctaaatctaaggtcaaggagagttacccctatggtttctcctgaaagtttgatagtgttagctcttatatttaggtctttgatccattttgagttaatatttttgtatagggtgtgaggtaaaggtttaacatcatttttttgcatgtgaatatccagttgtctcagcactatttgtagaagaaactgtcatataattttatccataagtatttcagcatttttctctaaaagataagaacttctttttacaaaactacagtaccattattacacttttaaaatactggccaggtgtggtggctcaacgcctgtaatcccaacactttgggaggccgaggcgggcggatcacaaagtcaggagatcgagaccatcccggctaacatggtgaaaccccgtgtctactaaaaatacaaaaaaattagccgggcgtgatggcgggtgcctgtagtcccagctactcgagaggctgaggcaggagaatggtgtgaacccaagaggtggagcttgcagtgagccgagatcgcgccagcctgggtgacacagtgagactctgtctcaaacaaaaaaaaaattaaccagatttcttgagtatcatcaaatatctaagtccgtattcagaattgtaattatctcaaaatgtgtatatctttttttaaaaaaattaatatctaaataaggtgcacccattgcaatttgttggtgtatctaagtgtttttaaatctataagttttctttgcgtctctttttttctcccttgcaatttatgtgttgaaaaaactctttgtcttgactagtatcctggtctagattttgttgattgtatcctcatgatgttacatgttcctcagtcctctgaatttcctgtaaatcagtggctggagctagaggcctgatcaggttcagatttctgtttttatttttggcagtactacttcctaggtaatatgcgttcttataccaaaaggcaaattctatttacttttttatttatttatttttttctatttactttttaaaatgttaacagtcattgatgatcactgcctgagtctgctagcttattaggaggcacaaaatggtggcattcttctactatgtcttcttcatttattagatggaatacctacttttttatgaacagaaactttccctcttttattattcaactacccagtggtaagatttgtattaaaaaggcagtatagactcttcagtctttccttttatttgtcagctcttagttagtttgttatttttttctaacagtgccagtcatattctttgggtggtgggggatgaccttgttaaggcatttaattaagcacatttaaagtgtttctacacattacagctattattcttatctatgctcagattatcccatctttcaccactgggagtctcttgaaattgaatcctttttgacatgattttgtggtctttgatagtttctgggctattacatattgtaatttcccaacttttatctggttggaatgtagtctacttgtggcacttcccaaatttccctataagcacttataggtcttgaaacttccttggcttcttggagaaggtgggaaggtttccctagccgttgtggaatcataagaagacaagtcagaacaggctttggaaactcactcatgaaatgagtttcatgagattttatttagtttctattaggtatacaaagaaaaagaaaatataatttctgcctgaagattttggagcctgatgaggtatcttttaggacctggaaacatagtgctgatatcaggaatgtagatttggacaaagccaaagccatcaatgtggttttattgtggctccattttagttctgtctctactactaagtcaggaattgattgctagttattctgaattcttttcatataattataaaaaatatataagtacctaataaggtgatctttgttgaagatatttttgaaggtaaaagtctggaaatggatgtgtttttctaagcctagaaaatgcatgtaaaagcacatagatggcttttttctcaaatggtctctacatccccattgagtaagggtgatgtttattttctgcctattttataagttgctaagtagtgtaatgagtttatatttatagagtgcttggagcttttgcatgaaaggtgctaaattagagtttattgtttattgaatttatttgatgtgtccaacctcctgggaacattcgctgaagttaattaaaaacagatagttcccacactgacagcttacagtgccacttacaaaccagtaacataaacagtgtgcacttttgtaaccctaagttgggacacctagagaaccacagttctttctgataggggaataatcctacttttatgtgaaaatttgactgctgagttaaaacagagatattctcaattttgtctgagtcacctacctactcccattaaaaaaaaatacttagaatatggagagtttcctcaattttcaaatataacttacaggttgaaaaatttaaaaataatgtttcctttatatcattttgggagtacatgaaggtaaaagcttgtgttttatatattgttttatgataactttttctttgcaggaatggcattccaaagcagccaattgcttgtgctttcttaccccaacttaatggaagcagtgaagcatcattaaaataatggcttgtttgcttcctttgccagttggtgatggagttttgtggtgctggctctgtcaccgacctgatcaagaacacaaaaggtaacacgttgaaagaggagtggattgcatacatctgcagggaaatcttacgggtaggttacgagtggggactggcccacctcccaaagtcttcaagcaacacatgatatcttatgagggattgaatttttttctgactttctagtgaaattcataagcatatcaaaaaccctttaaaagtttatcctatcagtggtggtggtggtggtagtggtagtttggtgtgaaggtctgctctgatggaagtgagcgccattctggagataggccatgagcatattttcatttaggttgacattgggtgatttctcttaacaagggattcattttcaatgctgtttccaattagaaacctgattttagatcataaagacagtgttccacttaggaaatgaattattttatgagatattttaatcactcatttaagttatctgtttgtgaaagttcacaattaatatattatccctaatggtgtaataccttcccaccatataaagtttataaggattgtgtgactttagtcattcctatacatacaacctagtttaaccgattttacctttaaaaaaaatctttgtgacctaatcacttaaactaatcaaaatagctgaacaagactgcctgtttgcccagttttcccacacatcccccaatcaggaaatctagacaatagtatcatatttgctgagctgagttcaggaagaagaaagtaactgggcatattttagttcattcagactagcttaatcatcccttcctactaatatggaggttattatatgtctactgagcattcttattaaatcttcctggccattgttatttatttataagctctgccttcttaatttaaggcaacaaaagttaaaacttttttactgtgtgttcaagatatgcctttgagagatagattgtatgctttgggtggatggatgaaatggatagaagttaaaaaagaaggaaggcataagaagacgatgtctgttcattaaatgcaaaccaaattaggcaaaaggcaaatagaaaatggaattttaaaattataacattgatgtgaatgacttctatcctgaaaactacaaaatatcactgagaaatattaaagaagaccttaataaatggaggtgtacattatttcacagattacccaatattctaaagacatcatttctacccagtttgatccatggtttcattgaacttccaattaaaattcctataggtatatttgtggaaatttataaagctgattttcaaacattatatagaaatgcaaagggccaagaataaccaaggcaatcttgaagaagaagagcaaagctggagaatttatgctaccagttatcaggatttattataaagctactaataaattaagacagagtagtattgttacaagattagacaatggccaaaggaacagaatcaagggtccaggaacagacccacatcatatggatgatacctggtctgtgtcaaaggaaagggttcttttatcagtaaatagtacttgatcaattgaatatccataagaaaacatgaaacctgacacctgctacataccatattcaaaaatttattccagctgggttatagatataaatgggaaaaatataaaaattaaagcacttaagaaaaaacacatacatccatggcttgggataggcaaaaatataaattatatgttttgtgttcttaaacagaacataacacaaaatttgaggggaaacaaggaggcctggctgctgatttccttcacatctgacgtttatctctgttttgatgtgccattgtgcaaacttactttgaatttctgacttaaaattttgctcattcagatagagcataatggattatttagtcatcctgaccactcagtggctgccaagaacctgtcaggtctctagggctggttctgcccaatatgcctttctgcactgctggggaaccctacagaggatcagtcatttgatctaatcttcatggttctaaaagcagcagggatgtttcatcacatgagcatctctcaatacctttcacacattctcaatgtgtggaaacaatggctttcctcctttttccagtatattctccgaaatgataccagcatttcagacatgactcactggaagagacatttgatcacccaaaggtctctggccacaagaggttttggaggtgacctccatgcattgtatgatctcattaaaagaacttttggctcacttccatgctctggtatctgctttcaaccacttcagtagtgaaagagggaaagggatcttcagtccctctcttaaggatttatggggtacataaattttgtgaaaaccacacatttaaacccctgatgcctaccctgtgacaaactgaacagataagaaaggcaattttttaagacctaaaccagtgcctcaaacccttctataacatggtttatgttttctgatatctctaaatgtatatgtgggtctttttggacctctgtactctcatgctgaatttctttgacaagagaattcagatatctaggtttgtttcttttcctgtcaacctcatttttcataccatgattttgttgttgtggagaagatgaaaagcacaaaaaattaaaggtaataaagaacactcggggacccgatacattgaattatcaggtgttagcataaaataatttgctttaagactccatttttagattattttagattataatttatctgaaaaatatatgactactttagagtaagtctgtaggttaaagaattcacaccacaaagaagccaaaaacagagtaattcatgaagaaatggaacacaaacaggtttagttgtcactgaataattctcacataatgagcacaaagtcacaaatagcataaactagcataaactaaaaatgacagtgatgaatgccaacaaaagaaatagaaactgtattcctttttaaatgtaaggcacaatgggtaaagccaatgggaaatttcttggctggtctgagaaatattttacttcgcttaattaaaattgtataacaaggccgggtgctgtggctcacacctggattcccagcactttgggaggccgaagtgaatggatcacctgaggtcaggagttcaagaccagcctggccaacatggtgaaaccctgtctgtactaaaataaattagcctggcgtggtggcaggcacctgtaatcccagctactctggaggctgaggcagtcgcttgaatccaagacacagaggttgcagtgagcccagaccacgccattgcactccagcctgggcgacagagtaaggctctgtctcagtcaatcaatcattcaatgaaattggataacagaatgtaaattttaacttttaaattcaaatatcctgcagggattcagttaaatcaggttagttttctgtacagagactgtgtagatggttctattttaaactgtttaaacttcgcttttcacagtagtattaactgaaactcatgttcatgttggaaccgtataattacttgtgtggttccctgatacctgataatcagatccaatatgcaagcatttcattaaacacagcaccatgcattgcaaggactgcctgggtactttaatttatattgatgaattgcctacagttagaagagcactatgagcacatgaaagatgtgattataattctgaaaagtatgtctgggtgagtgtaaagtttttggatccttaacagtcaaaataatttattggcatcttggcttatgttcctattaacccttcttaactctccatcactccaggggctgagtcacctgcaccagcataaagtgattcatcgagatattaaagggcaaaatgtcttgctgactgaaaatgcagaagttaaactaggtaagagcagaatcctgtgagccttggaattgcaggaagtgatgagattatattaacagctctaaaaaaattaatgttaatttgtcaccgtggatttggagagcattgccctaaaaatggaaaggaaaatgtttctttgcctattttaaaaaatattttctcaaggcattctgaggaatgaattatatataatgtgggaacagaaccacttgcttaatcaatatatagaaataattgagatttttttgtttcagcagagattagaagtgacaaactttgaaatggcctcctatatcttacagtttgtttatactgttgctgctataacagagcactaggacccaatttttttccattaaaatatacacaggcatattcagaataatcaattcctgctatattcccataggtttaagttatatttacattgattttgttattaccttgggctcccgtgcaaagtggatacttaatattctactttaggtgcatactgattacccccacttccatcagtgggagaatccttctctttggcgtatctgttagagctctttccgcaacaaatctgggactgcccaaatagagaattaccacatgcatttgactgcttgatgtatatgagtaagagcatgaattgacaaatatccagtaggatatgtaacttgtcatctagaaaagaatcgctgtccatatgattgtatattttcaaagagatttaaacatcttctatgtttatatcccaaacatttgctcttcctttttgttgaaatatatgacttccattttttttcttagttaacatttgggaccaaactttctcacctcatgaatattctcttttaaaaacaaaagtatacattatgtaggctaagcagttatatatgtatcaactagataagctatcctgagagcattcttacttcactaattaacagttacttgttgagtatatattatatgccaggccctgtacaagacaattttctatagattatctctcataaacatcagagcaactctgtgtagatgtcatcatcctcattttacagattaggaaaccgaagctcagagaggttgatctactagccctaggtcataccactagtagcggcagaaatgagatacaaacttaggcagtctgactcagacttttgcttttaatcacttgtcttgtatccccaaaatactaccctttctgacaaccaagcttacttttttttaacacctatttttggtccctgtgaagccttggtgtaatcaaatgtaattctttgtgccttcctcatgggtacacttcatccatttctcatgcagtttaaaaacatattcacaatatagaaaaggtagaagcaacccaggtgcccatcaacaggtgaacagataaacaaaatgtggtccatacacacaatggaatattattcaaccttgagaaggaaggaaattctaacacatgctgcaacgtggatgaaccttgatgatattatgctaactgaaataagccagtcacaaaaagacaaatactgtatgattccacttatacaaggtagtgagaatagtcaaatttatagagatggaaagtagaataattgccaggggttggggcaagggggaattgggagctattgtttaataggtacaaagtttcagctggggaagatgagaaattctggagatggacagtggtgaaggttgcacaacagtgtggatgtgcttagtgccccagaaatgtacatttgaaaatggtcaaaattgtacactttatgttacttatgttttaccacaataaaataattcacattcattttatcgctatctaaaacctatgatcacagactttatttacttgtcttttcttaaatagtggactttggagtcagtgctcagcttgatcgaacagtgggcaggaggaatactttcattggaactccctactggatggcaccagaagttattgcctgtgatgaaaacccagatgccacatatgatttcaaggtatggcttctttgtcgtgtttcaaaactatgcctaccatcttatcctgagtcttataaagtcttacatgcccttatatttatgatttatgtcacccaaagggagaactgaaaaacattatttgagtttaagacctgtaagacattcaagtgaggatctttttaatgaattcacccatcttatctgatggcctgtttgtaaaaaataaaaaaataaataaaaagtttaaatcattttctatatttttttaaatttactcttgcttcttattattggaaaatagattggatttccattttggttatggtttagatttttggaagagtatatattctgatagctttttacgttaaactaagatgtgagtttgttgtcttgggtcatctttttctgattgagaataatctgacttacttctacaatgctcgaagtataattatctggggtttctttttcatgagagggaatcagatggaatattggtgactactttatggtatttctgtcgtgtggcctgatgtttcatagaaatttgatttgtgacttgttactttatattataaactagaaatttgctaatacattcaaagctgtgttcaaatagatttctccaagaagcccttctcttttctattctgctagccaataaccaaacataattttgcattattgcccctcaggtttattgtctggactttcaggtgacacggctttctaatgaatggtgactgaaagtcaaggcaataaaattaggggcaatgggatctaggaactgtgtgtgggtttccaggctgtgcattaggtagagagacaccctgtggtctttgtgtacattacaggacaacttgggcaaaacttgatctgcttgggctggtttcagaggtgcatggacttttcaccaaaacactttaatgatcctctgtaaatactcttatctaacagatgaagaaactgaggccgaggtctgcaggtgctcaccgggttagcaatcctctcagagttagcacttgaatgcaggtctccaaactttctgttcagagccctttccaatatattaccttgctcctctgtaatgtacttccatataaatctccaatttatcaattgaacagtatatttgaagaatatttcacttttaaggaatatttttagttctcgacatgtggggttattattgaaatcaggtctcaaagatgcaaacattgcagcgtttttgaggccccgtatctcagtgttgacagaaaatttgcctcttttgggaattgcaagcttgaaggtctgaaaacctaataatctcccataaatttcctccttccttcaaagttagtcactgtaataacctgacaacaatctgtctgaaaacagctgccaagttaaaaattaatctcctgccaaaatgtcatttttttaaactgctaatgataagcatatttaaataattctgtttgcaaatcccttcagagaagccactacaaaatatacatcccaggccagatatgggtatcatgattagctacaagcaattcttcaaaccatagttatacctaacaagtgctaactagtctacatctgggccacagatattctagattactatgtaacatagcatggggaaacagcgtttgcagctcttacaacctcagcttaatcttttaagtattgtgactgactgcactatatatgggacttttgttatgtaaataaagtgggtgcctacaactgacttgttttcagtagggtatctagaagaggctttccttctggccaagccaaagcttggaattaaactgatattttggtcctctttcctcagattatggctaaggagtatagtttaagatcactgtaaatggtgtgagaccagtgcataactctaggtatgggcaaatcctgttgtatgagtagccacagaggtcgtcatgctgcacagtgatttcagaggtactggaaggctcacctggctataaaagtatcctgagacattaaaaagattgaagatgaatgtctgtgtgtttttttaaaaaataaagaatcctgatagaataggttcaatggtgtcagtcatttagaccttagtgcaaattagtttaacaggattgtcaggaatgtaggttgtgcaagaggaggaaaaagtcatggcagggatatgagcttcactggttatatgccatgggtaaaaagaggaggatgacaaaagaatgaataaggaagacttttctacagaggactttataatattgaattattttaggtttttaaaaaaattcatagtggtcttcaaagacatcttagacaaatcaaatagtaaataataaataacaaaaccaagccataccctgttggggtatagtggaaggtttggggattctttgcagatttatttaatccacttatacagttttactgtgggccagagaagatgctgatctttaaataaccttactacttctttcttggcaccatatatcatccccttttctgttcagtatccttaggaatgtaacctgtcaccaggggacaacttgacaatatgctgactttcaaaatcatttattcattcactcagtgcatatttatagactatccattgtgtataaggagttagtcaagctgtatctgtacatgcagtttctgatagaaggttcatttgagaccccatcaaagcccgaggatttcactgtgtgtttggtggtccacttggcccagtggtgtatcccagccccagaagcttgatgtcaacactttgggccctcatgtgctatagccactttcagccgagagtgtgtatttagaataaaggatgacttggccaccggactttattagatttcttaccacaaaagtcctttctgtaaaataaagacaagaagaaaaagaaaaagagtatagcttagttttgttatttgatttattgtttatcaattattttttgatgtgtctaagatgtctttaaagaccactataactttttacaaaacctaaagtaactcaacgtataaggtcttctgtagctttttattgcagagtctggttttgtgtgatatctactgggcacagtaagtaactcactgaaaatagaccctctcctaaggaggagtgccagaatctcatttgccgggtgtgctggctttcccctggaggcccttcctttcttgttttcagaaattctgtcaaaacacttcaagtgaaaggaaaggtttcatttccctgataagtatgtggggcaataatgaaagctttcccgtttaataataagcattcaaaagatttgaaattaataaaactgttcaaaatgcctaggctgtttaaattgttatttttttaacctactttgaatttcattttggttggatgggatctgctaagcattttatagtcctgtgtatttattactttaacagaaccacccactaagaaatttctgtggctgaatgccacagtatagtacacataatgtagtcttattcacccctcccaccccatagacacacacacacacacacacacacacacacacacacacgggaaatctataaagaacctggaaaaacttaatagtatttacttttgaatagggcatgtggatggaaaacttacaatttttattttctatatctttctgtcctgttatgttttttgccataaacaggccttgctcttatatgaagccaatgaagtaagagatgcacagtgaaatggcttacccccttatcccactccccaccagattcctgtcctcaggcctgatctgtgccaatgttgtttattatttgcctaaactctgtttatgagactttcatatgggtgctgcagattatttgcagacatgggtgtctcctccagcgtttgggtgaatattgtgctctggttgtagagaaaaagtactcttttcccctgtgtcacagataattggcattattcaggcagggtggaaatacttcttctaagtaagagtttcagttggaaatgaagtgagcaacctaactagtggtagagtttccgccgtgcagggtgtcacctgagaggacaatattcagattgcagaatgatgcatttacactctcaaacaagtcgtggcctctgtctactgagattcaaacaaaggtccttccctattcgatcagaaggaagatgacccagatagcatgttagtgtcaccaacaggaaactgaaactcctattcaacatatttctgtggctctctgttcacacccacctataaaggattccttagtgaaacgcagccagtacctcctccacgcaacatgctgatacccaggggaagagagtgagctattctaatattttccctttggtcacataacaagtgaaaatggacaaaaaactaaagatttctgtcctcagtttgttttatgtgtgaaatgggattattaataactatctccacttcagtgaccctaactcaccacctaagttctgtatctagataacataatatataaatatataacataattaataagagtcagtcctttgaagtcagacaggaccagtttagactttgcctcctatttgcaaattaactcaggggagttatttaactttttgtaaacctgcataaaatgggaataataaattgtttattcggaggttataatagaataaagtgagaatatatataaagggattaatacagtgtccaccacttggtaagtactcaatatatagtacttagtatatatattatagatagttttgtgtttatgttatcatatggaagtattgctatttggggccttttttttttttttttttttttaagacggagtctacctcttgtcacctagactggaatgcagtggcacgatctcggctcactgcaacctctgcctcctgggttcaagcgattctcctgcctcagcctcctgagtagctgggattacaggcgcccgccaccacgcccagtgaatttttgtgtttttagtagagacagggtttcactgtgttggccaggctggtcttgatctcctgacctcgtgatctgcccaccttggcctcccaaagtgctgggattacaagcgtgagccactggacccggtgggggccattttttacccctaaaaggcaacagtttcatacggttcaacctcatatttgtgttacacacctctgtctgcttacgttgagccagaatctgcttctctataacttttaccactcaattaagatgttgtccctagggaccatacacacaatgcatcaatttctttttcccacctggaacatttcaaaagaataaactagtcacaaataagttacccaacaaaagacgattttctgctctgtgatacagtatgctggctgtgcccattattaagctattgtctgtcaactgtggactgccgtgctgctctctgctttgtgataatggagctaggagtcagctgtcctcccttctgtttgtccatctgacttcttatcaggctctgccagcagggagcaatagagaacgggagatcaagtctggaggaggaaggaggacacacgttttcctgtttgcttcctgtaagcttcttgtttatgcctgcatggtccctgtgacctctttgaccaccactgagtaccagagctccctgtcatcttacctgactctggtttgctggttgaactgccagttgatgatatctggtcctaagggtctatctgtacccacattcgttgaatacccaatgcagcatgtactgcattgtatattaggcactttttgcatattcttccttattgaattctcttaccagtcctgcaagacatgtgttcttttcctgttgcagttcttttcatgggctcagagttgttagttgtgtcacagttgggtctggctgcagaccataggcaccttctacctcatggtgcacattggggttcttgtcttgtgccacacagcctctcattcttctgtggctggttcagacatctaaacgtgttgcttttcttcactgtgttgagcagcccagccccagaaggaatgctttcttgttctgttcaagttgcttgtgtatcagctgttccccactcccaccctttccagcagccaaaagttctgtcttgcctctgccttcccaaaggcactagaatttgtctctcttctgtttgtaatgcacatagcgctagggtattaatcatgccacaggctaggctgcacaacacctctggaataatgaattatccagcttctgccaaaatgagtcacaccatggccatgaacgaaacttatctctttctgactctttcctcatcttgttcttccatcttcccttgcttgtctcctgtgatctgtcttgccagtggtaattggagcattttctcctttacttaagttctgaagtgtctttgggactcgctaatgtatccaacggctaaacaaggcctgtcaaggacatttatggctttctagcatgggcagttgagtgtagcttacaagcaactttggatatatatgaccaggaatataaatgttccttttggaaaacaagagaaccccagccaaaaaaaaaaaaaaaaaaaaaaaaaaaatcctaacaatgatatcaaatgaaggcttaaggaagcagcagaattgactaggtcatgtgacttagcagagtatgcacaggtatttgtggtgatatgacctttggtttgaaaggggtgttctggtggcttagggaaaggctgcccaagagggattctgaggtgatgtgtactaaataaagtacatattttttccctaaaccttcttgcttcctgtggaataaatccaggattacctaacaaatgagacctctccatttccttactgtcaaagtatgttcttcaaattactgctgtatgtgtattatcacttaggaatgcttttgtctgtacttacgtttcttatgtcaccagaaatctagaggtaggcagttcagggttcatgtgatgcttcactgataccttcagaaaccgaagctcctagctttctgtgctggcatcattagtctgttggcaataactcatggttgcaagatggatgctgtagctccagatatcatatttttattcaaggcactaagaagtgggaaaaagttagcaagacactagctatatttgtcccttatttcaggaaaagcagaagctcccagaagatgtttgcttatgtctcattggagaaaactatgtcacatccctaactgccatccttagctgtcggggagtcaggataggcaagtgtggctttgctatactctgaaatggaagcagcaacaaaaatgagggttgaaaatgaccattgggttagccaataaacaatttctgccacaactaaatgaagggaaatcatagaagactaagttgggcaggcaaaggcagtgtcacctgacagtggagaagaaggaaatcaatattcttgagccctactctgtgccagattttgtgctagcagcatacctgatcaatacatgcatgccacggttatttccattgtgcaattgagaaagctaagctctgagcaacagtctgcatgtagctaaattggaaacctctatttgaattcggatctgcctgtcttaaaagcctattctcagctgggtgtagtggctcatgcccataatcccaacactttgagaacccgaggtgggaggattgcttgagcccaggagttcaagaccagcctgagccacatagtgaaacctcatctcaatcaatcaatcaatacctgtttctttctttctaccaatccatgttgccattgggaaattgaggcgagttttatagcatgaaactggagtacctcactgaatctcagtacctttattgagttgccagcaccttcagtcacctatggacaaagtaggaatctgaagtaattattttatggattaaaaatgcattttgataacaaaaatgataaggggaaaaatggtgaatactcaagtccttagattgtgatgctagttaaaagagaactggcctaggaagcagaagacccagctcagtttaaaaccagctgctaagttgctctttgatcttgggtaagtcatgttccctcatttgtgaagtgaaaggtttggctaggtgatctgcaaagagtctactagccctagaacacttaggttttgctacgttctctcatgtatctttcatttgttcattcattcaataaatatttattaagggcctactgtgtgccaggagcagttctaggtactttggatacatcagacaacagaacaaagatccttgccctgtggctcttaggttcttatgtatgtgtgttagaggtaaagggcacaagcaatcaacacaaaacatggtaaattagtgatgaataaacatgtcgtatgttagaggtggttagttctgtgggggacaaatatggggaaggggcatgagcagtgctggggggaggtcccaggggtcctcgttgagaacacaggggttgagcaggctttggggaggtgagggagtcagctagcacatcactgctgaggtgctgcaggaagaggtaacagcttgagtcaagatccaaaggctgggccttcgagcattttccttcttcctgacctgaggcctggccttgagttcttcttaccccagaaccatcattttctttcacatgtattggttttcaacccagctcaaagctttctggacttgaaagccatttaaattggacccttctgttgcagttagggccatagagcctggctgccaccttcttacttgtgtcttatttcacgctatagaaactctcagttcctagggatttgggtaaaatggtggtagaactaccaaggtctggagatactagagtcttatcaaaatagcacagggaccttaagagccaacccaccatttccagactattattgctgtgtttcctgtttaaagcctcctgaacagcaaatgattcagtgtttctctcatgttccgaaatgattatctttgtctatcaaccataaaaccccaggtacaggccgggcacggtggctcatgcctgtaatcccagcactttgggaggctgaggcaggtggatcacgaggtcaggagatcaagaccatcctgactaacactgtgaaacccgtctctactaaaaacacaaaaaattagccgggcatggtggcaggcacctgtagtcccagctactcgggaggctgaggcaggagaatggcgtgaacccaggaggcggagcttgcagtgagccaagattgcaccactgcactccagcctgggcgacagagcgagactccgtctcaaagaaaaaaaaaaaacaaaaaacccaggtacaatagaactgcgtttttgtctttaccagttattgctcctgagccaacttgtaatagatgggttgagccatccccatcagctccggaaataacctcactaagcgaggccaagagcctctgggagactcagtcacttgctaggccagagaaacacggggtgcagattgcgtttaatgaaaatctttgtgtacatcttgaaacataacaaagagaagggacaagagttgactttgtgagttgtgttgtatgcagagagttccttggagtcttagaatgatggtgttgtgaaggtgcattgctattcccagttgaactgagaactggtaacattgaaagaatcccccttgctcctagtgtgaggttacacatgtgccccagccacctgctctcaggtagactgcactttaggcaagaggctagaccccctagaaaaccccctccacattgtgcagacctctgcccaattactgaagagccctgagtgtcatttcacaggatattgagaaacttagttctggggagtgactcagcatgaaggttatgaattttatgaagctctcttccagttacatctctttttcatgtggccttgacatttgtttgatggcaatagcaaggaaacttacctttgatcactctaatctgagacaattttgaaaaatgtacaaaatgcatgaggtatttaaaatgaaatatctatattaggatgtgggccattgaaccaaatttgatactagattttcttaccaatctgctgtgaaactgaggcagcaagcctcttcttggtgttttctaaccaggttttccccatctcttgatattccccctctcatgcaatatttagagactactgagccacagacagagtatgggaggagaatattgttagagatggagattgtacaggtagaaatggaggcattagcctagaaaattctgttcagagaataaaagtcactctgagcataagaaataatataaaggtatactggcctctattgttacatactagtctactcacaaaataggcaataattgtttatcttttcaacaaatactttgagtacctcctactgtgcccaactctgatctaagcacaagagagacatcagtgaatgccatcatcaaaaagtctccctgtcctcatcttattaggtaaaaccatatgaaattgctgtttttctagttaaaccaattgaatataaataacacctactatctgatccagccattccactctcaggtatttaactaaaagaaataaaagcatacaccctcggatttgtacaccaatgtttgcagcacctgtatctgtaatagcccaaactagaaacagtccaaatgcaaaaacagtgatatgtccatagaatggaatactacacaacaataaaaaggagtgagatactgatatgtactacaacatgggtggacttcagaaacactattctacgtgaaacagatcgaatacataagaccacatatgatgtgatttcacttatacaaaactttggaagttacaaactaattcatagtgacagaaagcagatcattggttgcctagggacaggagagtggggatgggttcaggcaggaaaggaaggaggcaaatgagatctttgggggatgatgggtatgtttactgttttgactgtgatgatgtgttcacaggaggatccctacgtcataccttatcaaatggtgtactttaggtacagtttattatatgacaattatagctcaatgatggtgttataaacagtcaaatagcagcaatttcctatggttcaacccacagataagtttcagtaacgaattaatttaaaattgtttatattcatttttcatacatttattgataagctgccatgtgccagacaccatgagtggtactgtcaatgaaaagtaagactgtttctgctttgaaggttagtggaagaaataggtttgtaaacagaaaactgaatgactttcacaggaagttctgaagcaattaccaggtttaaccaagttgtcctttgttgactgaatttatgtgtgtgtctgccccttctttttcagagtgacttgtggtctttgggtatcaccgccattgaaatggcagaaggtgctccccgtaagtaccctcctctggggtgaaatctgttgctggtctgctctgcaggtactgaagtttccttgccaggagctgcagttgctttacttccactacaccgagccctgcatggattcaagctggcatatttagaaagcagagtcatcttaaatcaaccaggaatccattcatttcagagcagtgggagaatcctgtttttattagaaaaaaaaaaaaggaagaaaaagaaagcatactttggggagtcttgtttgttttacagattctgtacatcatttattcttggactactcctcacctgacataaaactgtgaccaactcacaagactataaactccaatgtatgaaaatccaaaattaattttcagtgcacaggttatacaaagactccactcaatggctatcactcctcttaaaatactgatgtttaaaattttagatttccctgctatttgagacagagtggctagggctccagcagtcttgagaatctcagttccttgagatttggagtattggccccagcagagagtctctgtcatgagactgtgcctcacagacttccatataggaagtgtaactgattgtcagccccagctgctgcaatggcagcaggccgcacctttcaagggccactccccgccagtgacctagcacagtggggatactaaggcaggccctttcctggaggacacaagattcctttgtaggcaactttcacccaagtaatcccctatgactttacaagacctgcaggacaggctgggacccttccacctaccttttctccctctctccttcactcagggtcagacttgcatagcaatctgatgacttcccatactgcctggctccttccctgtttccattcacatagtaatttacccagtaatatccttggtgtctgcatctcaaaggactaggacaaaaataggccctttatttgcacgacaggtcattatacttatgacttttaccttcgggttgtcatcgttttcttacttcccagtctagaattggtagaactcatctgtagcatgattgatttggagtgctggttgacaaaattgccctcattcacaatgctaataggcatgtgtgaatcagaaaaataatatattgcagtcttaaaccatattatcattcttgatgagtggtagacagggctaaaaataaacttctgcccacagaatcctttggcttttagggagcatatattcttattctagctacaaagtagaaattctcccagatgtttgaaaagtaaactaataaaatattttattaaaataagaacatatgagtgctttcactataaacgataatgtcatgtttacaagatgagatctttttataactttgtttttctgccagactctgtgtgacttaatcctctgggcttcctggggccagtgaatttaaaaacaaaatgaaacaaaacccgttacgaaacctgaaaagccattcgggatatctggaaacagagaaaatggggctctggggctggtgttttggactccaaaaatctgtgtagataacaattgcatttggatgagctgtcgacgtgtaagaaatagacgggataatgaaatgccttttatttatggcttaggcttttactaattaaaaatagcttaccatctccattgtagttgtcatctgatggtatttactttaaatgtcaggtggtcattcacagcaaggatggctggttgttgaccctttaacttagtttccttaaatatgaagtaaacatgtattcactagaaatgttagcagtagctatgtgaaccatgttgtattttatgagactcctgtaagtggatattggatctttcaaatgctcagaagcatttggatattctgactttgtgctcactggtggtgtgtaaactgagtgggtcattgggcagccattatctgcacagccaagacgggcttggcctgggtttggcctcctaactgtagctggcccttgttttggtctcttgcagctctctgtgacatgcaccccatgagagctctcttcctcatcccccggaacccagcgcctcggctgaagtctaagaagtggtgagtttggtcttcgatgtttcgcagatctaagggtgaggttttcttgtgattctattttggattagctctaatccctaggtcctgctgatagaatgagactaacatgtatgatgacttggtgaattactttccatatgctgtcattcatcttaaagtatatattgagtatctactgtttgtacagcaggtctttattcccccacctttaaggtaagaaattattagccaaaatgggtaagtgaagccaagtaataacatgaaagctctttgatctataactccaagtcatatctttcctggcagcacagaacagcttatcagagagggtgatagtttagagagtcagcctgttagattggctgatttctcttctattccttacaacaatcattccctaagtgcatatacataccaggtaatgtttgagattatttctctggctcgtgtatgagcatttgcagtttttttgtttttactactgttttcacatatggcaggtgatactggcttcttatttggggcagcgatttaacttttccttttgataaacttacataaaacagtggcttaatttaaaggaaactactacatgaatactagtatgagtggtgtgagggtacggcaaaaattatgttgataggatatgactgactgacatttgggaaacagttctacaggttaagccagatgttggatgtttgactttttggggataattatatagttgggatcttcctatcttattattccataaccaaaattcattgcttcctcctttcttcctatggaaatggtgtatcctccctgatacattcttgaatctcggattactcatggtctgaggtcaattcctgcactatttgtgacctcctatcctttttctagagataagtcctgggcagtgagaccatgagggacaggatccttctgcccctttccatagcccttcatgatcaggcgcttgactggggtcctcatgtttcccacccacccacacacaggctcacctctaccatacagggggcagccttaattaccaccagtcatctactaatgagagccaccctggtggaacagaggaaagggcacactgcacagaaagagggaaggaaacagccagaaaagagatggcagcctcagaattgccgggccctgcgaggggagtgagagttgctattggtaacaaggaggcagagcgttccctgctcctccttcctctgcagagggtcattgtggtgcaagacaacccttctctccccagcaacagccctcccattgggtgtcatacatcatgtgatcggcaaagcaccccaacaccctgcttcctctcttctccctggatcagactcccggggagagggactggcgcagttctcttccctggaagtgacagtgacactacaaagccctctgctaggttcctgcttgatatctgagctgagtctggtgtatacagtgggctttacttaccctgttccctgccctatcttctccttgtctccctttactgctgcaggacacgtattctgagcttttccacagaggaggacaaactggccctccacaaatgtatttggctgtcacactatggtcatataccctgttttaaaaatatgtgtattaattggcaacacttaaaaatctgtcaattgagcattacatttagatttctggcctttttcttgcaaagatgcagtgaactgcctgcaaagatgctagctgctgctcccatttaggacaagtgattgtccttctcctccagctgccacctccccccaactcagaagctggtgtcagttggttagtatacatctcctgttttcttttcttttcttttctttttttttttttttgagacggagtctcgctctgtcgcccaggctggagtgcagtggcacgatctcggctcactgcaagctctgcctcccgggttcacgccattctcctgcctcagtctcctgagtagctaggactacaggcgcccgccaccatgccctgctaattttttgtatttttttttttttttttagtagagacagggtttcaccgtgttggccaggatggtcttgatctcctgacctcatgatccgcccgcctcggcctcccaaagtgctgggattacaggcgtgagccaccgcgcctggccacatctcctgttttcatcttaaccatggtctacaccacccctttttgtgacctacctgaccccacagaaaagtgagtgaacagcccttgccctacagtgtcagttttcaccgactgagacccaaaaaagatcaacggtgtgctgaccttgtttgagaaatacaaacttttaggacaatgcagtctgatttttcggcttcaaacctttgacaacaactaattttaataatgctggagggagcaggagaagtttggaaacactgagaagtccaggccaatttcatctcatcctgccaccttgcacacctttccctgatgtgtaaggaaaactgagtaggaaagctatgggaacaagtcccatattgtcagacagggaaaggaaaagtaacctgattgctagagagagaccggggaaacaaaagccctgataatgtgccatttcacacttcgatcccagcctttgtagaggtggtggtgcagcctccaggcacatgatacttgacagcagacatggctcccatttctctgcaatacaattccaccagtttttaagtgaaaatatttaaacacttcagagtattttatcttgaaagcgcaggtccaaagtgatttgaagtaagttagggtttactttaatagactctagtgtttgagaggaaatgaaacattttgtttatgttttttattttaattatttaagaggaaaagactccctcccccgaccaagagacaaaattccaaaacattcttttatttccagctattctctacctaaatgagttaccgggttaaatgccttgttctcagtgtatatatcaacacctgaccaaagggggcgccattgttgagacagggccatgaactcttctcatggcaaacattcaataaagcatcattttcaacatgactgagtctacaacatacaaggcataaactggtctcttagtgtgaactttttttttgttttttaacttgtaccttcaagatttgagaaataaaggcagtggcactgctctttccactgtcatcgtggagggaaaggagaccaccaccactcacaggagcccagttcttccttccctattggtatgatgaggagaggcctttgtggtatgggatgatgaagttagggcaccactgaatgttcaggcagctcagccatttaataataagttgtctgggagggttgtaacctttgtggaatcagaggaaaccaaagatactctcaccctctacctccatatcagcaccagcaagtgaaaagcaagactgggatacccattctctcttcctgtctcttgtgcgtgcgtagattccactcgcaggggtaaaccatctccttcaaaagattttctcctaccttctcttgccaccctgctcatccacactcacctgccctcgcaagtatactcagtgtcactgcttccctccaggactttctggagaaggataggaatggctccattaagtataagacagtgaatctttcatgtgccctttaaatttgaagagcccacacaggcaaagcagcactcagttgaggtcattagaaaaatcataactgcttatatgtacaagctccactggtccaagccactcatgcttcagatgcaggtgtgcaggcccagtgaggctaagtggtgtatttgcacgagttctagcctccttactgggagaaccagcctggacccagcctcctgcttttgctccaaggctaaaaatcacccccgttattttatgaggcaccagttctgattcttggtgggttgtcagacttttgagataggacaaagttcgtgtgtgtgtatcagaaattccttctactagactgaatattctagtagtaatgtgactttgaactttggactttattaaaatccagctaaaaactattacacagactttaaaaattaacctgtttgtgcaggcttcttggagataacagcccagttgactcctcctgctaagctatttaacccatacgtgaaataattcccttaaagaactctatgtttacttagttcaacagaaatgaggatttctttttttttagagacagagtctcattctgtcacccaggctagtgtacagtggtgcaatcatagctcactgcagcctcaaactcctgggctcaaatgatcctcccacctcagcctccccagtggctagaactacaggtgcatgccaccatgctcagctacttttttctattgtttataaagagaccgtcttgctatattgcccaggctggtctcgaactcctggcctcaagcaatccatccatctcagcctcccaaagcactgggattataggtgtgaactaccgcacctggccagaagtggggatttctgctcctaagtcctaaaggcggatgctgtgttccttaagtccaatgatgctcagagattgctgggggcaatgtcatcatagtcatcatcatcataatagcaaacacatatgtggcatttatgataccaggcactgttctcaatattttacatgaattaattcacttatcataactttttttgagataagtactaataatatccccattgaatgcagccagggaaactgagacacatagaagttaagtaatttgtccaagttagtaagtgatgcaactcaaagtaaaggaagagggtagcttttggaaatagggcagggccaatgcaaattttaggccaaattgcgtttagggagtctgatgattaccaaaaacttttaacccaactgattataatagctaatgtaacaatctttccagcattttgaattcccccaacacaatttaacatataaacaggttcaatctgggaagataaagtatttagtgactctgatagtagaactagtattatcagactgtaggtaccaatcattaccatttatttctccatgccaacccttgggaaatcagttttactaaccttaggtgtttttattttataagagacagaactacattactatcagcagagattcaagcaataaagttatataaatgtactttaaactcattagaacactcagcaaacagtgaggtaatattcaacataggtgaagtgttttcactcttaaataagtgtgtaattaagcatattgattctttggtcatgctaacttaagacactacgaatccttctttgaagactcattttaagtaaacattattttctcttcaaagggtgccacttgaagaagatatgaaatatattaccagctttgtagttctgcacaagtgggcccatcttttaggcccaaagttattctcttgaatatctctgagttttttctcccagcaaggcatactgggaaaaagtactctgtttaataactaatttcattaaacttgaacactattccattctggagatctggagatttctctgactgttattttagatgccaatatcagggaatagactgtacagtctattaaatctggatcttacttttaaattgaatgtgatttcttttatttatcaacctctaattaatagttggttgagtactttataaaaaaaagcacttctggcaggtgcggtggcccatgcctgtaataccagcactttgggaggctgaggtaggcgaatcatctgaggtcaggagtttgagaccagcctggtcaacatggcaaaaccctgtctctactaaaaatacaaaaattatccaggtgtggtgtcatacacctgtagtcccagctactcaggaggctgaggcaggagaatcacttgaacgtgagaggcagaggttgcagtgagctgagatcatgccattgcactccagcctgggtgacagagcaagactccatctaaaaaaaaaaaaataatgataataaaataagcacttccttctagttgccagcaagaaaaagagaactgccatttatattccttataaatatttcatacctttctgtcttaatttttgttttcatctttttaatactgatttttctacctggaaaagtactgtatggagtttgtttatatcttcatgcaggtcagcctcattctcttcaattcattccttaggagtgtcctttatttcattacatttttctggcaaggtttcttcttagatgagatcatatttatgcctccacagatttatttgattgatctgagaaagagaagaatatccgctctccaaacctccctttctgtccctcaaaagtgcagacttgaaggtggccatattgcagctcttgtccagaaccttcatcacgcattcactcatgcaccaaacacacagctcaggtagtgtgctcatgatgcaaagatggctcaggcacgttgatgctgctgatgattttcagtgggaagaagcaaggatatgcatggaagcacttaacaaggaggtgcacagagtgtcctgctgtcactatttctagtccacagtgtggccaacgctgattcatcctggggcaaccccaagcacagtaggctacctttatttctaggtaaaatattttaaaagcttgaatgtagcttagaaatttagagcggaaaaaaaaaataccagtgattcagtactttaaaaacatggaataaagtgaaaaactgctttgaccagggcagcactagagagtggtgcatacaaaagtgccctgtcatgtttgagtgttgaagaacatgctctccattgtgttctgtgtggtgagggcacctctcaggcctggagagtatgtatgcagggactgccgggcaaaggctcagtcctgggatccactcctgtatctcccctgtgcaccacaggagagcaacagagagcacaaaacagatcattcctgctctgggcaggacaggaagggtgacccgagtttcatcaaggtctcctggagtgccttggaaaagcatgctatagagtcataagcttaattattgatgactctgaacaatttcttggaactttcagcaagaacatgcgtgcttaactcatgaatcacggctgaagtccaccattaatttctgccacattgtggccttactgccataatcgtaggtatggtatctctcgccagctctcccctgccaggtctctggcgtggggtttatctttgaggaaatattgcctttctagaggaagataaatttgcatctgggtgtgaacttaattctttaaagttaaatgtctaagtccttgagttaacgacaaaggtacacatatacttatatgttcttattccttggaaagcagcgttcaaaagtgattctgaaactactggttacaaagtttgcctaatcaaagttcacttcatcatataaaaatcttgctcatttctacgaaatgcactccctgttacctatccaaccttggttttactttcctccagcttgcatcttctgccttatttaagtggctcacctcagtgtcccccaacatacattattctcatcctagcctgagtttttcactgtcatcctacatatctgaactatcctttccccagagtgattttctcctaatttttaaaggcccagctatggtttccttattccaatagcccttctagatgtgattcccataggggtctttttcttccctgcgtccttttggtctgctatgtaatgttacatataaattgtgcaaaaatgctttcatgtgcataactaccttctgctacctcaattgcacgttgatgatgatgatgcctttgaacccattatgcctaatatagtgctacaactgttttctgattagtggatgatccctatgccagccaattggaccttaaaaaaagaaaaagtcccagcatttcagaaattacacatttgcttttctttggatcgccgttttatctgtggattcatttcttttgtttggcaggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaaggttagacgcacatttgtatttcagcagcagaaacaaaagatggagtgaatcatgggcgcttgatgtatttggaggtgactatggggatttcaaatgggcctgcattattctttagtgcgaggggctgtctctgagaccacagcctctgggcatcagtggcgtgagactattgaagtagaatctttcatgaaaaaaatagaactgcaagaaacattacctctgccaggcactgaacaaagtcatgttgaatgatactatgaagtactttaatatgacaagtgattttcttaattcaaattaatattcatgtttagaagactaaaactctacagaagacagataacctaaagaaaaaaattcatctagttgacatttttctgtactgacattcttcaacatttaaatttatgtgctctgaggctcatttctaattctgttatttagaagtcagaaataatttttttatagttgcagtgatagaaaagatcattaggttgccaggcttgctgaatggaacatcagatttttgagctgaaggtcatttaacacacttctttattttatatatgcaaaagcacatctttgtgactctagctcttatatgtcactgtctcttcactgcatcattgaaagaacatgagtccaaacttggagtctcaggctgcaccctacctttttgaatggaagcttacatttttaactagcatagaaatggtatgctaatactgtatattagggaacattgaggtgagctgccaaatgagacaaaatgcaagccaaagaaaagtgaaactaaggttggatgggtaaggggagtgcattttgtagaaatgagcaagattcttatatggtgaagagaattttcattaggcaaattttgaaaccagtaatttcagaatcacttttgaactttgcattccaattaacaactcatgagtcatagctaaggttcaccactaatttctactacattgtgtgcttgctgccataatcatcggtatggtatctctcaccagcactcccctaccctgtgcctctctggcataggatttatctttgaggaaacagtacctttctaaaggaagacaaatttgttcttggagattgactagcatattgactgcgccatgaccaaggtaaaaacttgcatggtctggagcaggtttaatggctagctgaggtagggcaagttagagtatgggaagagagaaatggagaggacagcagtgagggctttctgggtagacagcaggagggggttgctgctgggaggatagcagtgaaaggcagtgtgaggctggaaagctgagcattaacagtgtggtgagtggacagtagagaggaagaccagagactgaggatgggaggggaggcacatggtgatgtgcttgttcttgcttccttcctctccatttctctcctctcttcagttcagaggcagtagcggagggtagcccacagacaggacagaggctgcctttctgttatttgcatttcctttcttctttgcctctgcagttaatacccataacacaagctggggactagcggtgggggcggtgagcagtatgaaagttgagactggattggagaggtaagatcagcagagggctaaggcaggatgagagaatctcagtgaaggttccagaaagagttcctttttttttttttttttttttgagatgagttctaactttgttgctcaggctggtctcaaactcctgggctcaagggatcctccacctcagcctctcaaagtgctgggattataggcatgagccacccacccagcactttttttattttttattttttgagacaggctctgtctctgttgctcaggctggagtgctcactgcaacctctatctcccgggctcaagtgatcctcccatcttagcctcccaagtagctgggactacaggtgcacaccaccatgcctggctgattttatatttttttagatttttagtagagacgaggtctcactatgttgcccaggctggtcttgaactgctgaactcaagaaatcctcctgcctcagcctcccaaagtgctggtattataggcatgggccaccaaacccagccccagggaagaattcttatgcagctagcagggacttgaaggaatgtatgatcagcttagactatcatacattgttgtgaagctaggccaaaacggtggctcatctgcagttaataagatgtcaattagaccctaaggagctgggaggccagcccaagctggaggaactaggcatgaagagaaatacataggtcaaactcaaaagttccaggactgatttttcaattgctccttgtccatggtggtcttgggctactccatgaagtcagaatttttaagggcatattttagggcagtgtgtcagacatgcaaccattaaatgctaacttctctcaaaaggacattttattatacggtgaatatatagcatagtttaagtgctcagactgttttcagattcatattctgggttcaaattctaactctgccccttatcagttatgtgaacatcactccagttttctcatctttaaaataagattgagagtatactactaatatctactgcctcaaatagttgcaaagattaaacgaggtaatgcatttaaaatgcttgacataatgtccaggacatagatgcactcagtaaatatcagttattcttatgtaggcaattacttattgacccatactttttcatcacttactcagagtactttgtgagaactcatgacccatctccctctggggcataaataagagtgattgaagcctgtgcctcaggttgtttccacattttgtggggcacaaactctggaatgtgactcagaactcaccatgccatgaagatagatcatttttaatgtgtttgttctctgcagagtggaaaagtaagattcttgggaataggtatgttcaagagttatgtagtaatttaaggaatctaagcctgtttaggcttagggccaccagaatcacagttctagtctcctttttgtctgctccccaaggaatggtgtttgatcaaatgagatctaattccatttgttcagtttaatcaaatgacttagtttgctctaatattacttttcactttcttagttgttctatgaccaacttttggtagaatcaatcaaagcaattctattttgcattatttgtgatttttttcaacctgatattttttccctaacatatgctgacacatgccaaatttaacccagtaatataaaagcagtcaaaagcaaattttggtgaagtattaaatattaaattgagaagcctgacaaatgaaggatttaccctagagagtagaagtaattggaataattgtgtgcttcttttccttgctgtaatttcctttattagataaaatttctgcatttttactttgaaatctgtttattcattttgaaaaagtttggaatatttcatttttagggtggagtattaaaatgctttatgcaggttctttatattttggtgaactaatattttaaaaataagtagcctgaaagcttcatacatacctaaatgtatgaagctaagttgtgattttaaaaatacacttgaactcatcaaacttttggctttccttcattatctctttaatggctagtgtgaaaagcaaggcatgtttatcaaatctgagcattctcactgtgtgactgctgcctcctggtggtaacataactaaattgcagtttcagtttctttttagggatgtgcaaatgtcttcaaggttgtaattattaacctacagctatgaagagataggagtaatgtgacaccttcctttgcttaaaagctcctccaagggttcctcattgccaataggaaagttctcagcatggcatttataagaatcagtgagccatttcatccctgccagcctttgtccctccataaggttttctcacacccaggcacctaactactcacagctcattgtttcctgaacatattatgcactgtaatactgccagccttactcatgtggatatgttgcttagagtgtccttttcccacaagtgccagctgctaactgcctggagaagggccactgaccttccaaagcccagttcattttttctccaaagacttcaagtctcttcctccattatgaccagtggcactagctgttcctttctttgatatctcattgctctttatatgtactgctatttagcatataatatgttggaaagagcactattttttaagttggaaaagttctggattgaattctaaatccaaatcctagattgaccttttattaatgagataacattggttatattacttaacctcttgtaatttcagtattcttgcttgaaaaatagacactaatttggagggttattatgaaaaataaatgagagaacagagtaaaatatctagcagtagtgactggtgtgggagatacccactaaatattccttccctttcttcacaatcatgaaggctctgatatttactcatctcacatattagatttgatctcttccaaagcaagcctcaatcttattcattcacacatgtaaactgcttcccattttgctgaattaaaggactgtccctagtggatcaatcaaaacacattttaaatatagatatacattttttaaattttaaatatatatttgagacggagtctcactctatcacccaggcttgagtgcagtggtgcgatcttggctcactgcaagctccaccttccaggttcatgccattctcctgcctcagcctcccaagtagctgggactaccggtgcctgtaaccacgcccagctaatttttttttgtatttttagtagagatggggtttcactgtgttagcctagatggtctcgatcttctgacctcatgatccgcccaccttggcctcccaaagtgctgggattacaggcgtgaaccaccgcacccggccactatatatttttaatagcacctattgtcaaaagtttctttgttgcacttagcaaaatagtctaaagacagtttgcaagtccatgtaagtcataataaaatcctactttaaaaatggttaataccatcaataagttacaaagggccaatgggtttgatatgggtggctttatagtgggaataacacaaacaaattattattattattatattattattttgagacagggcctcgctctgtcgcccatgctagagtgcagtggcacgatcttggctcactacaagctccccctcctgggtttgcgccattctcctgcctcagcctcccaagtagctgggactacaggcacccgccaccacgcccggctaattttttttgtatttttagtagagacggggttttgccatgttagccaggatggtctcgatctcctgaccttgtgatccgcccgcctcagcctcccaaagtgctgggattacaggcgtgagccaccgtgcccggccaaacaagttatttttaattgaaattaaattaataaaaaaattaaaaaattattttttaattccttctcatgtgaacactaggcactggggacagatatctagagtcagccgagacagccttgaatgtggttaatttcatatacttatgggaaccattaaatcacaagcctggagaccgttccagcgctgtgttaactacaactctttgggtgtctatttatttatatataagagacggggttgggctttactgagccatagcatctttttgtgcactaacatgctgggatctttcttcagatgagacagagtatgagtacagtggaagtgaggaagaagaggaggagaatgactcaggagagcccaggtatgagagcaaaagccaagtcttctaatgttcacattctgaattgtgcttgtgtgaaattcactttccttttgatttataggttcgtttttaagaatccaccagggtggtcttatttaatttattgcccatgaacatactcattaatttgggaaaatttccctaggcagaccattacgaaaatgtggaaatcagcatattctttatcttgtcccccaagatttatggtctctatcgtaagagcttgttttcttacatatgtaacacgtagaatgggtagaaggctaattatctgggcaatgcaggactaaaaatacttaaaactgcaactttctagagacctaagtggtattttcggacttgcgttattcagttcgttacttcacacctttgagaagcccattcgggtagccactgtccttgtcacatgccttggtattttcattgcagcctaatccaggagaaagtgattttcagaaaatcaaattatatgtagagatgaactccaaacaaatacttttgggccattcctgttgtcacctgttggacctcagaatccagggctgttttattgtcatgcctacattttgaattccacttgactttgattctgactttcttctagtctgtgtttataagtaattaaggttagtgtgcttgcactgccaggatatctctttggtgagcgaattcagcttgttgagtcaaggagggcaggcccacatcccatggtgccatgcagtatacatgtgaagtaagacttggggggaattgcacaagcagaagactcattgaggtgtggcctccctcctcaagccatccaaggagtggaccctaatgctccagaaggatcagttcctgtaccactgagggagagctttctgaccagaaaaggggccagcttagccaccactgctagaatgagccagataccatgtgttctttttttatgctaactcagacctactgagctggattcttgctaagcttctataagaagatggaactgagctttcagagccatccagtttttctctcttcacctgccacaggattcctcaaggtcaaagaccgaatacttctttcctaccatctgatacatagcatgttggccgtccccggtttagctgcataaagaagatgactgccaagtagtgacatagaaaatgaacattcctgaaaggcagaggaccaaacgccctgctttcagagaagttgtacaccagtgttcaaaagcttacccaaaaggttactgtgtcagccttctgaccactttctgtagaactgagaaaccctgtctttctaacacttgctaaactgcatattaggagtcactcaacgagccagcccagccgtaccttaacacttccgtaattataacatgtcattatatcatgctgaagattatgttccaagtcctgttgttgttgttattatactttaagtccaagtcctgtttttatggacgtatctaattaatcttcatgaaatcctgaaaaatagaaaaggacaatggttatctcattttagaaatgaggcgacagcctaagggttgcacccaggtcacacacagagttaatggttgagtcactaacacagctcagatcttctgacattgattcaatatcaattaatattaatggagcatcctcgtgtgcatgggaggctgggttcccaagtccctcccctctgcacagggcaagtggcctgtgtagataagcaccatcgtttggggttttagagtttgacacaaaggctctaagttttagagaaggcttgtgagtagacgccaagcattgtctatggaacatcacgaacaaagcctttttatgtcttttcatggcagtatctcacacagcacactaactactctccaaaaccgatccttggtcctcttgttaactgccacgaaacttgctcctccctcagcattcctcattcctgttctcgttaccaccgtcacccagccaccaagacagaacctgcaagtcatccctcactccacatgtcagatctgtccacaggcttcgtgacctctatccccaaacgctccttccctcctccacccgctctgctctcgccctgggtggtgtccccaccccagaaccactctgcagcagcagtccggcttgctgtgcttgcccctgtacccctcgctaggtcatccatttagcagccaaacccatctgctcatgttgctcttctgcataaaaccttcccgtgcctgcatggctgtcgcggccccgcacctatctctctgacctcctctcatacccttctccctctcattcactctgctctgggaagccgggctggtgttcagttgctcaaaaatagggtgcacccctgttttcctctcaggcctctaaacctgcttttccctctgcctggaacgttcttccttcttcatcaactgcttccttcccagagaggtctttctgaccacccatctaaagtaaggcctcaaagcttacctcagctcccagccactgtcactgaaacaattacaattttagtcttctatagagcctattaatacctgaaattatttgtctgtatgtgtgtcccataagaagataactttaaagggagaatttatctagcaactgccgtatccttagagcttactacagtgactgccacatagcaggtgctccgtaaatatgtgtttaatagatttatttcaaatggaagcttccagaaagattaaaagggctacgtttgaataaacagaagtcatttcttagctccctcttaggctgctgtgcagaatcaaggagtctgtaacatttagttgttcacctgcgagcagggcagcccaggaccaccagcgaagtaggtagaacttatttatgtcctctcgatctctgtcgtatgcacacacattcatgtacaaccaccattttacagaagacaaaactgttacctaaacagaatctaggaaccaatgagctgggttgaagtcctagctgcacctgctgtggccagagccaaaccaagccctttaagtgtggtacagtcaggcaaaccctgacttggactcagcaggcttgggctcagatcctggctctgtgttgaccttgactcaagggttttccatcgctagttcatcgtggcttcacaggagcagcctggcctctgcctcatggggtttggtgtgagggggtggtgtgggtgaggccgatctgtgcttgtctgagtacccttgttgcccaccattgtccatttttattgaaaataatccagtctggggctcatggcttgcacactggctaaagtctttaaaaacaaatctttgccacgtcccaaggatgagggagtggtgtggacagtcctggagaaggtgacaactctgagaatgtgacatccctctatggatggaggcagcatttgttggccacagtcgtactgaaagggaggcaggtctcttatcctgatgctgtttctttggggtgaatgattgaattagcggaggatctaggagcctgtgctcttctttccctgtgtgtgggtgaatcatttgtcccgctttcctcctccaaggcctcttggtagccatggcccctgccccacgtgggatcctgatcactctctcctacccacagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggaggtgaggacctgctcgggccacctctgaccccaagcctctcagttgtggtcactctccaagcattccctgggggcccacatcccacctgtgagcacacagagcttagaggcacaaaggggttgactgcaagggcagataagtcctgaatgctcttacaaacaaaaggcttcccttgctttttgtggtggtgtggtcatttcagaaaagcaggtgaaggccgtcaccccttcctgtcttgcccatatatcaccttctcagcaccttctcagctttacttaaagtcacagtccctccctccagcatgtcctatttccctgccctgccttattacttttacacagcccttagcaccttcaaatatagtctacatatacttttacatgcctgaatgtccctactggaatttaagctccatcaggacaaggagattttatctcttttattccctgatgtatctctagcatgtcgtaggtgcctcataaatatctgtggaatgagtaatatatgaatgaatgggtcagtagttgagaggtgaaatataggtattaactagatcacagtgaataagcagataagtggaatttcaagtatggaagagtaggacctgcctattgatgctctgaatgctaggaagaatgtttcacagatcctttcccagacatcccttagtacccagggcctgtcctccagcctgtgggcaagacctgcctttagcagcagatactgcttatctgtgtgggaagccatactgctagccacagttggctgcatgccttgtcctgggccagactctcaccttgtggtcttacagacatttgttaaagcctccttcccagaactttgcccagatatctcaggcctccttcctctgccagataaatcaaagcctctagacaattaggaaaccgagagagcatatctattggggaagttgggcagcagatgaaaggcgcactaactgcacggtaatgggatagtaattttacaggtttcccgaacaccagcttgcttctcattaacgggcttgcagcaattcacttgctttgccaggtggccactgaagatttagagggtggtgaattgcagtcaccagcagcagattgctttttaaatggtacatcaaggtccagcctccctggtttaaatcagtaagggcctcagttccagtttgcagcaaatcccatcaacctcattatgtccttcaaatatcagtatcagaccagcaacaataatacccaatggttacaattattgagtgattttagtaatgtcaagtaccaggcaggatgctttgcttatagccactatctcatctactatcattatctcttttcctgtattgattatctctcatgcaaaactcataatccccatttaacaaagaagaaactgaggttcagggagggaagtaattggtcccatgttgcagggtactgtgtttagtactttacacgaattgtctcatttaatcctcacaataatctccagtctaaagataatgcagctgagtcttagagaggttaataacttgttaaaggttgagaagaaaaccgggtttcagatccaggggattggcctgcagagcctaagcaccaagtcactgcatgtgttctgtgtctccactgataagtcaaagttggtatgcttttccacatccctcatctggcctctatgtctatagtcttttatcctgaacatttaaggagttctgcgcaagggcacagaatctgtggccaacagatgctcgcctttgacctgggttctgtctcacgctcccagtcagagctattgccaaggcctcctttgtgtctcttctcttgtggcatttgcttgaacctctaccatggagcaagtcagagttcagctcactgaggcatgtgcagccagagacacaccctgtcaatcctggcttgcacagaagacgtcagccagcatgcatgagggcacaagccttttgctgtatgtaccaatgggcatgagccttggctccataccagaagcaggaatgcttctggccacagagcattgatagattattccagctttctcttttgatccttcatcttattctatagcgcagtggagaagaacaaggaatactaagtactcagagagctgtaaattctgaaccccttagtcatgacattctctcccaccaggaactcttctgctgtgtcctgctcctgccaggtccccttctatgtctgcttccctggcctttggtgaccacttgtgtttctggtgtcctgagtaggaacttggactacattgtcatatagaaactgttaaagcccatagttcagcttgagtatttcactgcgagtcatttttccttttgtaggaaaaacattcccacttagctacccctttggtcacacaggactatgtagcttgtagcttttgtattttgtgatctcaaatgtcacctcccaccagagggtttctaaggaagccctgcatgtcctttactatttatgagtaaccatgtggatttggctaagctctaaatcagtgtctgtatattcttagaaggactttgaatatacactgaatgttgtcactgatcagctttatgaaaaggacgtggcttcaggccaattaaatggtggagagaagactcagcttttgaccattgttgaagtacaacctataacaaagttccaggaacttgattaaacccagctaaagtgaatgagtccatcaatggtgagaaaaagtacaaggaggacctcttctagttttactcagctcaataaaaatttctattacttggcataaacaaaatacatcttgttttattctgtatcatggagttaggatccaagaataatgggagccttcaggggtcaaggcttctactctggtaatcttgagcaagtttgtggtgatgtttgattctgctcaagagttctgaaatgatattagtgatttatatatgtgtttcaaattgctgagcacattctatactttcattttggggagcgtgcctgtaagtcacaggaatgaatcaaatagaccccagaagcacctgctccctggtagtatgttttattctttcaagactctttcaggacaccaacattctcatgtagtgcccttcaagaccatcctaacattgtccagttataaaaataaccagttctatctggccaaaaaatatacactttggctccatcccatgaatttttttttttttttttgaagagatatcacctgtatcttattggccagtaatcatggagcattaatgtacaaagtaagaacctggcagcctaaaaatgtcagccctctctaagcctctaactttttattgtgactgaggctttcaaggatgttagactcaattgttgttgttgtttttaagcatgaggtttttaagcataaggttgaattaaaaccttttcctggggtctgtaggtcatcatttgacaaatattcagtgaacacctctgttgtgtgggcaccatgttagacactagaaatacagtctcccattgtgacgattagatctgtgagggaaacaggcactaagcaaataatcagccaagtaatcatttatcatcacagcaatgactgccgtggtggaggagagtggcatgctaaaagagcgtgccacagggtgggagcctcacctggcttggtcagagtcccgctacaggagggagtggggcacggagagataccaggcagggaagccatggcacagtcatgcagggctttgtagaccatgttgattacttttgaattttattctaagaagagtgggaaaccattgatgtgtcttcactaagggaacagaatcagatctgcctttttcaaatgaaacttgggctgctgcagttggtgctggaaagaagcaagagtaaatggaggagacaagttagtctaggccagagagtgtgatgctttggacagatgatggtggagtggggattgagaaaagtggacacatttgagacaaatgtagcctgtggaccatgcaggatgtgcaagttgattagacatcagggatgaggaagagcagccaacagtaatagtagtagtacaatccatgcagttggattatggtagagatggccatagaagaggggtcaaaaataagaaaaataggaattattggtttgtggtaataaaagtacacatgagaagagagtgtaggcctgagctctaagaactcagaatagacaaggaagagacagcagagaaatttgataaggaagtggaaggaacacctggagagtttgatgctatagaagcaaagatttagtatgcaagcataaggatggagttaaaggggccagctctgcagaatgctgctcagaggtcaggaagacaatagcatcttttggtttcaaatgacaaagaggatatttaaaacatagttttggccgggcgcagtggctcacgcccactgtaatcccagcattttgggaggccgaggcaggtggatcacgagatcaggagatcaagaccatcctggataacacggtgaaaccccgtctctactaaaaatacaaaaaaatagccgggtgtggtggcaggcgcctgtagtcccagctactcgggaagctgaggcaggagaatggcatgaacccgggaggcggagtttgcagtgagccaagatcatgccactgcactccagcctgggcaacagagcaagactccgtctcaaaaaaaaaaaaacaaaaaacaaaaaacaaaacacatagtttttgtgtagtactccctagaaattctttcatttcctgtcttttctgggaagggaagcaacctgcccagggagtcagtagatctgcacttggagtgaaaagacgtcaacttctgagggtcaccatgtactactactacctgcatgccctggcagttcttattctctccacacctccacttcctgagctctgcagggagatcagtagcaaagcttgttcccaccaccaaagttttcctgaggattaaccagaaaaatggatataaaagaactttattgactgccaaaagctggacagaccttacttttgaggactggtcaaattcagcttaaatatttctaatgagacccaccttatgcttgtgttggaattcttcctaattccatgctcatccatttgctatcagctttttgttcacattctctgttaccatgcattcttccttttttctttttttttaattaatttattttttgagatggagtctactctgtcacccaggttggaggcacgatcatctcagctcactgcaacctctgcctcccagattcaagcaatccttatgcctcagccatccgagtagctgggattacaggcatgctccaccacgcccagctagtctttgtgtttttagtagagatagggttttgtcatattagccaggctggtctcaaactcctggcctcaagtgatctgcctgcctcggtctcccagagtgctgggattacaggtgtgaaccaccatgcccggtcaccattcactcttctcttagggtaaccaagcccagtctcaaagcagctcagctgtgcaagctgaagcccaaacccagagaagccgctggtgtggaaggttgttctttggaaccttagtagcttcttccaaatgctcctagacagcctccacccacaaaagagtggtgaggtggtggggaagctgcaagtttctctaagaatcacagtgcaggacagcatattgatgctctggaaagtcctgggacagcagagcatttggtaaaattcagtagagagtgaaattgtattttggttaacagcatagactctagagcctaagactgccaggggtcaaatcccagctttcttccttattaggtgtgtgacctgagtaagttctttaactttcctgttttacagtttcctcatctgtaaagcaagaaataacaatagcatttacctcacagggctgttgtgaaaattaaatgagttaattcatacaaagcctgccgacatcactaacacatagtgagccctcaataaatatgagttgttcttgttattggtgtaggtgcctttgaccaaagtcaaggaaacaaatttccaaagtttgaactcctttatgtgctacagtaaaacctttttggatttattaaaataaatgtaaataggtaagcttctttctatgcttcgggaagaatatttgttataatactgggaggaattcagttatatcattaagagcaataaatgtctaatagttcttagatggccagctttaggttcgtgtagaggtaaaatacactatctttacaggccaaggccaaggtttaatcttagctgtgtggtctttggcaaattacttaacctctctgaacctcagcttccttacatgcacatttggtaaaataatatttacttttcatgattgctgagaagtaaatgaaaccataaatacagaggacttggcacaatgcctaacacaaaacctggattggtattcttgggtgaatattttattgttattttggaactgatgatttcaaagtatagtactgttaattttgtttttcattttaatggtgctgtctatagctagcatttccccattccctgtcttccttaattccttaatgtaccttccctgtttagtgtaaaaccttgactttttcatccccttttgaaagcatttttccagagcacattttcgttatgtcttactgggctgtttatctgctggtgagttagcctgcagtcctggccttgtcaggacaaggaggcggcccattctttgtccttttgcggatttcttgtttagtagggtcaactgccaccttgggaagtctccttttcccagtgaaacctagagaaccttcccctggagaaactgccttctgatggattatcttatcagtatttcttgctgtcatttccaacactgtaaattatgatcccatcattgccaccaagtggctgcatgaaatttcatttcctaacaatatctaaataaagttcataaggaacagagatcttgtgctgagtgaataacaagcttcttgcatcagggaaatagtaccttccgagtgaccctttcaccaaaagggtgagaacgtggcagttcagtaagacactgcctgggtttgaatctcagatctgccacttacttcctttgtaattttgagcaagacatgacttctctatgtctcagtttgaccatttataaaatgggatgtaatacatacaaaccacttagaacagtacctggcactgagtaaacacctgaataagttcaaggagagtgttacatgtgaagggaagaatcttgcttctcattacctgctttgttattgctgccctgggtcatctctttccagggtgaggccttgaagctgaatgaagcctaggcaagtacagtgggcacaagaaggagacaggaaaatcgtgtgggttttttaccagtgcagcatttctacccactggaccacactcccaggccccaagccagaggaaagcactgtgagcaagaaaaattaattcccccatctcagagcctggagtgttaacacatcagcactgctgagaagtggtccttaattcacttaatcattaaccacaggtgtcccagtgtgtcctgtgagcagtggctggctagttggaggcagcacagctttttattcctggatgtcattagcatcaacacaagattgaacactttctagctgggcttttgctctgttatttcaataactgaacagaaattatgaaacagctgggaaccatcctggcaaaccagatgctcattgtccaggacaaagcgtgcccatgagctttggataatggtcagtaatcgcatgcacatgtaaatcacacttgtgtttcagggagccgtgtcatctgcatggatataaggaaccccacctcccagtggatcgcaaaagggcttcttgttctaacttacgtgttgtgccaaaggagttctgactttgtccgctttgtcacctggatcctgtgatgggagggatttcctgccacagtgcgggagttgggctgacatccctattttgtagtgtaaaatgctactgaaatctggagtccttttgcccaggctcctgcctacgcttttaagacataggaaggtagagtacgctagtgttttatacttaacagcatttcatactgaaaaaaaacctggagttaggcagttgctgatccttggtgtatctagagtaccttgcatggaaggtagggatggctttttagtgcctgcatgcaatggacatcacacagacctaccctccgttgtctaaggtcttcacagaaccacctttattacatctagtctgtatgttttgtgtgttcacagtcttcttagttattcctaaccatagaactatgacaacaaaatagtttcacatgaaatcttatttcacatgacatttaaattgaattgcttttattttgattcttgttttctttagtaagtggttttatagaatcatagaggctggggaatattaggaacctcaaaagtgatctcagccaattcttctctcaaagcaagaattccttttgcaatattcttcaaacagggttatctaacctgtttaacatataatctttccttgtatgtccgtgggcttgaggcagcacattctatttttgaacaactcctaatgttggaaaagttatcttttcgttgattcgagttcttgtgatatccctgcattaatacaggttgtgccaaataaaactgaaattccctgcatatctgccctagaaatgtgtgaagacattaataatgttttcccacaaatgttaccagttcctgcaacctttctacgtataagttagcatctttagtatcatctcgggagtactggagtggccctctctgtaaatactgtattaataaactggtttataactggcttgtcttcataggactcagtctgagggtctcatactaaggcttcagaatgatgacagtaggaatttgggggtttcatctgcatttgactttcacactaacattcagagtcgtaggtactagggatgtccattaggccattcttgctcctctgtatgacacctgggaaatcccgtgtgactgttctcccaggagaaactgaggctcagagacactaaggagtttgtgaataatcacattgactagcatccatggaagaggcaggatgagaattcttctgcaccgcttcgtgaagctcagtctgtttagaactgtcatgcctctttcagtgtccgcaaagaccagcttgcacacatgtgcttgacagtgcttagccatggggctgtctgctaatcaaaagttggcctgtgagcacaaagaaaaggcttcacttaggcagttaatttttcaggaaagctctcaaagggtaggttggatagtttatctctcatggtgtaaagtaggtgtagaaagaaaggaatgagttatatctggcctgtctagctttcccaatgttctctgattactatttctgagaacattgggaaagctatggtagctttaaggtaggtaacaagttaaggtaggtaacaagtaaagatagaaagaggggaaaatggcaactttaaaaagcattagacagtatcttttactttgtacacacagatgcttcttgtggacccaaatgaggcagcatggcaagagtcaggcatggaatataaatcctggcctcgcacttaccaaccgagtgaacttgggcaagatattggcctggatgtgcctcagtttccttaactgtcaaatgggggtgatgacagtattacctgcctcaaagggttctggtgagaattaaatgagttaatatgagtacagtgcttggcatcataggctgcactacgtaagtgttcttcattatgcatatagttattattatttttgtttttatttcattgtcatatagtgaattcagaggtgccagactgcttcctcatcactcttgtgtccttacataaaaaaaggtttggaactccagttttagtcacaaggaatcatgcccttaccctatagtcattggtttgcaatgatctttccaaaactaaaactttagcaacgttaaatgggaaaatggaatgcccagaagctggaatacctctcatcacaagtatagctcccgtgaagcttatacagaatggtcctatttaaagtgagggggcatgtgtgatgtgcagtcaattcaaaagaccacactgggtcctttcattctgagtgtctttgaacagagagcccctgggtggaggggatggtttgaggtacttcccaaggagcctgacttgatcttgcaccagccgttttcctgtcctctggaggccaactcgggtcttccacagtcacagtagggtttcctctcaccgctttcaggaggtcacccaagatgaaaagcaacaggagctctccaagggcaaataagaattctgcttcgtttcactctgaatggttagatttttgctttgcaatgtagcataaccttgctcagactcttagaatgaacagatttgcaagattacttaatctataccctcattgaaagtttagctgaaggtgacttactcaaggtcaaacaacattcactcattcgtcacttttttttttttttttttttgagatgaagtctcactctgtcacccaggcacaatctcgtacagtggcacgatctcagctcactgcaacctccgcctcctgggttcaagcaattctcctgcctcagcctcctgagtagctgggattagaggcacgcaccatcacacccagctaatttttgtatttttagtagagacgggttttcaccatgttggccaggctggtgtcaaactcctgacctcaggtgatccgctcgccttggcctcccagagtgctgggattacaggtgtgagcccggccatcaaacacatatttacagagcgctgctacgtggtcttcagtgttcgtattggtggcagtgcaggaccagaatctagtctgtttccaaaccattttattctttccccaagccctgttgcctctcttgcctacccctctatcccaatgacacgttgcattgcagctataggatattaattctcagatgtggatatcacttgggtccatataatgggaaatatgatgtatataaaagatggaccagggccaagatttgtttctcattttttggcttattatgacttttcctcattccaaaaggaggagttaaggtggcttaaagagattaatacagcaattaaaagtaaaataaacaagaagacaatgtagaagggaacataaagtagaacggagaaagaagatgcaggcaggagcggggtcagtgcacagaatgcctgcacaacatggcatccagcgctgttgcccagggcggtcaccaatctgctctgaggcctgacacatgagaaaagagacagatgtgaagtggttgagattcatgttgtccatcagataagagtaaaccagttactcagacaagctttctgagatcacactgaaaactatacacttgcctagtaagtagtgcaatgaataatgtctgaggcaatattcctggcataaatgcagtggttagctttattcagctattttgaagacatcataaaatgcaattttatggcattgcagttcatcaaagtcacttctatgagagctagaacaccctggtgtaggtgcgtacttttctgcttatctaaagtaatctaagaagagcatttaaacaaaaaaaaaaaaaaaaaggaaagactgactccacagcccttgtgaggaatatgcatgaggattatctcttaaaactagacctctaatgacaattcagaatttaagggttgaggtgatattctctgcaaagaatttaaacagcaaaaattctacatagccaatttgggataaatgcattacctttgagggccccctgaacaggtgggacaaaattactattccctcattaaaattaactaacaaattcacatgcttgaaagtgcagccacacagcctccacctagaggtagcgtgaggggagcattcatagggaggatcaaaactgcccccaatagatccccagatccagcaatcccaccactgggtgtatagccagaggaagggaagtctgtgtgttcaagagatagctgtggccgggtgcggtggctcacacctgtaatcccagcactttgggaggccgaggcgggcggatcatgaggtcaggagatcgagaccatcctggctaacacggtgataccccgtctctactaaaaatccaaaaaattagccaggcgtggtggcgggcgcctgtagtcccagctactcgggaggctgaggcaggagaatggcgtgaacccgggaggtggagcttgaagcgagctgagattgcaccactgtactccagcctgggcgacagagcaagactccatctcaaaaaaaaaaaaaaaagagagagatagctgtgctcctttgtttattgcagcactattcacaatagaccagatatggaatgaacccaagtgtccatcagtggatgcgtgaataaagaaaatgtggtacttacatacaatgaagtactattcatccataaaaaagtgagattctgttgtttgcagcaacgtagatgaacctggaagacattatatcaagtgaaagattccaggcacagaaagacaaataccatatgatctcactcactggtggaatctaagatgtcactctcatagaaagaaagagtagaacagtggttaccagaggattggcagggggcagtggtgagagactggtcaatgggtgcaaagctatagacgagaggaataagtgctggtgttctattgcataagaggatggctgaaattcacaatgtattacatatttcaaaatagctataaaaggtttttgaatactctcgtcacaaagcaatggtaagtgtttaagatggtagatatgctaattacactgacttgatcattacataatttatacatgtatgtaaacatcacattgtaccccataaatatgtccaattattacatgtcaatcataaatatttaaaataagaacttttaaatatttcatgcctttctctaatgtctaaaataagaaatttaaaatatcttaaaataaaaataaaaaggaattgtcctaaaaagaaatcatccttggcgaacatcaacagaagacaaaagggacatgaagtccctgattatctactccatagagtaaggcaacaattgttagggcctggaaaactttaacagtaggttctatccatcatctccccaccggaaaaaaaattaagaaacttataagaagcaactgaatgtccaattttaaggaatataacttttagcaatgcctacaagaagacatggatgaaaatatacttctaggcagttcaatataggtggagaatctgccaacagttttagagtagttggtttcagccattcttttctgatagcaggaccactatcttcattatgtataatttgaataagatctaggaatgctatttgattctcccctttccctttttttccagtttagactcttattcccttatttttcatgcctttctctaagatggcaaacaggtacattccagtgccaactgtaggtggctctttttagaagaacattctccagttctgtctgtgttcaatataaaagaatgttccagccaataagagctacttaagaagggcatcaaagagtaaaggtctggtacaaagctctgcagggctctcccctcttctattacttagccagtttgcagtattcaacacaacaaatatcactggtggctggcctgatatggaaacaatgggagataaaaacaagtggaacagagatcttgcccacacacggctttcaatctagattgcaaagttggtaagatatactcaaatagccatactataaggtatggaaaggtagccataccgtcagtattgacaggaggaaaaattctacaaagaaatttaagaggatactgtgttgtcttttccctcaagtttcttactatgttcagcgcaacaaactcttaggtgcacctgccaggtgccaggcccccgtctgaggggttggggtacagcagaaatcaagcactggccttgccctcagagagctgcttctagcaagagtcatcagagctttgtaaaggtgtctgcctgaggccagggacttggtcttgcattgatatgttttttttatatcccctccctcatacggctccatgcacaggaggagagaaagcaaatattttttcaagaatggcattaacattgagacacagcagctggaaattggcagggtgccctcagaaggttgggaaagcgatttatttttccaacctcaccacaggaaccaaagccctggcagatgcctccatgtgttagcggctgctgatccgagtgagatcattattaattattagttacttttgagtgtctttctcagaaactacagagtacttgggaagcccagacgctcttgagttgcaatcaatactgtatacaccttgcacagggacctgagtggcatgtaattataaaacagtattgattcctggcaaaggggttcaaaatgtacaaatccttcacataaagatcagctaactcttcaaagggcttgattattttcctttccttaagaaagagacggatggttggagtaagaaatttgaaatattagctaaattagtgctatttcctgccaggatccagatctgtacacataattattttattctctgtgctggcactgattcactttggttgagtattggaaatgtctctgttttgggtctgtaatccaaattattcagtcagtgcctatgctgatgttttctactcgcatcttcctgtattatttttctgtaaaacaaatacttgcatgtctgggacttgcctcatgctggtacccaccccactcctacttttcctgctcttctctatcccatcgtccactgtgccccttggccggggacttcacctgccctcctacaacctgtcgtcaccaaatcctgcctattttattttggcctaattctaatttctgtttctaaattggtgtccactgaagtcctattagaatgaccagcaacctgtatagttgttagtctttattcctcttggctgtgtctccatcctcagcagtgattataaacatggactctcatcccgcctttgctgaaatcatcgatgccctatcattttatacctagatccacagaatggccttgcactgcttttcagcttctagtcttgccccttttcatggatgatggggaggccttttgaaaatgcaagtctgatcaagtcatttggctgcatgaagtcctccaatagctctccttcgcctgcaatccaagatggaaaaatcattgttgatctggaagtgacagaaactgagtcttaagagacgcagcttatctcccaagactcagaggttattggaagacagcaggtccggaggattgctgcaggagctccatcgggaaggtttccacatgggcttctctggcattctgaatatctgtggttggtttagctggggctgagacacagaacttgtgtaaaaaactatctccctggttgtgtagagctaacttatcagtgtgagacagtcacaatttattccactctgggtacctcatgtttcctaagctatgcaatgaagtcttgttgagaatgtgacaaggaaatggtccccctggtatgtcccctctgaacttcatatatgaggaaaaagaaatcccaaagccaataaaggatctgacacaaagggccagccgcctctctcaaaaggtgcactaatgccatgatgtatgggaaaagacttggtaatatgtgacaatcctgtgccttgcacaggatgtttggcatcactagcctctcatggtaaatgccagtcatgctcctcagtcatcagaaccagcaaaaatactcctcacatgtccttagatagttgcaaatgctccagagaggggtaatggcactgctcctacttgagaaccactggctcctgtaactgcttggcctagttctaacttctaaaatgttctcctttcctgagagtataatgaagagccagatactttgtgatctttctatcattcctctggcttcttggacttccttaatgattgagctcagatgctggagtcacatcgtctggctatgaaatcaagctctgccatttactgggtgtgaccttgaacaattacttaatctctccgtacctcagttttctcagataaaatggagataatagtgacatccacttatttttgtgaagatgaaatgaaataaagcatgtaagctgtttatcacactgtccactgttggaggcatggtaattgtatgaggtgatgacgatgattgacgatgacgatgatgatgatgatggctcccaagcataagggtcttattcgagcaagaacttgaaattgacacttaataatgaatactccagaaaacacagacaggcagcatgatatatgagaaaaggtagcagactaggtgggagtcagtaaatcctaaagcaccctctgccatcaattctgtatggctttgaatatgtcacttcaccgctctgatttttacatatctatgaaatttttgtgttacatggtgttaaacagattgaatgacttaagcattgtgaagtaatttcataaacaacttgatgatatgtaataaataacctgttttgcattggtgttttctacgcctgacttgaaaaccctcaccagctgtggggagaacacacttaacaggaacgtcttggtgagagtctacttacatggtaaatggaagtatgttatgcgtgacactgaatctctctctctcacccgctccctgccagtgtaccctccaacagccccggagagaagaaccttggagcatttaggcatatctcattaaaagttcatgtctggggttcaacagcttttcctgctggctccctgacaccccccaccggggcctgttgccttcatggttgtctgcttgttgccccacagcaacaaaggcgagagaaggagctgcggaagcagcaggagagggagcagcgccggcactatgaggagcagatgcgccgggaggaggagaggaggcgtgcggagcatgaacaggtacagctgggaccaggagccccactgatggccccccggggaccccagcaccagccttctctggggtgtgggtcaccttttctgaggaatgctcagtttacatgggtttttactcttcctcaagcaattatgctcacctattcaagaagtcaaatgtacaaccttggcaatgcccacctattcagccttgctttctacccagacagagttccctgacatacccggatcttccgattctcccaaccctcggtatctgatttgaaggtagcactgaagcatgaaaaatcagccaagtcccactctttcactgcttcagaagagcttttctactcatgccatctctggtctttatgactttgagtcattgatgcaggcccatctctctttgctagaatcacattcttacagcatagtgaaactctgcaggatggttccattacaaagacagtgcacgatggcattcaacagttgtcttattcctgctgcttgcacaggagcctctgaactttatagcattgttaattccaggtagtccataaagagaggaacctgtaatgaaaagctttaacatgtagctgggcttattaaaaccaagtagtagcagtaaaatgccgagacatcgcagtcagctgttgcaggtagaggggcttgtgcttttcattatgttgaaatgcatttgcttccatgtgacatactcttcctgctttgtaagaaggtatttgggtatttttcccctccttccttctacactttacttagcggctcttgtcgcctttgaaattactggttcatttctctctttctttctgttcctctgaattctctgctgcctacctctccaggaatacatcaggcgacagttagaggaggagcagagacagttagagatcttgcagcagcagctactgcatgaacaagctctacttctggtaatgagaaagccaagaaccagctgacctgctctgtgttcatcttgcaagtgtttgtgtgtgtgtgtgtgtgtgtgtgtgtgtgtgtgtgcgcgcgtgcgtgtgtccttctaacataccagtccagaagaggggatcttctaagcctcagggacctcaaaaacctcatagaaacttaatacattttctgattgattttgctgagtcctaatatatttaatacagttgttatgcattctttattaactccatttatttgtacaacttgaatataaatccagccttattataagtacaaactgcttttgagacctactgtgtttattgcagagtaatttttaaggccatttgcgacatgctggaatacaatcacagcaaaatgcacctctcccataagaacccatcagctctacagtcatatttcatttacagactattagctttacccttacgatgggaacattttgtgtcccttgctcatgcagcttccacttgaagtacagtacttttttattattatagcactgctctccagatgggctttttggtgtattttttaaaactgaactttttatttaatggcattctgatgttttttagcctgtacataagcttgctaatggcctttgtaggtccaagttttattaaatgaaagatgatttaggcactatctttggctgcttagtttgtacttaattgtacatgtttgagtggtttaattactagatcaggaagtgggtgactttttctaggagttgtatgccgaccatttaaatgtcctcattattgccattttgtcacttgtaattcatcagggacaagtcattttgtaattgatggggttcggtagggattgccattttaaagcaatagcgttttcattaaatgacacattcttgtgtagatactaacacaaggcagtagcttatttctgtggcacatcctgacatccttctgtcattctgttggtattaagatcctttgttatttagcattattttgcctccattgcatgcttatctggtactggccgatgatttctatgtgataatttggccttttctttgctcctctttcctgatctggacaggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtaagtaagcaagggtagcctcaccctgttggccaggcttttgactctaatgagtttgtgtgatagaagtggagagttaacccagtgctgcaaagttggaaaacaattcatcataagacacatgctttgcttttgcaagaactataacattatttctgtagagaaatggcaagataccttccttcatttgtgaggttttgtttttgttttttttttttttttgtatatctttgtggttgcaatggacttttataggaaataacagaagatagaaaaaaccttttttctgttactcatccaattgaatttgtggcatggaggatttttagtgacctttttgttgaataatgtgattaaggatttatagaattctaggaagaatcagttcctgtccatgcctggaccctgttgctgatcattaacattgtcactaacataactttgttcactgtgatactaccagcagatgcacagttgacctcagacttgtggtggtggtattcacttttaagatcagaggtcattagtgtttcttctacacatacttccttcatttgcttaactactagactaagaaaggattttcaggaacttagcactatgttgagctattttaataaaaactgcttggatgggagggaaaaaagggtgatagccagacaggtaaagcaaacaaacaaaataaccccaaccaaatcagcaacctttccagggagtcactgtgtgaggtcatgtgcataacacgctggttttcagttcaatcattatttctggcatctagtgatttcctttattttatggtgatcatagctggtcatttaaaaggatgttttggagttattttgtatttttatctagaatctttagatattgatagctcacgcttttttcaagttatctagaatgcaatattactagaaccagatttcttacataagatcctatttttatgaaaataattctttgtatttgtctaacctatctgacatatgtacagaaaatacttgacataatgttgtcctaatgttaatgatagtggtttatgggagcagaaagtaaaaaaaaaaaaaaaaaaaaaaaaaggatttttaaaaacttttttgtacttttacatattgtttaaatcctttagagtgatcatgtatttttttgtgaaaataacttttttcttttaaaagttaaactaagtgtgtggaaaaattgttttgatttgtgatgaagaattttttatcactttcccttacatctgtaaacatgatccatatttacctatgtctctaacatctgcctctttctcttagatcagtaattcaattttgtgatcctactcccaggtacagcatcgaccccttaataatccacctgttcttccagctaagcaaaatcactatgctgctaaacagcagctgacatgcttcttggctggcaggcatgcaccaccttcctctactgctaaaccatttcctagccatgccaagttgaaatcctcagctaagccagacccacagctcctgaccatggcaggtgttcagaccactgaaaaactagcctctacaaagctaatgtcagtagcacctgcaggaattaatgattccagaccaagactcctgcttgagcatcacccatgggagaaagatggacgagcttgtcctattagacttggtttggaagaacaaatgaagcctcaggaagtcttgaggaccatagtgagatctccaaggcactctcactcccaaggatgtagcccaactcgagagttaggatctaaggtcatttgtgtgtcttctcccaacgtctccaaagtgacaagccccgagttgtccattactgcaattcaggagggccttagagattcatgtagaccttggggcaggaagagcatgaactcatgcatctttacaagtgcttctacttttctaagaaatgctgcatcgctaagcgacctccccttgatgcatgaccacttggctttcagtgttcccagccccaagcatgagtttaggagagggacacctacagatcccattggaaaagatcattatgttgtgcaaaccattccagaatttcttctttcccctagacagctccctcatgcacaaatgtaccagaagagggggaaaagcatgaaacagttttcacctccttcattcagcctctacccagcaccttgtgatttgaacttgtctaccttgacttcactgttttccagttgctatttgtcctcatcactaaatttactggtctgtcctctctattcagaactagttcatagctcccaagctttcaggagacatggcattcctgggggcagatctttgcagatgtcatcaaggcacttttctagacctcttaattccctcatgcttcctggtcaggctcctagcagtaaaagaaacacagcatttgagcatgcaaacaacatgcctgagtcatcaagcactcctgatgtgaggtttcccagtcaccataagtctgggccatctctggtgggtgacatcttccaaggtccctggcttcctggcatctggtgtgcttcctttgggcttcacgcatttccacagatatatgggaacattctttggggatttcatatttagtcctctgctcctgggtgtggttaacataatccagcttccaactaaccgttgtctgttcatgaaacagttcccaagtcttagagtgggtgatcatattttagaagaaagatgaaacatttagttgatagaaggagagtgacagtgctaaatttaggactggagcaatcgatgtacaaataagaacaaataattgtctgccttggtttgagtcatcatttttaacacccacttcttagtaggaataaaaatcagtgcaaggatctttacattcttgatcttttaatgcttctcatcagcagtgtatgaactttttatgtaaagcattatttacagatgtcttttctcatattaggaaggcaggggctcaaagtgaccaagtagtaatacacgtttcaaaactttaaatatgaacatagcttatcagtatcttaactatcaagttataagaaaacctgggttaaaccctctggaagtaaaataaaaggatgccattttctttttttcaaatgcaccctctgtgcccatgccaccgtctcctgttgtgtagggtctggactattttgccccatgtgccactgaaggtatcacctagctctcttccacctactgcaacctcttctgtaatctgttccagcatttgttttgtaactcagctctatgccgtctcatcaagtttttttttcttcttctttgcttacttttccatctacttctcctcttcctcattccaaatcgatagtcctttatcagcaatgtaatgctcttatactgctttgttctctctgttcttgtttcttcattttgtaaaacacaagtgatcactgcatttctgagtacctttctgattaatatgttggatattgtagagcaagtgaaaatgctcagtcatttgcaaatcttgttgagctcttctctccctccttttactgagtattctttctgtcctggatgtcacattggccttgatttaaaagaatatgaatgtctctgcattaaaaagacagcttggagccaggcacggtggctcacgtctataatcccagcactttgggaggcaaaagcaggaggatctctggaacccaggagtagttagagaccagcctgggcaacacagtgaaaccgtgtctctacagataataataaaaattagctgggcatggtggtgcatgcctatggtcccagctacaccaaaggctgagggtgggacttgagcctgggaggttgagactgcagtgagtcatgattgcaccactgcactccagcctgggcaaagagtgagaccctgtttcaaataaatacataaataaatagacaggttgggggcattctcactgctttcaaattatctgccatttctgagttgagatggatgtcaggtatgtactgtgaaaatatcagtatgatgttctgttgaacatcggcagaatttgaaggtcttcttcctcactttttggatgatggagattcctttttctttcttctgctccttaaatggcatgtgattttctgggcctggcaataactgtgtgggctccccttccttttccatcccacatacttaaaaaaaaaattgtaccaaagctcagcagtgaaagaatgctttgtttacatgagtattgcatgagattgtattttaatttttttagcactccatcgtgttctctttctgtgatatatgccagtcctggagtgtttgtttgcaaacatcaatctgataagggccaaaatatctctttatttccattagttcactggactttgaaatcactgtgtataaaaactccttctccatccggatttctctgctctatacctaagtgatttctttttccttttatattagttagtttatatataaagttcccaaactagcatttagagagtttatatctttcctccatttctgcatatctctcttatgattaaatataggagagacctggaaggaaatagtaaggagtatgtttgagttcaagttcttccacttcctgcctgcctgacctagggcgtgtctcctgccttcctgagatgcagcttcctcatccgcacatctgcctcacaattgggaagctcatgggcaataatgaatatgcacgtgccatttaaagttacatactacacaaattcaaatgaaatatggtattcaacatattcctattttgtttccaagactgttgtagctcatgaggaacaagtgttctgtctcttgttttggtctggatttcatatgaccaattcactggcgtcgcctatctcttcacccacctctcccaggtgatagataagcacttctttatttcctatatcaactttctaagattttgcttcattacttttaagtatgtgctccattcacacagggatctatacgtttttctggaatattagtaagaagttgatctgggaaaatagtccaggcccttagagtcagacaagattgcatcttaagcattccttatgaatgagagtctcccccgttctcagaggtgacccggagcaggggcatcctcaaacttgctcagtaaccatctgcccatgtggttttgcccaacgatattactcagctctttatgtgactagtgagtacagggtcaaagtatctaaggagcacttaaaagttacttactggcttctttctctttctccagcattgccaataaacacaaaaaccaaactgttttgtccagttggggaaaaaaagagaatacccatatgattgtgttgaattcaccatgtattaattcttaagtaaagccttctgagaccttcctaaaccccgtggactctacatattataaaatattattagaatgcacccatatgacatagtaaatatatatttgctgtcaacagttttaaaattacttctataaatgttttgaaattctcagtagatgttattcattattgtaaagtgagacactgtaacctacaaattgttttaaaatataaaaaacaatttgacaattgacattgatacagtgtttctctttattatgttttaactttttaaaaaatttattttgaaattgttttggaaatcctgaaattaacaaatttatttttaagttgtctatatttgtatagcctttatatatagcagaggccatagacattactcctatcctaggcagtggataacacagacctgtctagagcagaattttatttctgagaccacagttattttttttctctctatataatgctatagtaaatagtatagcatttttgcagaggtgatccaaacttctccaaagttattttagttttcatgttgaaacgattttttaataagaaaaaaatacttttatagtgaagttgatcagtctgtgctaaccttctctgtatttctgataattccttctactgtgaaatcatttataacaggtatcttttgttgttatggtctagcaccttcacactccatacctgatggtactggaacactttctaattggtgctcctggcattttatgtcttcttggaagcaggcagttggagcagaaacttggctcctagacttttttgaacatcctcaggcattgaaacatatcttgttgttcccagtttttaatcacatgtatctttcttctagatgggagaggttttggagggagactttctttttttgtctcacatatttatctcctgttcagtcagcagacataagttgtgataaaccagggaacaggcctttgtctagtatgaaaataatgaaaagggcctgcctagataccccatccagctttctctctgtccatctgaaggtattattaggagaagtgccacttccaatgtttgatttgatcctttgctccagttcttaaggtgattctgcagtgtaaagacacttgggcggcattatcttcctaaagacttcaggactaggttttcttgagacaaagtacgtaatgagatgcctcatcgttacacccttttcttagattttcaattttctttggacaaacttcaacccaggaaatttcagtacactggagccttcctgaaataattttcaaagtgtaacaattacttatgccatatatttttagaatggtaccgactgaaatatactaatgatagaatttaatatgtaaactgttagaaagcataagaaatttttactagaagtacattagcaacatctatacatgactaatcaaatccattcattgcctgtgaaaaccagtaccctagtttctgccctgttcatttctttttttttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactaccggcgcccgctaccacgcccggctaattttttgtatttttagtagagacggggtttcaccgtgttagccaggatggtctcgatctcctgacctcgtgatccgcccgcctcggcctcccaatgccctgttaatttctaatgatagctttagggccccctgtggcctgtgatcctattagcagcagggatgcttagactggggccttgttgctgacacttcccaaaagaattctttctttatctcaaaaatggtttctttgcccaagatagagtctttgggggcaaacttttctactattgtttttaatgtgctgtcccttaatgtacatttaaagctatcagtgtattttagagccaaaaataataattacaagtattcctcactctgcatatattttgttcctgaattttgggtgacaagtggtttggatagtgggaattcagacactgaaggatgcttatgtatgacttatctattaatgatctaccctgaaaataagaaaatggataatatttgaccaattccagtggtctagaaatattaaccttctttcaaagagtctggcatttggaaaagtgatatattgcatgccttgatctcagtttatctattgctgtctttgtgggactttttcttctttgtggtcttatctcaaagctggctttgttcttttgctcaatgcaatagccaaataattattgctgatgtaatacttcgcacacatgcacacacaaagtacacatgttctggtttatattcctggctttttgcagcaaatctcatttggtgtgtggtaagcttctgggacacgggatttcaaaaccaaagccaattgtatgtaccctgcacagccatggtgggggaagagatgttcaaattactcctcactagaggcaggagggctgtttttcattctgtagcttatcttattgtgttaaaatatgtgaggttagtatgagtttaaaaacagacttactttgtatatttgattgagtctgcctctagaaagattcaaaatgggatagggaggatgggggaaaatagctctttcaagtttttatttcaaatcaggcagtaaaatgaataaagacttttagctgctacataaaaaatatgcaaacagacatgaatattgaacatctgcacgtgggttcttaaaatgctcagtgagtcagcagaagagaattaagggctcactgtaaaggccatcagtgtggggagaatggttgcattgtcctggtggctttgggaagcacaacagtcaagttggtcctgaagaaataaaggacaggacacagtagatctggaagaaaagtcataggcttcttgaagttgtctaagatcttaagccatatcttagagtgcgcaccttgtttatctaagtttctctttaaaattgccctccgaggcagtctttctgctgtaaatatgtactaaaggtaatgatgacctgtttagaaagggcattcactggctcagcatttcccgtgaagcccttgggatctgttatctgctttgggctgaaagagaccctggaagaaagggaatgacaaggaaatgaaacagcctgagagaagacagggttagaggggaagagaaaggaggagaagcaagaatgaacaccacatgtgtagaaacagggaggaagaaaggggagagcaagacagtggagtccaagctggacatgaaagaatgagatggggcagtgtatttgaggaagcaggaaagacaactggaaagaaagacccctaaagagagaaaaagaaagtgatacaggaagcctatttgaaacacgccacgcgcattaagcaggcagcctggaacacccacttgtctatcagtaggacacgtgaagaaatgcagggtgcatgcactcagcttcatcctcttgttcttcctctcatgttccatgagtcaacccaaagcaattttctatgttccccaagccatctaaatgcatgctaccattccctttgattgtctagagtgcaaactgtcttcctcactgaccccatggcattgcgaccaatcagtaagataatatcacaatcaatacaagataaactcttagcaggtcacgaattccctgctaaccgaataacactagataatgggtaatggaagagtgatggcttgggtgttctattttgttgttgctgttgctagtgtttgctctttgcaaactcttgatgcagcacagagttttgtcttcttaaaatcagttgatcagaggattcaaatggctgtgcaggtgactacagaaaatccttgctagaaggtgatctacttctatacattgaggctgtcttttttttttttttttttttgggttgtaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctcagaccagtcgatccccaggtacagtctgcctccattccatcaggcattccaataagttgcacaagaaaacctattattaaaagcctagggaattgtaacatggattcaggcacaggatcaaattatgacccttaatatagaatttatagtaaaataggtggccccactgatttttaagagtagaagaacaggtgagaaagaaaaaagcatcacccttaaacttgagtcaaccacaaactcacttctatttaaattggcctctctggggacccataggagttcctgcaaggtgagaacaagcattcttttagttgcaattgccaaaactagaattcatagaaactttgaggtgtgtgtatgtgtgtgcattatatattttttgttttcttgggactttggcatgagcctgaaactgaaaaaattaaatagacttggttaagtaaaattacgtcttctaagccagtggttctcaaagtgtaaatcactggaccagcagcatcaaccatcacccaggaacttgatagaaatgcagattattgggcccacttcagaccaactgatcagcaactctgggggtgggggaggcctggcagtctgtgatttaacaagacctctaagtgattctaatgtactttagagtttgagaacaactattaaaagctatagggtaaagaaaaaagattactccacttttaggaaaggagggggtttctggaagttctgcaggacttttaagttatatatgccaaaaatgaaatatgaagtgaaatagattaaggaattccatgaaaaataatgtagtttcttctgccaaatgtcttaaatttcttccaggcatccacctgtgttaagacttccacgaaatattttaaggtcacctttgaaatatgtaatgctgtttgaactggagtttaaaagagtagtgataaaatcaagtattctttgtgttttcagtttgcctttagtaaataaagtccaagatttttcagcaccaggcagcttggcatatcttcctcttggctgtttttaatttgtatataattctttcatgcctaaccctcaaaaagatacatttttttacaggaatttctattttaatgtacaaatatcctcttttaaaacccctaacgttgaccttggaaggtactttggcctttaaaaggggagaagagagggaaaatgtacttgatgagaacaaccagagtgaaaatgtagatattttgtgacagttaattcacttaagctttcttcaggtgcttcagtttgggggttgtgtggtgtggttttttttatttttttattttttggctcttttaaagtgggtttgtgttttatactagatatttttttaaatgggctttgttttaatattattatttatttaatgatatttaacattaatataaatccagtaggttctattctggttgaagcttaacattcagctaaactgggctttgaagatttcctctgaactgtcattaataacattccagcacttaaatttaaaaccaaagaggatttgacaggtccttgcacaaaacagatattaaactaatgtttgttgaattaacagtgtaatttagaaggcactgtagattttttccccaaccaggatttatgggacaccttccccatgccaggcacagagctagcctaggggatatgacgatgagcatgacagacatagtgcctctctctagggagctcaccttcgtgaagtaataggagacacgcttagataagcactaactatgaggtgtgagcagtgctatggcaaagtggtgccctgcactctggattttaatgatttgtctttaagagccacaacttcgctgaaagactgcctgtcttccctgcgtgaacagtatcaccacatgcccagttggcctagttgagatacttaactcaaaaagttacatcctggtgtcaagagataatacgacagcatagatggtaagagccagcacaggagaaagtagaatatcatagaggttaggtttatgagctatgggtgtagaatgcctggtccagtccatgctccagcaggtgttatctgtgcaatctagggtattgctaaacctctctacaccttacattgctccggtgtaaaatgagggaaatgactgtatccacctcaggatggactcagtgagttcataacaagtaagatatttagagcagtttttgttttacagagcaacaccctctaatgtaaaagttaggggttttaaaggaggaatttcataatattagcagagaagtgcttataaaatacattgcattgctggtcaataaatattcactaaatatacagtagttattgttattatttcacacattccactgacttagcgttcccaagtaaatcatttaactttgtgccaaccctacatatcgttccaatggaaaattttgaagagctgttaaaaaacatgctatatatagttgtgatagactctctatagtccaatttttgtgcccttgaacttttttttttttttccttcagctcactgaggtactggctgatctcttttttcttctaatagtgctgttttcatgttgttttgatgcttagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtaatatttactggggtgttttttttaatcaccagcatcactgatgatttttattaccactattccagacctttcgtagtagtggagaatgtgatcatgccaaagcacttccccttctcatgtttgttttggtccctcttcattccctggctaagacttggattgccatttaccatgtctgacctttatttcccccgcaagaaaactgaagtcaggtagattgaagcacagatcctacgtccaaagttagaactctcaacaccaagtattccaaactgtcattttgctatccatattaacaaataaagtaatggatatttcattgatgactgaatctacatcaagacaattgaaaacttccagataaaaagtagaaaatccatgtattcctatttttaacaacacaaaagtgaagccagatttcaggggttcagaagatagtattgttcttaggatattttagttggccccattttaaggaaagctctttctaggccaagtcataatttatttccatctttaattaactactgaggaaaaaccttagggtaaaatgaccagccattccactggacagaacagccctgagtttgggttcttttgttttcctataccaagtcattactcattccaagaaatgttctagaatgtggctgtgtgcatctagctacaaacaacctggaagtatttcaaaatactagagacattttttgcatcggattcttcctggctcaggaatcccccttttcctgagattagcatagaggctgtgacaaatggaatgttccacaatttgcagaaaatgccactgttaattccagaagaaaaagaagcttttactcaattacaaatacatttcctcatcttcctcttaaaaggatattataacaagagtcccattattttgaaaataaaaaaagctgataattttttgagattctttgtggaagcagaaatgccatcagaaaaaaaagggtacatagggagcaaaagtcaatatgaaaaataaagtgggcaaaggagcagacacaatagatggaaaagctgaaaactgaatttattggtccactctctaaaaatacgcaggcatacatgcatgaacctgggagaaaattttagatgaattcaaaaacttaggttttaagaattcgttaggctcttctgtctctacaactatgtacatttatggtaaggaaaagaaaaaatagtaataattaatttgaacaggtagtagcattgatttggtcattctgctttactttactgactcatctttatgttaaaatgaataataaaaattaaattttcaaaacaaaggatgacactttacactgaaagtaattttctatactaggattcataatatgattcttttaaataacggactcctttggtacacttaaaatatttaatttcattttaaaatgtctgttttataaattgggacatacttcaattctaccttaggtttctgccagataagctaataatacattttcctcaagtcttattggtacttacacagcctttttgaagatccttccagtattttcagtattaattctgctttgtattatgttctattatgttcactaattgaccaagacacagtgcttttggtttttggttttagtaggtaattgcaaatcaattagaaagtagaaacattcaagatctactgtggtaggttctctgagctcaccaacatatgacttatgtcttaagctctatcctgatattctagtttctcaccagatttcatgatttccttatctgtttattgtgatgtaagctaaaagtggaacttgcttcatctgggtggctctcagctgatgcaacttccaatgagttaatgataccctaaagaaattcctggtatttaccacttttgcccaaccaagagaggtcaattatttttagctcagtgtatcaaaattattagctttacctatctttaaatttgtttttaagattgaggatgaccctctttaatggttcccaaatttgctcattgttttttgccagtagacctttgtttgattttgtttagggagtttaatatttcttcgaggaatgaatgaaagatagttctttactgtttcggatagtttctgtggcttctggcaaatcattggaaaggaggattttctgacaacaggctatggaagctactttatggaaaatatttctgaattctggtttcttccaggtgcctcaaagaacaacttctatatccccagcattagccagaaagaattctcctgggaatggtagtgctctgggacccagactaggatctcaacccatcagagcaaggtaagaaaggaaggtggttatggtaaaagaagaaactcctacccaccattgtcattattgctttcctagaaatgcctgtgttcttttttctcttcagaggcaggttgactttccatgtgcactataaacgttgatggtccagaacacatgccttttatttcttcagtagcttttcagagaaatcagtattcagtggggggctcatgaataaattaattaatggggcaacccagaaaccaatcagatgtaccttagcggacagtttttaaaatctgagagtaaaatttgcaaatatggatctggttgcaatgccctaaagcattacttcagagatcagtttagagtcagcagaacaaaatgacctgttatggcccatttcgaggtgatttttagcatcaggtcaagaaacatgccctgggaaccattgagacattacaaagcaattaccatggaaatagtgaccatcttcagagcttctctagcttggcagttatagaagaactagctcttacgaggaagttgcctctttggcattacaaaggtcactgaaatacagttatgcttccactcttgctctgtgtcctccttccagaatttcctatcaataatgtacattcctacagtcagaaagttgcatccacttccactggttggtgtagaggtctcaagaagctggaaagtaaacagtatctttagtgtctgagcaaattttttgtggtaacagatgctgtttgctgttatagttcatcaagcttccctcagatttttcatgatgaatacatcactttttaggatcaactgaaatagcaaatggcctctgctaaggctataaaaaggatgtgattgggcaggctgttttcttcttcattgtgttcataataaaaggaccctcctttgctagtaagagagaatgactggaaatgaagcttatgattacatgcacatatctttaaaatatggaatgctttaaatcataaagttttaattttcctcttcacatgaaaagccttagggaaggggtcagcccagcaataacatgaaactatactaagaacatgaattcctttagggcaaagatgctagcccattctgtgtggaattaccaattgcaagaggctctgaatgagccattttttttccagtgacttgtctgattcacactgagctggtattgctaagcagctaagcagcactgaggaagactagagccactgtgaccaggcagccaagggaacgttagtgctggatcgccagcctgaactttatcagtgcccctcttcaagcagtgataaatccccaattatcagtgctcctgcttcctttgaaccctgcccccgggggctctgttcattggatcggttgcttagaattttagtttctttagatcaagtattatttcaactttaagtatttttccttctgtcaaccaaaaagagaattaccatcatatagtcaaataaaaagccatttccattccctctgaagtgctattttagtgacattaaggcctaagataattggtatttgatggtcagtggtttacaaaataatgagccttttctcttggaaccacttggatattatactttatccaaagaatgctgactttgtgagagacagctaacatttttctatttagagaggaagggaggaagtgagttaagaggtcatagttccttcctataatgaaagacagagattgggggtggggggtgaagaagcctcttctctgcatgtaggacagtcctacagaacacccctttttatgctatcatgtatctccatgtggccagcatttaaggtgtaaatcagatttgcggttctagattggattgcatttttaaaagcttcaagatttgttttatttacagtgagagccacagctttagttcacctttgctgcacaatataatcaccataagtttagtgacctaaaagaataacagtttaatatttctcatgatgctgtgggttggctaaggagttcagctgctctcgcctgggctcactcgtgcagttgcactgagcagatggttctgctgtacctcttgctccacgtggtcttccattctgggcttctttaccctttggtgatctcagaagagcatctcaagagagaaagctccaatgcactagtacttttgaagcctttgcttgcatcatctttgctgataacccattagccatcacaagtcacttggctaagccctgagtcagtatgggaaggaactacacaggggcatggacactgggagatgtgatttgccaggggccattactgtgacacagacctctcctactctctgttggtcctaatgaagtccgtatagttctttttgtgccatttatcagacaaccatccatccataaagccactttaaaaggtgttgcttttaaataacctgtcctttacagtgcttccaagctttcctgtacttggtcaatattctgtttttcctcctagtcttttctttgaagtgattcccaagggtgactagaaaattagcaaagttaaaatggatgcagtaaaaagtacacagctaataagggacagattcaggatgttttgttactatcagtttttaattcatttgctaagttcagcaaatatatactgaagctgcatgtggccctgggacccagtgactcaaaccaaaaccgcctgactccagggcgcaggggtcgtaatatacctgctgctctctgggactacgggtactagtaggggcaaaattatatttcttgcctcactttcttattttgctttgaattaactaaaagaggcagaacctctctcttcttctgtggcaaacttagggaccacaattttaagacaacagtgtctcaacccagaaggaacctggacccccaagtcaccacttagagaaccatcaaggagaccagttctacctctgtatattatgatgtgagtgagaaataaaccactgttgtgctaaatcaattttttaaaaaaagaggccgggcgcggtggctcacacctgtaatcccagcactttgggaggccgagacaggtggatcacgaggtcaggagatcgagaccatcctggctaacacggtgaaaccccgtctctactaaaaatacaaaaattagtcgagcatggtggcaggcgcctgtagtcccagctacttgggaggctgaggcaggagaatggcgcgaatccgggaagcggagcttgcagtgagccgagatcacacccctgcactccagcctgggcaacagagcaagactccatctcaaaaaaaaaaaaaaagaaagaaaaaagaaaaacaaggcagagcctaacggttaagcaaaaacggtcagtttttgcttcctgcacttagtagtaatgaactccagttactaagtgcaagatgttttctagtaactgcagaatgtttgatgttttttgatcatttgggacacatatgtttaaatcagtaaactatttagtaccctgaagagaagactcttgaattaaaatgatcagtatgcaacggtatacctgtaacttgaggacaaaagtaaagcttttactattttgaatatccttccttctcccccaaataactccctattatgtcactcttccactgtctgtatgcaccataccaaatccaaaagagccctatggagaacactttttttatatactttaagttttagggtacatgtgcacaacgtgcaggtttgttacatatgtatacatgtgccatgttggtgtgctgcacccattaactcatcatttacattagctatatctcctaatgctatccctcctccctccccccaaccccacaacaggccccggtatgtgatgttccccttactgtgtccatgtgttctcattgttcaattcccacctatgagtgagaacatgcagtgtttgtttttttttgtccttgcgatagtttgctgagaatgatggtttccagcttcatacatgtccctacaaaggacatgaacttatcattttttatggctgcatagtattccatggtgtatatgtgccacattttcttaatccagtctatcattgttggacatttgggttggttccaagtctttgtcattgtgaatagtgcctcaataaacatacgtgtgcatgtgtgctgctttatagcagcatgatttataatcctttgggtatatacccagtaatgggatggctgggtcaaatggtatttctagttctagatccctgaggaatcgccacactgtcttccacaatggttgaactagtttacagtcccaccaacagtgtaaaagtgttcctatttctccacatcctctccaggacgtgttgtttcctgactttttaatgatcgccattcactggtgtgagatggtatctcattgtggttttgatttgcatttctctgatggccagtgatgatgatgcattttttcatgtgtcttttggctgcataaatatcttcttttgagaagtgtctgttcatatcctttgcccacttgttgatggggttgtttttttcttataaatttgtttgagttctttgtagattctggatattagccctttgtcagataagtagattgcaaaaattttctcccattctgttcactctggttggctgttcactctgatggtagtttcttttgctgtgcagaagctctttagtttaattagatcccatttgtcaattttggcttttgttgccattgctttgggtgttttagacatgaagtccttgtccatgcctatgtcctgaatggtattgcctaggttttattctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttgtcaggtttatcaaagatcagatagttatagatatgtggcatcatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgtgagctcttttttggttccatatgaactttaaagtagttttttccaattctgtgaagaaagtcattggtagcttgatggggatggcattgaatctataaattaccttgggcagtatggccattttcacgatattgattcttcctatccatgagcatgaaatgctcttccatttctttgtatcctcttttatttcgttgagcagtggtttgtagttctccttgaagaggtccttcacgtcccttgtaagttggattcctaggtattttattctctttgaagcaattgtgaatgggagttcactcatgatttgtctctctgtctgttattggtgtataagaatgtttgtgatttttgcacattgattttgtatcctgagactttgctgaagttgcttatcagcttaaggagatttggggctgagacgatggggctttctagatatacaatcatgtcatctgcaaacagggacaatttgacttcctcttatcctaatttttttttgagacggagtcttgctctgtcacccaggctggagtgcagtggcgcgatcgtggctcactgcaacctccacctcccaggttcaggcgattctcctgcatcagcctcccaagtagctgggactacaggggcccaccaccaagcccagctaattttttgtatttttagtagagacggggtttcaccctgttagccaggatgatctcgatctcctgacctcgtgatccacctgtctcggcctcccaaagtgctgggattacaggtgtgagccaccgcgcccggccagagaacatatttttaactatatacattattgagcaggtacagctatgcaggcatcagttggtcaaaaaagtgttattgggcaatgcctgcagttccttgccttttgcctgattcagggcaatttattatttatttctgtatttaatgaacatctctggagcacacatacacatatgtctcatatatatgtatttactaatttaagcagtgtaacaactctgtgaggtgttgactgtaatcaccaccattttacagaaggagaaattgaaattaacatgtgtccaaggtgacaaaagtagtaagtggtagagccaagatttgagctctgataaccttgcaccaaagtctacattcttaagcaccattctgtgctaatttgtttagcatgggtgcagcttgctttgctgcctcattttttcccaaggcaaaagagcccttgatttcttgactgacacagcaccattttgtccccacctttctcaccatgtgcttcagtgagtctgttaacagctcctcttgatcctattgttatttacccttatgttgcgatatttactaccttttcgaagttgttgtctcatgagacccatttatattgcaaacacttcccttctggagctagaactagtgtcatcacatgctttttatagttcccttcctagatggctaaagtctgggagatagcacagtcatcctgaccccatgcaactgttccttgtccttccttctcatgcatatgtagctgggaattgctcagactgcaatatcaataggcaattctcacctgctatgtaaactcctaaatgcctcatgctgtgaaggtgatcagttaagttcaaatcaaaatttgattggaccattttaaaatactgtttttaaaaatcaggtactttcatacttaacattgatgtatgtattctttctaaagcaaattaaaatttgatcaaacaattacattctgaataagattcaaattaagtcagaaatacccagtcaaacccaatgactaaatgattaatttcaaaaaataattctctgtcccatcccaaacctattttcttatgactcatttcttctcattggctgtgtcatcaaagaacaaagtaaagtgaaatttggcagttggccagttaattaaagacttggcccaagtatttgggccacaaaattactttgtaatcccaattttctgttttgactttttatgattcaaatgaatggaataattgccacattttcactttactgtgagttttatagacctagcagcattatctgcaggatggcaaatgtctgaactaaaagttagcatttaaagaaatccatttggatgttttcaggtttttacacattcggatctgaataggctcagttaagatgtgaacaagggatatctattatttcatgggattcttctgaaattgatcctcttaagagcattcatctcagaccccacagccccaaggccagatcatttaatacataatgaaggagagaaaaatgtgaacagcatgacattttctcaaactactcatgttttaccaaaagaaaaggtagaaaaggcattgtaaagttttccctatttctatgtgtggtaacatagagactaaatacttctttcagtctccagcagcaaaaatagcaacctattaagatcagcacccacactggttagctctggtgaggagaacttgtactaatgaggccctggtcagggatttaatgcccatgggatccaattagcttcacacaggatgagactctgagcccagtcaggatgtaggctcatcccagctgcttctgctaatgcccatgctctttttcacacaggacatcactgcccaggcctcatcatctgacttggcagcagcctcctaactagtctgcctgcctctctcctggtcagtcgttcacgtgtactgtgggaggtacacattctcctctaggctttaaaggccatggttatacaactcacccttttcttctgatcactccactctcccagtgtttcctaatacagatttggtacttgatttggccagtgtcatctctgcacccacatgcatcaggaaaaacaacccagccctatgtctgctccgactgttccccagccttcctgctacaacacccagtcaagttcttgctccttcataacactgccatcaaccataccagtctgcactaatggttccccaaactccaacaatacttagtctctttcatacacaacatacagttttgccatgctccctattgtcccctctgcataagtctcatctccatgattgtgttgtaacttgactgtatgccctgtggcttgtgcttctcctccatccctaatcctggtccggtaagtttcacaaagttggtgcttaacacaaaggttttggctaaataatcaaaggagtgctacattagaacaagtagctctatcctgctaccacaccacaaccaccagggaagaaaactcagagcatttatcaccagctaccctcctctcaagagattttttatttatttttttgtaatacaaagaatactacattaccgttccacaaaatgagagcaactccaagaaaccttaacatgctcatcattcttaaatctgtaatacagttggtgagcagtacattttttagagcaagtttttttggaattatttaattatgcataataatttttgaccactattgtttaataaaacagggcagtgtggaagaattcgctatttgggaattaaaagagattatttattttaaaaaatgaaaaatttgaaatgtagattatttcagagctattacacatttatcattttagacattttctaaatgaagggtatttccagtatggatccaaatctattttagtcaatttgatatgaacaattgtcataaaaatagttacttcacaaaggaatgccattattggaagtttttcttaagtttaccaatgatcactctgcaactgattttactgttaagttgacttagcaacccttttaccacaaaagtttcaaagataatatgattagggtctacatttatatgatcatattaatgaatcatgagaacatatttatttgtacatacgtttttcactgcatttttccacagtcatggtctatttctactcaatcaaatgtttttgacagatacattaccacaaagcaagattcttgagttttcagaaagaaattagttggtttaattgctgcttataaagttgccattgtgactgggttactggtagactaaactaaaagtatctcaaaggaaggggtcatatccaaatttatgggagaaacatctaacatccaacacagtacagagtgcctgatacatacttggtactcttaaactgggcagagcaaagttaaagcataaaattacattttaatataatatctcacggcattaaaatcatagctgtatgataactgttaacaaagtctgtttggggaactgaagatgttaggaacagagaggaagctgacatcagatgtttctcttctcagcatctggaaggcgatagatttgagctctgagtttcaggtctccctaaattatccatgcccagcattgtgtaaatctaacagaaaaataaaataaaaaaaagcctatgagttataaatttcaaagaaagagctttatagaagccttgagaatgctgctttttttttttttttttttaacaaaatcgtaaaatcctcagcagctgcctcccagcaccactgcttagatgtctcctgtttgggtacagctcccctgatggccaaaattggcctaggtggtcctgcctcatgcttccatatggctctgtgctcaacgcaggcaaagcatgttgaaatgggctgtgtatatccagctaagctcacagagggcacaggctgtgtcccgttcattatcatatctcaaatgcttgacccagtgcctggtatagaataactgagtgaatgaatactgctttttttggtgggaataaatatatgaagacaaatacagtaatatatatatatatttttaatgggagtagtagcctaccaacaaatttggtcttgaatttgctttttttttttttcgagacagacagagtctcgctctgtctcccaggctagagtgcagtagcgcgatctccgctcactgcaagctctgcctcctggattcacgccattctcctgcctcagcctctcaactagctgagaatacaggcacctgccaccacgcccagctaatttttttgtatttttagtagagatggggtttcactgtgttagccaggatggtctcgatctcctgacctcgtgatctgcctgccttggcctcccaaagtgatgggattacaggcgtgagccaccgtgcctggccgaattagcattttataataattatccaaaaatcgtctacccgtcggtaatagcctaagcatataaagacttcctgcaagaagataataaaaaaaaatacaaagactccacaagctacatgaacaaaggatttaattaagcaattcacagaagagaaattacaaatggcaaacaaatatgaataaaaattcttctacctcagtagtcactttttaaaactgtacctaaataatgagatacaatttagtataaaaccttgtatggagtgaaatggaccatcacatttacttcagtgaaaatctgtcatacctttatacactcatacatatgcacacacacatgcacacaccccaaacttaggccttttcacccaagaattctaatctcaggaaatagaaatgtgattggctatttgtgtacagggagattattgtttcactgttatgtgtcacagcaatgtattggaagcaccttaatatttaacagcagagaaatggtcaagtaactcatctatataatagacaattaatgaagctattacacagcataagaatatgctcacaatgcagttaagggaaaaaagcaagatgcaaaactgaatatacactatgcttccatatataaaaaggaaaaaaaaaactgaatatgcagtatgcttctatagatagatacaaaagaaaaaaaccccagcaactctcattctattgtttctgtgagtttgatgtttgtagattccacgcataagtgagatcatgtacaatagtaaaatatagttgagtatctcctggtgcagagattatgtgtgttccttccttattttttcccttttaatatttttcaagactttttacaatgagcacagaaaaaaatgtttgtaagaaagctttctttgaagattcaccatccagagctagtattttcaatgtgatgaacaagagttcatcctgtacacatccagtagctggtcaggaactctacagaggaaggcatgactgtcatcttctgttgaccccttcctctcaaggtcttgtaagtgctctttttacttccttgcactggggacgggactatgcttgtgtctaccaatggcaagattttgtcccccctagctttactgaggtatgattgacaaataaaaagtatatctatttacagtgtataacatgatgttttgatatatgtatacactgtgaaatgattactaaaatcaagttaatcaatatatccatcacctcacatagttatcatttttttctgatgacatttaagatctactatcttcgcaattttcaagtatacctcgttatgatctgtactcaccatggtgtacagtagatttccaaaagttactcatgctgtccaagtgaaactgtaacctttgaccaacatcttcccattctctctccttcctagatcccctggcaactatcattctactctctgtttctatgagttcggtatttgtagattccacctataagtgagatcatgtagtatttgtctttttgagagagagatatatcacattttctttatccattcattcttcagtggacacacacttaggttgattccatattgtggctactgtgaatagtgctgcactgagcatgggagtacagctacctcttcaatgtactgatttcatttcctttggatatatatccagaagtggaatctctggatcctatgataattctatttttagtcttttgcggaaccttcatactgttttccgtactggctgtactattttacattctcaccaacagggtacaagggttccctcttctctgcatcctcaccaacactcattatcttttgtcttttgaaaacagccattctaataggtatgaggtcatatctcattgtggtttggtggggtttttaaatttatgtttttattttttgagacatggtctcactctgttgcccaggctggagtgcagtggcgtgatcatggctcactgaagccttgacctcctggggtcaagtgaccctcccacctcagcctctcatgtaagtgggaggacaggcacatgccactatgcccagctaatttttttgtggagatgggatctcactatgttgcccaggctggtcttgaactcctggcctcaagtgatcctcccacctgagccttccaaagtgctggggttataggtgacagccactgtgcctggctcattgtggttttaatttgcatttccctgatgattagtgatgctgatcatttttttcatattcctattggctatctgcatgtctccttttaagaaatgtctattcaggtcctttccccatttttaattgggttattcgttttcttgctattgagctgttttgagttccttacatattttgggtattaaaccttatcagatatgtgatctgcaaaactggcaaggtctggagagtgtaaccagtgtgctctgtcactcacacagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgaggtaaaactttctcttacctttacctggcaatactgcctgggaggaaagctgtggacagggaaaaaggttagttacttcctgactctagtccaggcatggccaccactgtgtgatcctgaagagcctgtcaactgctctcaaccccagtctcctcgggagtgggccactgtccctaattgtgtgtgtgccatcagtatggacaaaatcctttctaatctcagataccagtgttttccagggagatcaccaaatatcagtcttatttgaaaatacagtcacttaccagtcacctgaatttctgtttctgtttgattgccggtttttagagtttcatgtacccacaaatgtcctgaacgcattgcaccaattgtcctgtttagtattctgaacatagttcatatacacagttcagaataccatgtatttctcaaaatgaaattcagtaaagactaatgtagaatacacttgaaggaaggaataaaatctttgacttaaaaagcatatttaggccgagtgtggtggctcacgcctgtaatcccagcacttagggaggccaaggcaggcagatcacctaaggtcgggagttccaagatcagcctgactaacatggagaaaccccatcgctactaaaaatacaaaaaattagcctggcgtggtggtgcatgcctgtaatcccagctactcgggaggctgaggcaggagaatcgcttgaacccaggaggcagaggttgtggtgagccaagatcacgccattgtactccagccttggcaacaagaatgaaactccatcaaaaaaaaaaaaaattgttgactcctctggttattcctattaagtaaaaattagcctctctaaatatttaattcaaattattcatcattgtttagtttccagtaatggggaggcctatgaaaaacattattatttccaggtgctgatacataataatacattgtttctagctagttaaaattcactccttctgaatcaacttcttcagaagataattttgcttctaagtgatgaagaccagtactttaattgcaatttgacaaatattaacatacttataagtttctctgtctgatgaaagcctcatgagaaccttcagttcttttttctttcttagactctttattacataccacctcctaatacccttagtttatctcctaacaccctttcagggttttaaataaatcactctatttccattttaaaaagcttgatatctaacatgtgattgatgttcacgtctctggattgggatatggactagccaacagctgcctctatatgcattcttctgattagtggcacatctcagaagtatctactgtatgtctttgttgccttgatcgaaatataaatttccttaatttagaaaactaccagatgtagtggcttacgcctgtagtcctaggtacccggaaggccgaggtagaagaattgcttaagctcaggagttcaaggctgcagtgagctatgatggccccactgcgctccagcctaggtgacagagccccatctctaaaacacctaaagaaagaaaacagccattctgttatcttttttctatttataggcaacttcatattcttagagcaaatatttaaataaaccaaacttaaacgcataccattttaattctctggtctggttcaggcttactttttatttccttcagcccctcgttcttccggattaaaagggctgttgtatccctggtatgtccctgtccaagaaagactactttttaagaaataaaaaccacctctcctaccctaaattgcatcttctctatctgtaagctcatagactgcaaagatgctattcactctgcagctgtcagggtccccttgaccttgctctgtacctccagcctagggcccttctcctataacaacccccttcttgccctcacctcattcttttatttttaaagggctgagaccactcccatctccaattaaaaaccgttccaccaaataaaataaattttttttccctcacaaaatttcaacaaaataacctatcctgattggacaaatgataaaagaagaaaacaagcatagaaccttagaggctcatttagcatagtgactgagaataggactttcagaaatcagaactccagctctgtctataatttcagtgtgacctccggacagttgtgtcatctttgtaaatctgtgttctgtaaaataggagaatagtgccatatcattgggttggagtgaggattaaatgagataattgacatggaaagcatttagcactatgcctgacacataagaagtgctctagtggtgatagtacttgctacatttcttttttttttaattgttactagtgatttccaggtcacaagcctaaatgtgtttgcctgaacattatatttttcatggatgtttcttgaggatttgcccaggtgaatgacgtgtccactgagtaatctcaatgtgatgacacatcacagataattcattcagaacttgagccagcactttttgatggccatctctttcttggtcctctgtttttttcctctagccaacagtaagtcagaaggatcacctgtgctcccccatgagcctgcgaaggtgaaaccagaagaatccagggacattacccggcccagtcgaccagctgtgagtgcttttctctccaagagttttgaactcttaatttaccagagaacccacaggattaagtagttggggatacactcatgatgcaaacaaaaattgttgagattagtaagaacggatgctagaaacatcccgaagaaagtcatacctgattaggaaagaaccgaagagatcttggattgactcctctgcctttggctatttgctgatcattagcagtcctttaactataaaacaggaagagaaacaactcctatcattccataatttctactcagcaactttggcaaaaagatgttgaaagtagcagttaaagagacttgggtactttctatgaacttctctaatctcttctactctttccccatattattttccacatgaattaatattacagtttttctgctatttttcatgcctccaggactatattttctggaccaaactttttaagcagggtccaacaggcgtcgtaacaacttagcatccagcttcactgctgtaacatgatagacccccaggtagccttaaagaggagtatggaggctaaaatttgaaagttgaaaattaatttgggatgaattactatccattttttctatttaaatctcttgagaatcttttctgtaaaatgaacgtgaagctttttggtttactcttttttaacatcttaaagtaacgacgtataccgagagtaataatgaagggatttgcatcattctggattgacattctcttcgcccttttgtatttatcagttgcgtactaacaattacaattttgtgtctaatctgctgcctttctgctggcttttcctccttctgtggattcttctggattgggttcctctcatttcagagctacaaaaaagctatagatgaggttagtattaccttttcttggtcatgctttcacaaaatgtaaatattaaacttatttcctaatgttgacattcagaaaggtggccaatgggagcaatcagctgggaggagatttgtagcaatctgctgggaggagtgccccttcaaatggaagccaactttaagaccctcaaacctacccatatagcttcagagaccttccttctaagctaaaatgtcacttttccaatgttccagtctggctaatgacaagtattcatgctttattaatggcagtttctccttccagtatcttccaatagcaaacctgtacttgccagccttgctagggaatggctctcagcagttttactaacaagaaaagagacatcattctaggacactccaaatttagagtgtgtgatttgtgaacaaggagttagtaggtattgttagattaattttgtgggacattaacaacagcatcagaagcaacatcagctttagttaatgaatcctggaaagttaagtgactttatttccttgtctgtggagacgttttccattagaaaaatatatggctttgtcagttgtaggtagcttgctaagaaggatgactgccttactgctatttgtcagacctgcatgaatacagcagagtagaatttgtttttttaagatccaggccttgcaaagagtcctaaatgcatggaatctaaagactaccatcatggctttaaagctgtagctctgctgagcactacttttgtgaaatttaatggaaaaagcactggctttgaggtcagcaagctgcattcaaatcttggctcccccagtaaataactggctgagactagtctcataacctcactgggccagagtttcctcatccataaaatgagaataaaaacacctccccatcccacttacaagattgtttaggatcatttaaggtaatgtgtgtgaaagcattttatgtgtaacattgctgcagaaagccaagggtttgattaaggtttgggccagaggcatggagctattttggcaggtaggagaagcatgtttccatgtatctggtcttcaccgaagagcctcactttttcagacttatggccacctcaccacccagagtgacgagacagttatgatcatagttgaaggattgttgcttataaaagaatgagactccgcatgtttgcggtgtgtggatggcatttatagaaagggaagaggagagtgtgtttttaattgctctgtgccgtggccttgcttgcccctctctctcataatagtgagaagggcagggattatcacaacttttgtcagttttctcccagaacaggtaaagaaagacagtgaagttctggtgctacagttgccaataaaatggctgtgcatgtgcagaactcaagaggaattacatgagttcagaaattggcttggaggggccgtcattaaggaaaaggctctcacagatttcatctgattaacccagaatattttaggctttgaaaaattgctctacttttttttggtgtactgcaccacactggacagagatgagagggggcaatggaggtatacgtaattacaaataattgagggggtgtgagctgcatactaaaatctctggagccatgtatggttggaaaagccctccaggtgactatcctgatctcttgagtatcactgatccaaaccactaaaataaagcggttctacctaacccagtggctctcaaccacggctgattcctccactcctcttcccttaggagacatttggcaaaatctggagacagttttggttgtcaccacttcagagtagcaggcagtggtactggcatcttgtggatagagcagaggggtgctgctgccaaacatcccgtggtgcacagagaactccctacaataaagaattatctggcccaaaatgtcaacagggccataattgagaaactttgaactacacctttctcccttctccattcataggttttggtagggcttccctctcaacgactgtttttgcaatttagataactgggattgaaatgaaaaatctgaaaatcacttttgaaatattgtcgcttgttattgctaatgatttaactttttataaaaattaatttgggggagtgtacattaatgtgacattgctttctaatggaatatgagattttgcagcatagtctatttaatatagtctttgaatatagtctttgaaaataaatgggttttctctgttggcacaattaaatatgtgacacaaagattatacacgtaagaaaacactgtttttaccgctgttttttattagtatgtgggcatcaaaaatttcaaagcacatcaatttagattggatggaaggtgaacaataactaggggttcaacccccttttccctcagatgaggatattgaaactaagtggcttgcccaatgtcatatctttagagttcctaaaaagaaaatagtttaatacaaagagaaaaaaaagctaaaaatttttaaacaatagttcaaaaattgaactaatatttatttgaataaactatattgtttctaaaaagggacctaaaagagcgcctttttagtcaagatgtgcataatagttaacctttgttgaatgaaaaattatatctagttgattctaaaaactgttaagcctcgtagctatcttcacatttactctgtagtcaaaaaatcttaccatcttgccatatttcttttttagctatatattctcaaatattttcatgctaaatagcacttattttgttttttaaatactttttagctccaggcttgtgacagccaagtaataaattaccaagaaggctcattatatggagaaaatttgtattgtcaaagaataaaatatatgaaaatagaattgaacccaatggtgttaatattagattgtgtttatttcctataactttgctattataaatttttcaatactggacggataagaaacaaaacttcagctaaacacataggttcttagcaatggaagattaattttctttgactacaggtattactttggaattattcattatttttaccttttcatagggattctggtatatgtctcgcctccaaactgttaattgaaaatttcctttaagtttaattgttatttctaatgtttcagggcagagagctttttagtaacacagaagcaaaaaattctaattaaaagcaaaattattaagcagttcagaactttaaagtgtttctaaatacaatgtttagaaaaatgtatgtcattttaacaagtgaaagtttttttaaatcagtagcctgtggactaaatatttctaaaataattttgattttttagaatttcttttgtctcgttttgaaatgtcagagaaaaggaaaataaacctctggggaaaatgtatcattaattaaaccatagccaagagtattatattttactcagaattattaacaatagagataaactcttttaaaccatattctctctttaaattatataaaatgtaattcttaataacaagtaacattttaaatgctagctgtattctttgatgagacttaacacagtcctaatatatagatgtcagaatacaaaataaatttatctaatttttcattatttcactggtttggaggatgataatatccttttctttcatagccttaacaaatatctagactttattttcccatggtactcaagaatagcatacccttcactttcttcttcatttgataaagataagcattgacaattgccaggaggaaataagaagtaaaagttgaaattcagatattagcttttcctattttggctaattgccaaagaaaccagaaatttgcataacattatacctatgttatggttttcctcttctttttataatatgcattacatttaaacagagttggccttctaaatacaattctattttcactttcacagatggagcaaatacattcaccgagattgaggcatgtgcaaatgtgcaaatgtgcatgtgtgcaaaagccctagccaagtgtgtttctgtatgtaatgcaaaggttgaatttttagcagcttccatattctaagggtttcaaatcaggtgtcatcaagacaaatttaaaagccattttgctttccctttgatttctatgaaattagaaagaaatgacccttcagttaacactatgaattgcctaaatttctagaccacgtaaaacacctaaagtgtttcctttcctagtgtgaaccaaaatagtaatgcctgacatacaggtggcagtagagaaacaatgttttgttgtattctcaaaataaaattataatttaactatacacatttatcacagcttttcttttaaccgattaggatggattacccaatgtcatcacccaggttgctctaatcctacatcaggtgaattggatgcatacatttctggattgaaataaagagagaatatggccatagaaaactgtgggatttagtatttttcaatgagtttctttctccctaatcccctgtctctcactgaatgctctgattcccacatgggtcactaatatagggagaaatggtaagactgatgtcaaattgctttttccccatttgcatgctgtgtgccatgggcagtttaacccatgcaaattagagcggccatgcttttgcagaactgcttccctctgcattactctgaaagcatgtaaaataaaaggtagtcggatattcagcacactgcctgcagtatgcctggtgattaaataccacatcatcacatccataaggctaaaggtttcatcatactcatggaaaactcaaaattatctcttccttttggtatttgcacattcattttagtgttcttcaccaggatttctgccagatgactggaatttaaaacaaaagaaaatgaaacacctatcattttggaagagaactcttgttgttgttgttcctcttgattaattcagttctgtggctgtaaatttcagtggcactagactttaggatgggccatgatttgatgtggtacctccattctccagggaatgatgacacaccaaatgagtcactgtagtagctggaaccttgggagttgctctgttctatggctgactgatggtaaatttcagtacagcagcaatcataagaggggaaaagccatcactgtggcttgggcaggagtcccagaatactggggcacaatttctaatcccacatattttcccattaactctgggggtgaccagcttcacctttccaaaacaaaatgagaacccaatgtttgtatatatgtgtacatacacatatgtacacatatatattcaggactgaacagtctcagtctagctattggttttgaaaaagtttaaattgatttcatctttcttttctagcttctacacgctacaaacatcattttcttagttccatgcagtaactatgtttgtcacagttctatatagagcttttttttttcttgttgcttaagctggagcactgacttgctgagagatgtagctttggtcgtatctaccactcatatgctgaacaaatttttctttcataggatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgatgtaagagaactacttttaaagtgtagaccgggaggggactaggtttccaaaataaaaggacaaaaaaatatgagttaaatgtaagattgtatatgggtctgtggcaagataaattgactttcgggacttgggtttttgttggagcatagttctataattatctctatctatggacacaatcacttagaatatgtagcatttttggactgcatacactttacctatccattgccaatggattgactatcctttcggcgactctttcttgttcttttcatcttaagggcaaacaatatcgacaaccagaccattgatacgtgccttcccctctaaaactgaaacactgaaatcatgggcaatgacatttagggattaaaattaacaacataaaacatgtatttcattaccaccactgccaccaacaagcaaggagaaatgcacaagccagcatgcgttaccatcccagcaaaagaatcaggactcagataatcatgcagagaaagttccaaaatataccccgttatgattttctactttattcccttcatggcttctttttctggatccatttttctgtggtctgtgtctttgccacatactgtcagtctctttgcagttctctttttatgtatttacatgtatatttatatgtacctacattttctttagtaattgtagcctttttcttttttttttttttttcaaggtgaggagaaagttcattttttttttttcttattggagtggatcccgtgaaagaacctacccttatcccctgttgcttccccagttcctccacctagtaagcacaaggtgtttgtgccctggtctcctacaactttgatagaatgagatgctaatttttccatcttcacacttcaatcacctctatttctttggctcagctactagcattgattatcagttcacactcactctatataaaaaagaagccatttcaggccacaaattattgtccacttcagcagggactggagaggcagggctggccagtctaaagggaatgtcattcactgattaacatcattacatacaagcgattctaagaggcaaatctaattaacgtagctgaaaaatccatactggttattttgctgttgatgacccagttgctgacagctctaaatatgctaaaatatgacattttgaaacaaattgcattaaattgcctttttaaaagtaaataaaattgttctagaggcaaaatcactaatccagaacatttctgcaaaacatgctggcccttttagtttttgtcttgactcagaattgcttaattcttctgacagatgttttgaactccttttaagcactgagcatgcaagcatcaggatgagagaagattatgaaattaaaaggttgctaaaactctcactatgtgatagccctgctgaaggctttaagagatctgataagttcgtacttggattttgtcttccaaaagtttatatgctagttggagaatgacaaaattacacatggaaaactgcaggctaatataaacatttggaggaacaaccaaagatgttcattagcatttgggttttaggtcccctatcatattttgcaaggctattaatggtgttcaccctcctacctttaaaggcaaatctaggacttactccccactgtagaaacacccacctttctaaaatttcctgaatagaccacgcttcacttctgtctggcatttcctgttcctttagaaatcacctactcacagccccgcctgcataggtagagcctgccccctcttctgtgctaccgctgtatgttgtgtgtattcctgcatcttcatgtagtgccttgaatcaggattgtttgttaggtctttgtctccttttctggactatgatatctttcagggtaagggttatgccttactcatctctcttgctcttaacacgttccatggtgtctggaatacagtgggtcttcagtgactataatttacatttaattgcactgaatttgaaattgcaagttctgactttgaagagtgtatagccaattctatacaaataactgtcagcaagattaaaaaaaaaaaaatcctgaggtaatattagaatcccaagcagggggaagagttgaagtaaagacacagaaagttgactttggtgggaatgtatggtgtatacggtggaggggagtctggactagtgaaatcagaccaagaagtgtgctctttatatgtagccattggaaaccattgaacgtatcttgagttcagtgttatatttgagggagattatttcagcaagacgatttgaaaagggaacagactggagactggtaaagcaattcagaggcgctattactataatctgcataagaaataatgaactgaggctatcatggaatgctgatggtggaggcaagacttgacatggttcttaagggattggtaaactttagatagatggaaatgattgtttaagaacatttaaaatatgtgattatgtatgtgagaaaataagggtacgaagggtacaaatgtatgtgtgtatgtttacttcaatttgtaaatatatgtatttttatattgcatataaaatatacacagtctgttctacaatgtgatgattgcatgcctgagaaatttcatactattaaaagttcattataaaacaatatttaggaattgagtatttgggggccagagtgccttttatatacattcttattacctttattttttgttaaggtaaacctctatattttgtgccatatatttttaaagcagaaaacaaaaatatattgtagctcagtgcccaccatgaagtaaacacagagaagcttctcagaaatggagcaccagccattttgacaaacagctgtggtttctgatgtttaaaacaatagcttttttctatgcactgtgctggttttgcatttattttacaagatataacttatgagagtgcacttaactaagtttgtattccccaactaaccagttgcagtatttcccaattcctcatgcatagaaaaataacgagtggagggaaatacaccaaaattataaaagtgattacctctgggtaatataattatgggagatttttattttatgtatatccccaattatatgatgggcatgtactactttataatcaggaaaaaaataaaagctttatagaataaaaagaatggaaggaaaggcatttaatttgatttgcatcacatcaagcaagccaaagaggcaaccttaggtattagtgtcttccctcaaataccagcaaatgctccagtagggaagatttctccactgtaaaatgactcttttatttccgcttttttctatgctatacctttggaaggaagccactatgcacagcccacacttgaggagtggggaatcatgcgttccctcctgtagggtagaatagctacataatttatttagaattcttctgcacagatttgtctcctctatttattaatttattccatcatttatatcagtatagattcatggatataatctttattttgttgctcaaattttccagttttgaccttgggagctctttcagttagctcctgtgcctctttgactgacatgcctccacctccccttgcttgtttgtaaattcccattccaacagtcagaaacctggcttctgccatcaactactgtattagtccattttcgtactgctatgaagaaatacctgagagtgtataaagttataaagaaaaagaggtttaatggactcacagttccacatggctaggggggcctcacaatcatggtggaaggtgaatgaggagcaaaggcatgtcttacatggcagcaggcaagagagcatgtgcaggggaactgccctttataaaaccatcagatgtcctgagatttattcactatcacaagaacagcagaggaaaaacccacctccatgattcaattacctcccaccgggtcactcccatgtcgtgggattatggaagttacaattcaagatgagatttgggtagggacatggccacaccatatcaaccacccatttacttaattgtgcacatccagtatttttgtatagtagtatcaaatttgttaacctgtaacctcatgggaaacaactttctcaactagaatgtacactgtttattgctcagttcctcttgcctttagtattacagactccactcatttccaaggttacttagatcaatgcctttttgccacatttctcctcactgaagttgttcatacatttgtaatatggtgagattctcttatcacagtttttaacattctttcctgggagcttctgatctcctcaatgattttttaaaatttatatacattaagtttaactctttttcctgtaaagttctatgatatatctgaatagattttttgttattctatgataaccacccaattataagaaaattattttggcacatcctagtaaacccaacttcataaaattgtaaaacttaacattgattgctcaagatattttaaatatccaaataatatcctgatagccaattacttatcaattcacagaagagctatatttttacaataaatctgaatgaaatctctgttagacattaaacaaagcccttgacccaagatcttcagcgatttaataaacatttattatgtgctacctgcattccaggcaccatgcttggcactgaaaataccaacattaatgagatctgatcattgcaggactgtgtattgaatgcagtggtagagatgcacaaagggcaatgtggaggcagagtgaagagccacctaaaccattccagtgaggcttaaagaatgagttagccagagggaggcagagaatagaaaagaatcttccaggtaaagagggcaggctaaagtcaccagggattttctagcataatgtacataggaaacttttataagttaaatgctggtagagttaggagttggggcaggattttgttaaaaaaaattaggttagtgagacaggcaagaactagataatggagagcttgtaagccacagtaaggagcttcaagtttatcctgtggttgacagggagctactgaagattgaaagtagaagagtgattcggacttggtcagatttgtgttttggagggctcactttcacagctgtgaggagtggatatgagggggaaaggactgaagacggggtggccaccaagaaaactgttattcaggtaacagaggaagcaggtctgactaggacaggagaacttgattgtacaagcatcagcctggcagatgccaccaggccaactgagcccctgacaatagcaaagaacccctttctgataaataagaaaagtggctgccctcatggaagactcttgataagtacttcattgatttattggctttatatcattttgtcccaaacaagtacttacggcacaaaggaagaaagaagagcaagaaaaaaaaatggaagatacacacaagataaacaaatgagtgaagaaatgatattttgaaaactgatttaccaatctatcaaaatgccaggaattcaatttttttttccatgtctctgaacactattaaaagctcctttctaggaatgacatgttgaaaatgaaaatgcctctttggaatttcttcccaaacacatcagttctagcccacatttagattcattcaatccactgctccagtttagtaattgcaatggaagcttcttactatacattttctcgtctggactccccctgtcattttttcacctgtctgttttggataaaaatccttgaaatatgtctttctctgccccagagacatcataaatctggtgtatttcttgtttcttagatggaagtttccagtaattctttggactttcataagatccaagaggccagagatatttttaaatatataagaaacaatgaaaataaaagaaaaaaatgattaaagttgcaattaatatgcctagagagaaataagccttgataactttcctatttttagaaaacccactttaaaagagaggcagatgctaaaataggagaacaacaagtatcgcattaacaaccaaaatccttcttccagaagccatgttgtaccaacctcaacctgtggtgtgtggttctcaaatcccctgagctcctaaaccagagaaattctgtgtcatgcaaatgaggcactcctgatagagtgaagctcactatgagcagtcagtcatcactttttgagccctggcactgtgctctgtgctacaggacacaggaaacatcagtctgtgttctcaaggagtatgctgagatcctgttaccttctctcattatactgtaaacatgatagcaagaaaagaactgaaaataaatataccaccatgcaggatgattacagaggctgagtgctgtttaagttaaacctcctagtttatggatgccccaataagccagaatgttcttagtagatatttcttctttatagaagcataaagcccatggatctaataatcattttttgcattcctagtatgtgacaactctaggctgggtactgggtaataataatgaacaaagagacaaggactctgccatcacaagcaatgagagggaaggagaaagggagaattcaaaagataagataattgcaaattgtgatgagaactatgaaggaaaaagggtgaagagaaaagaagaggggctgttgggacaagacataggtgataagagcagacttctcacagaaagcatcatgtaggatgaatgagagggaaccaaccaaggccagagtggaaagaactttccaggcagagggaacagcatgtgtaaaagcaggtcaggttgtctgctgcccaaagaaggagggcaggggtcaggggagatcatgcagagcctggtgactcctggtgccaacttcagtgttttttccaggtaaagccaaacacttgctcagtctggctactgggcagagaataggtcaagaggggatgctgcaaaagtggggccagtccagacatcaacacacattaaaattaatatgagattggcagggcgcggtggctcacgcctataatcccagcactttgggaggccaagacgggcaaatcacgaggtcaggagatcgagaccatcctggctaacatgttgaaaccccgtctctactaaaaatacaaaaaaaattagctgggcgtggtggtgggcgcctgtagtcccagctactcgggaggctgaggcaggagaatggcgtgaacctgggaggcagagcttgcagtgagtcaagatcgcgccactgcactccagcctgggcgacaaggcgagactccttctcaaaaaaaaaaaaattaatatgagatgtacttaagaccactgacatgtacacttaaaattggtacaatggtaaattttatgttattaatatgtatattttaccataacaaaaataatgaatatggacaggaaacagatatttcctaaagatacattgccatgaatgttgttccttctcatctcagaccaacaggagctccaggcagcaacgagcagtacaatgtgggaatggtggggacgcatgggctggagacctctcatgcggacagtttcagcggcagtatttcaagagaaggaaccttgatgattagagaggtaagttggtataaaaactgtgtagaggaaatgccatttcttcagtggtttttacattaaagctttcacagagaatgcctatggcatgtattttaagtatggggaattcttgggggagggaggacctgtgcttccaaatagttgagtgattttaattgtctgctgccttctttcctgtattcttctaagctctggcagtgtgacttaattatattattccaaattcttcagcaggagctatgcaaatcagaatatagaatttgggcctgaggatataaaattgcaaacttagatgtttcctacaacaggaaaacagaaatgaatggtctctctgaatagcatcactggccttgttatgtctcttctccccatggttttatcttagtggatttcgtataaaaaatgctcaatagttccaagaaatgatgatatcatcttatcttgttaaattaacattaaaacaaccgttaagttattttattgaaataacaaagaaataggcagatctacttcaaaaatgtaccttggaactttggttgaatttttttttaaactctaggaacatcatttcatttggggggtggcacatgttccctttcatctgtccttctgacatgcagtaactccccactgtgtccatgctaaccagaaagaccctgacaaattgaaatccgtcttttcctctttttcacttcatcatcaccatgcaagtttgagtgcagatatttacttggaaggaaagaaatggctgagaacattgggcaaatgttacctgacctctccctgcatccatctataaaattttataaataatagcatacaacttataagatggttgagaatattgagttagtaaattaagcattcaataaatgttaactattttatttcactctctcctcggaaatgaattctccttttacttgttatcaccatccagtcctccctctgaaacataaacatatgtcatctgtttttcctcttcagccaggacagagttgggaaactctaatagcagactttgctctccaaaaaggcaaagggcatctcactttcgtaagaaagaaaggaactgtagttttgagatgaataaggcctttgaaataataattagcagtggggctataactggaagactagttcacaaagcaacttgctagaatttcattttatgtccttgttgaatctttcaagtagcctttaaagagtcctttcacatatgcctgaaatgaaaaatggacttggctgctgaaattgacattgtgtagtgctggcatataaatctcttcatgtggttaatggataatttcaatggaagtgtagaaggcttctatccctataacttaccacttaggaaaacatgagggagaacgttctggagtgagttgctgtttgactccagataaaaggactccgatttctaatgtggcttaaaatttgcttgagtctttatgacagagtcaatacctccaagtagacatttggagccacattttcagttcattgccagccacatccaaatggctccatgttatttatagcactccagtattctatgaccacaacctgtcactttgaaaacagcatttgcagccgggcgcggtggctcgtgcctgtaatcccagcactttgggaggccgaggtgggaggatcacgagatcaggagatcgagaccatcctggctaacacagtgaaatcccgtctctactaaaaataaaaaaattagccaggcgtcgtggcgggcgcctgtagtcccagctactcaggaggctgaggcaggagaatggcgtgaacccgggaggcagaggttgcagtgagtggagatcgtgccactgcactccagcctgggcgacagaacgagactctgtcttaaaaaaaaaaaaagaaagaaagaaagaaagaaaatagcatttgccagtgtcttataggaatttgatctattaaggaacccaaaatatttttgtcctctcaatttccaattctgccttcctcaatgtgggttttttaaataacaaactgtattagttggggttctccagagaaagagagtatttacatatgtagagagagagagactgctttattattattattattatttttggagatggagtctcgctctgtcacccaggctggagtgcagtggtgcaatctcggctcactgcaacctccacctcctgggttcaggcgattcccctgcctcagcctcccaagtagctgagactacgggtgcacgcccagctaaatttttgtattttagtagagatggggtttcactgtgttgcccaggctggtctcaaactcctgagctcaggcaatctgcccgccttgacctcccaaaacgctaggattacaggcgtgagctaccacgcccggccgagagactgcttcattatgaggatgtagctcatatgatatggaggctgagaagtcccatgatctgccatatgcaagctggagacccagggaagctgttggtataaatcctagttggaagctgggtgaagatgagatgaaatgtcccacttcaaccagcggagaagaaaaagagggagaaaattccttcttcctctgccttttgttttgttcaggtccccagcagattagatgatgcccatcccacttggaaagggcaatctactttactgagtctaccaattaaatgctaattgcttccagaaacacttacagacataccagaaaaaatgtttaaccgaggcaccccatggtctagtcaagttgacacataaaattaaccatcatcaaaccttgagctgaaaattactaaaagtacatgtttaaacaagataaatgcaggttaaagtttatccctgacaaaataagaacataaaataaaaactcattataataagatttagcttatagggtgctattagtacagttctccaagatgaactttaggagaactcacccaacttgtcatcttgtggagtggactagatggttctataagaacataccactctaacactcatgatcctgtcagatgcacaaatttccccttgtagtgcatacccttatccctgtggttctacctatccctgtcctatagccccacaggaccactttttactcggttctagaatacaccacaccagctgtgagctgccatttgtccatggaagctcatctgctggaagaggtattttgtattatccactgctacccacacttcaccaaaagaaggtccctgttctcaatcttccttatctcctacaagcctctactgggactccatggacctttgtacacagcaccttcctggtatcttttcagcgttgatcctcctcactgaaccagaacactagcttgtcatcatgaaggctctttgggttacaagtaatgagtaaaagaacccacttaatacagagtaagcaaaaaaaaaaaaaagaaagaaagaaaagaaagaaaaaaaagaacattttttaagtcgggagagggtaggtatcagaaatagaggagtaaaggaagatttagggtatttcatggaaggaacccaaaggtaaaagtgagctgagcctctttgaaggactggaacagacaggagctcaggcagcttctcatgtgcaggtctctggctctcttgctgcctgtctctccttaccctaatctctgctttcttccacatttctcctttgctcttctctctctttgtagaggagctttctctccctctgcatgctcctgctttcacctctccacttcctccattgcaagatactcaccacatcccagttcaactgccagcagaaactgatccatgtctcttgggcttaatattaaattccagtgggaatctggtccctcttggctcaggcatccacccctgattcaatcagctgtgaccaggagtaggccccctaatacaacagtgcagcccagagcacctgggctctgccataggacagctgggttcaaaccacttagaacccgtgtcactcagggcaagataattgatggaatgtcatatataaagtgtttagcacagtacttggcatgtggtggtacacagaacatctttgtgccaatccccacgggaatggtgagagataaagacgagatattattgaggttctgttaatgaggttcttaaggctgttgtacatctgtctttgtgtttccagtacagtacttggcacacagaaagtgtttaataagaaggtgctggtggagtgaacaaaagggtgatgactcagaagtgggcagattcagagcatactactggattcctttaagcttctcactatctgagccacttccccttgttagcctctctgagtctctctttgataaccagtgtgtctgcatcagtttttggcttgagaaagagtgctgctgatacaagagaggccaaaaaattccaaagagatgacatgtgatttatgctaaagagaggtttggggaaaatgtttaaaagcttttcagtatttgaacagaagttaaaagaaaggagaaactgcccagtatacataaagtagcacacaataagatgtattaggactgaatttcctaaatgtcatttagaaaaggaaatgctcaactctgagaataggcactaatacacgctactgatggccactgtgacaaaatgaatccagaaaatgttcctctccaggacagctcgtagtccaggagcaggttgccaagaaacacaaaggacactaggctttccagttatctctcaagcttcctggaaacatcaattacatgcaccattacaggagcttgggagtctgtttcatctaaacaagaaaaaagaaaagaagtgcctcctttcacttccagccagaggcaggtgcagagagctgtaattgcaaatccatgacaagctccagaagtaaaaagctaggctggtgagatggtcaaagaaacagcatgaaaccttgcacatgccagtagaatgctttacacttagtaggaactaaaaaatactgtgttgatgaatgaatgaaagaaaaggcagagagggaaatcatcacttaatcagatctgctctaagaatcctcaatgagccagttgcataaaagttaaaaagtgcaacactagtcaggcctacaatgtgggcactggcttttggaaaccagagttgtcttttaatcttgcctttcctccctggggtttttttggcagagactgctctccagagcaatggcttccaaacttgttacatcacgtaatcctatcagtaaaaactgtacagcgtgtcacctaatacagtgtatttattcacaagtcatacatttttttctactgcactgacattatatacattataaaatacctttggccgggcatggtggttcacacgtgtcatcccagcactttgggaggccaaggtgggtggatcacaaggtcaggaattcgacaccagcctgaccaacatggtgaaaccccatctctactaaatacacaaaaattagccgggtgtggtagcacatgcctgtaatcccagctactcaggagactgaggcaggagaattgcttgaacctgggatgcagaggttgcagtgagccaagatcgcgccactgcactccagcctgggcaacagagtgaagagtccatctcaaaaaaaaaaaaaagaaaaacctttaaaggacattaaaaagggatattagaggtgatgtttcaaatgctttgctagttatgactttgttactgcctacatcacaaagcaccatagttatttattgagacataaacatttatgatagttgtaaatccatattttcaaatagtattctagatcatgtcaatatatttggaactcctgtcagatctgattaatcattgttttgaccttgtgaatgacaaagagccctgtgagttaagtatggtctctgccctttcttggagtactccacacacactgcttcttttcagcaacactttaggtcgtttatctgttgtgtgggtttgtttcattgtaacctggtaatatgatctgtaaatatatataagtggcaggtgcatacagcacaagtactacaaaagagtttacaagtgtgggccctgctcagtccctccctttttgtagcgtctccctctgtacatgggactcccatgccatatgtgaccactgtctgtacctcatgcaggaacgtaaggcttcaggctcaatccataaactaaatattggcaaagcttaatttcttttttgttttcttaagtaaaatagaaatgtgaatatcaccttctcatgccctagtgggttgatttggagccccgtatgcctatgctgtgtgagggctgatgtcactctgtggcctttttcccccctctctaactcctcccacgtgctgtgctccctcagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaagtaggtgctgggcaacagctgacatgacagttctgctgtccttcctggggttctaaaaccatgatctcttcaagaatgaggcttcgccaagctccttgaaacttgtttggttggtttctaccatagagctacttatgcagatactcaaatagagaaatcatggaagcagagcagtgaaaagttctcagatatcatctgaaccaatacctgtttctacagatgagtgtactgaggttcacagaggttgaatgacttgtccaagacacacagctggtttgtgacagatctaagaccagaactgggacctccagttctgatggaaacttcaggctacacagatttcaaggccaacagttgaggtttatatttgtgttaatttagtcaaactaagtatgacttaagtaaaatgaagtttaaatgatttgtttatgaaaaataaaatttaataaatagataagttcttagagtgttcatctttcataaattcaaaattgtgtgagaagaaagaaaccaagcattacctttcctgtagagaaacagccccagcgaaaagtctgaataaacacaatctgtaggtagtgcccatagacgctgatgactgacaccagttggatgagttcacagtgtgtagtcttgtttcattaacagtcttgtcaatcacacgtaaggccctaaatgtgtttataaagcacatgtactattatttttgacattgtccacacactaagtttttatgatgcaccctttgaattctaaagttatagagtagatgagctttgcataccccaaggaaaagaacacagtgatatactgcaaagcacagcatcctattgtaatttcatgctgtgtgggcattttctgcctgaacacctctcttggtaccaaggaggacaccataagattgaaccctggttcaaattctgctgctgccccagctctatgtggaaatgttagtgcctgccctacctctttcacagacatcttccaaagatcaaaagagaacatgtacgtgaaagtgttctatttggtagggggaattcaaccttgaggaggatgaaatggttttgatttcataggatggaaagaaaatcttgaattaaatcagattagatctttgtggttttctccttatatgtttagaggtcttggatggtggttttatttttaaataaaaacctaacagtaaaactaaagtgaaataacctttagttaaagatatttatccaaaaaagatgtgcttattatgttgaatacagatgtgtttatgatgttaaaggacaagaatagaagaaatggacatgactgacattgcagcttattcagcaaaactcaaatttagaatattgtgacataaaaccctgatattgagtttactgttccctcatctccttctgacatcatgttttcatggtgccattcaagcccaagattcattttttaaagtaagccttcaaggtacattgctcacaaacgtaatatcctcatgaagtccctaaataaggatgtaaatgtaattattcttttaaggaaactatcgtgggaaggaaatatcttcaattccagcataaaatcatccctgaattgaggattttaaagcttttggagccaacaccaattcacttgcatcaccaggccagagtagaagggctcaaagctctcctccccaagagaaagccccttggtttgactctgttcaggataaagtactgctgtataggcttccttacttagtttattgccaattatgtcagcttttcatattgatcaagtagtcaatataggaggttgcttttactgaaagggagaggtaagctctgtcaccacagtgatcttacagattttaaggtgccacatgtggtccaaaatgtaattttctcactacaattcttgcagtctgataattaatgaagtcctacgaatgcacaatgactagtgagtaaccaataccagaagaagctggagacaggcacgcactgactagagcactagaatgtgaacacctgaataccttgaagaatctgtgatcgttttacagcccaagcacagtattgttagcattgttattcctgcagtatttatctgctcttcttaatcttcttgcttattgattagtatggcatggggagcagcaccaaagcctccttcaccccctttgtggaccccagagtataccagacgtctcccactgatgaagatgaagaggatgaggaatcatcagccgcaggtaagcaagaagggccctgtgtttaaaaaacagcttcgtcttcctttctggtatgacctgataaggaaattaatcctcagttcagtagttaagctgattactgcttaggtcctatcttaaaaggaagactttttaaaattattatttctgtaggactcctaaaacaaatgtattactttccattttttttcccatctcttctatttcgtttctggtagacccaggggtacatagggaccctaggaaaagctgttcctcagtgatctctgaacataactaaatgtttccccaaaacaatttctgggtacaatgttttacacacattaggcacttaataagtgtatggtacattgtgttgagttctaggtgtgtgcttcccaccacaaagatcaggctgatttaaaggagtcttgctttctaatcttcttcaagtaattaatcatcaaagtcagcttaggacagtttttcaactgataaactgcaattttaaaaagtagatcttttttgcctatatacaagagtggggatggtgtatttaatttgggactttctagactctgcaagtagtgtctataagcctgtttttctaatgaataaaagattcctttgatgaatgacttagactttattctactaaaacaaaaaaaaagtgtaaaataaggagagtttcagagtttccttgcctttactataattcaaaccaaacaaggagaaatcatagtgttttgaagccccatctccataagttatcttttaagatgtcactgacttctctgattctttttctcaaagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtatgttggtgctttttttttttttttttttaaataaccactcattaatgaactgaccctcaaacattaaaagcctgtggatcttgtcatcaaaagaacactggttgaatcctgggtattagagacctaacttgggactatcttgacctcaggagaaaccaaaaggagttttatatgtagaaatagctgatacgctactagccaggaagacgagattagattcagagcaaccttgtcacacaatagtgataggctaaagccaacaagagaactagctaccactgaatacattgagtgggcaaagcaaagcctataatgtgatcaatcagaggcgatttgtgtctggcactttgtgatataccccacgttcattctccatgatccataccacatcctgcaaggggaatatgagcataaataatggcataaacctttatttcaagctgaaaaatcagcccagagtatttttgtgaattactaaaggtcataaccctagcaataacaagataaaacttgaaaagaacaacaaataatttaatgaactttcccttttagtttaaaacatcaatctgcattttctcgtgaaaaagatctgcaggttttagctgacctcaaactcaggagaggcatgatgagattctatcaaagtcttggtctgtgttactataaacatctcatacagattaaggaaggacatgtcccctgtgtacccactgaaaatactaggcttggattggggaaccataattttaaaaggctgaaagcatttgagatgttagcggggaagagtgtgaagcctaggaaccatttcatgatagaggctctgtcctctggagaagagacagaagagaacaagatagccacatttaatactgaaaggattaatatatggacaaaaaagcagacatttgtgttgatcagaagatagaagtacaagacgtaagagaagttagagagttacatgttcatgaataaagtacactgcacaatgagcctctcaatgtgtgtgtgtgttgaggggtggatgatacatttccctagccataaatttttaggattacaactacccagacaaagccacttatgtgcctgtgcttctgtaatagggattactgcatgggtgttgggctgcactagatttagagacctgagaagtcccttaaagtgagtatgtctgtgactctccagctattaacacttctcttgaatgggtttatcatttccctaaaaaagagcaaaaacttgagggtatggggcataagatagttacattttgattcaagaaggaggaagggcctttcttccattggagtatggaaatggaaattccactgtatattgaaggtgggtaggctagagaccactgcataggggtgggggtgaatcttggggaagaagagaagtgatttatagggagagccaagaaagaagtggtttttccaggcagggaataaaggcaaattatgctagcttcacatctgtgcctaaggctcctattgacaaggactctctgcattaggtagtaaataactagatgtatgaatgctgctaactttataaaagaaaactgtaatttcattaccagaagtacaatgatttaattattatgtcagagcttctacattcattagtttatatttacctacttgcccattagtgtatatttacaagtcacagtttcttaaattttatagggactctcgatgcagaagattaaagttcatgaaaagtcagtcttagggtgcttcttaaatttacaggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggtatgttactaagatgatgagtcccccaggtccatacagcgggaaagggatccacctcatttctgcagaaacagttagttctgcccttcccagctaacaaacaacacaataaagtatagcagtatagccagagtgagattgcccacattttgtaacactgggaattctgacctccaaaaagaagtctctcacctctgcattaaatctgaattaggcagagacataccacaaaggctatatatttatagctctttacctctgtcaggactcagcaaggatcttcggatgtttttaaggtttctgcactccagttattaccacatacagacagaatatcaaaatgcaggcttcctagagggacatttagtaagcagaaatttcttggtctcttccctcaaaaattctcttgcttatagcccactgatgttttggcaggtgcagctggcacactgggtgatcaagtctacaaaaagatttgagtgtgggaatcattactgctatgctctgtagctttctgattcccaaaaagagccttatataggaaaaaaaaaaaaagatggagactaaagtgaaggccttgtaacaagttaaaaatgcaacctaaaagagggtagttttgttgaaagttttttttctttttggtatttgaaggagtttaacgagtaacacccgtcacttcccctctcattccatctagtatggaaccaacttgctactgcactttataatcacctagggagatgtgaaaatctaggctgcacccccagaccagagtcagaatctctgggggtggggtttaggcatcaggagcgttcatagtttctgatgtgtttccattgtacagccaagtttgagaacatggatttatgctcagccattgtttcacgaagagacaacacagggatgctggtttgaactttcctcaaagttcagctgtacttccattttgacaaaatgcttttgcttgtcactaaacttcctctttcttttacctttccactgaatgctcagtttcatctctttttattctccccaaataaggttaaccaggtaaattccttttgtattgccatttgagtttaatcccatgtagtcttttgttctggttaattgctgtcctgattgctatactaccaaatcaaaatgaaaactgcatatctgccaaaagtgggaatgcaaccagaaaattcacattcagacttcattatgttgttagtggcacatcttcattcttaacagtgtaagagtttccttttctcatgaggcacagatagggaaaggagaaaatgaaaataggagcaaaagattcttgaactaaccttggattcatattggcatagaaaggaggaaacactggctctcgtgtccatcctagctactgtgatcaatgtggattctaggcctttggttacaaaattgaatactgaccacacaatgattcccttagtttaggtgatgaatgtgctctcctgtcaaatgcatgtgtaatgctttactaagttctcttctgctggtatatattcatctataaaatataaaacattttttttgggagaggccgaggcgggcggatcatttgaggtcaggaattccagaccagcctggccaacatggtgaaaccccatctctactaaaaatataaaaattagctgagcatgctgggagcggcacctgtaatcctagctacttgggaggctgaggcaggagaatcgcttgaacccaggaagcagaggttgcagtgagccgagatcatgccactggactccggccttggcgacaaaagtgaaactcatgtctcaaaaaaaaataaataaataaataaataaaacatttttaaagcctaagataaagaaaaataagtatccaaaaaataaaacccatagagctaaatttatcattagttaggaagagtcatcccaatggacattttatctggtgcaaatcatcaaatggagtatatcaagttttgctacttgtgtactcttcaatattgtctaaatattttatcatcctatgaattctttattccaagatcactttaccaaacggaaatttaagttttcaagtttgcatcctttttttcctatttttgttcagtattcctttcagtgacttcagcaccataaacctgcccagtataattttctgaacccatattatcctcttgtttgttattaggttatacggtgaaggaaaggcaggtgccaaaatgcccagttgccaacacttcttcatgtgattgatctagaatgttctggaactctgatcactctgttgaagagttagctcttactaagttcagcagacactgctttgcattgggaagagagagtaagagcacatgctcaaataagaaaccacctgaagataaaagacattgtaattctgtgatgtgtctaaaacacgtagagctattttaaccataagttctggcagaaacaccattttaatgacaaagtgctggggacactggttattatgccttcatacacacacacacacacgtaaataaaataaattagaaataaatggaggtggggaaggaaaaagtgagagctgtcacagcaatttgaaattaaacctctattatttcaacaggaaagaagaataagctacgagtttactatctttcatggttaagaaacagaatactacataatgacccagaagtagaaaagaaacaaggctggatcactgttggggacttggaaggctgtatacattataaagttggtaagtctcaagacatggaattataagtttggtctgtttactcaatcagacttacttagttaggtttcacctagttttttctatcagattgatgatgcatgtgtgaccagcttcagatgttgctggaaccttcagcattatttatattttttaaaagccagattgatgaaattgaaagagtgcattcagaataaagtcctaggctccagtttgaacatttatatctactttcttccaaagactcattaaaatgacaagaaaagaataaaaatgccataagcctatgaggacagtgggaccaagagaagagaagaaatgtcggtaaaatcgaaagagtagctgagtgactggaaaaagacctagaataccaggaaattctgaattctgaatctgcagtgaggaaaatgatcaaaatcaatccaacagaacctggaaaggcccaggaactaaggccccaggggaatctcaggtggaagtggaggtgtaaggtgggactgaaaatagaattgttagaaaattcatgagcagcaagtcttccagaacccagtctccacctctgagtaattaggccactaccttcctctgctgcaacagaagatgaaaggtttgcacagccaatatgatgctgggaatacttgtgaaaacacacacacatacacatccctctaacccctacttagctcccaaatagccatgcctatactccctgggaagagaatgtaagaaatgtctttggagaaactaaatggccagaaagaaaagatgtacaggtactaacatttgaagtgccatgaaaaaagcttgctgcctaactaccctaaagataagcctgtctataccaaggagtggagaaattcacaaatatgaaggaaacctaaacaaacagaaagaaaggacgttagaagaaacagggataataaggagtggaagaaaatgtaaaaagaaagaaaggaaggaagcaagaaactataatagctttacagagattagaaaacttctttctataaaacaagaaaagggctgttaaaaaaaaaggtagaacaaagtaggggaaagtcatttagagaccaagaaaaaattttgcaaactaaaatgtattggcagaaataaaaaatgtaataaaagtgttagaagataaggaattctcctaaagagtagaacaaaaagcaaagcagagaaaatataagaaaataaaaagatcagtccaagtggttcaaaatctaagtaataagagttttagagaatatgaaatgaaagtattgaagaaagaatataagaaaggtatctagaattaaaagccttgaaatcccatattaagaggattcactgagtgtccagcatactaaatgaaagaaagactcacaaaaagacatatcaacatgatatatcaatacctgggaaatgagaaggccttcaaaactggcaaagctgtcagaatataagtaaataaataacaaacagtttacatacaatagacccagaataagtgtggcctgggacgtctcagcagcaatatagaagcttaaaagacaatacagcaaggccttccaaattcccaacagaattatttccaactagtattttatagccctcctgtgttaagggttaaggagatatatatatatgtgtgagtgtgtgtatgtgtatacacatatacatacatacatacagctgtatatatgtatgtacatacatatatacacatacatatgtatatatatgtgtatatacatatgtagagagagagattatgaggaattatttcacatgactatactatacaggctgaaaagtctcaagattttcagtcaacaagctcattcagacccaagagagccaaagttttaagtccagttcaaatctgaaggcctgagaaccaggagagctgatggtgttgttccactatgagcactggtaggctcaagacccaagaaacgctgatgcttcagtccaagtctgaaggccagaaaagactgatgtcctagctcaaccaagcaggaagactcagcctttttgttctagtctggtctccaaatgattgcataaggcccacccacattggggagggcagtctactttatcacacatgatttactcctgtcttaaaaatttacttttcatgcaccatttctcaggaagcaactgaaggatgtgttccaccaaaataaataactaaacctagtagtccaggaagatgacgaaaatacccagaatgatggtgaagggaacctggggtgacaagtctgccacaggcctagaaagaaataagtcctggcagagtgggacaatgcagggttccaggaaagatgcctccaagaaaaataaaatggtataaatagatgacctgctgcgtttgaccatgttgaagggcatttatcagcagaaagtttacatgtgcttagagagagatacatagaaaacaagtataaaaaaaaaggggggggggaacaagaaaggaaatgtaaccatggtatactacatacctcagtcatgaacaataataattttaacactcaatattgatttaaccaaaaatttaaaatacagctatatttagagtttacagaagtaaatcgtgtgtgcatatgcataagaaagagaagaagctagagagagaaggaaatgatgtgagaaattaaatcctttccatactacaaagtcagtaaataatgtctgtgactgaaaaaaaaaaatcaaggaataacattataatcatgttatttagaaatctggaaacaaattgctgaaagaagtagttgaaagagttgcaagcggttgtttttatggagcaggaatcagcagggaggcaggtacttggttttcataagccctagagttctttggctttttaaaataggtacctgtaagacttgttcaatccatagctgataagaaaatgtgtggaggcttttaaaatgtgtactagataaaatacattaattatttaacataaagaatgacaataaaggagcggcggaggaactttagacaccttcagttcaaaggagtccatgatgtggtctcagaaaagtatgagacacatttgaaattttaaccagtcaagtgggtccaatcatgtgtgatgacataatgtcggctgaaatctaatcaagtgtatcaaatacagaatgtggaaacagaaggggcatgctataaagaagagctcagaaagaaagaacttcagtgtatcacattttgccaactagaaaggggactctattttgaagcagagtctccacctgccttttctctaatttcattccaggtgaccttcccagataaccttgacacaatattaggaagtgttggggctggctagtgaacctgaaggtttggtgcctgagaaggacatgttcctcacttaataacatgtcactcacagttttacaaaggaaaaaaaaaaagcccctgaccttacaacattatctatgtcttacaacatagataatgtatgtattgataagtataaaaagcagcctttgggccgggcacagtggctcacgcctgtaatcccagcactttgggaggccaaagcacgtggatcgtgaggtcaggtatttgagaccagcctggccaacatagtgaaaccctgtctctactaaaaatacaaaaaattagccaggcatggtgatgggcacctgtaatcccagctactcgggaggctgaggcaggagaatcacttgaacctgggagatggaggttgcagtgagccgagatggtgccactgcactccagcctgggcaacagtacgagactccatctcaaagaaaaaaaaaaaatagcagcttttggaaaaaaaaaaaacgtttaatgtctgtaaacgtatgtggccagagccacatctacatctcaccggcacttagcacagagccaggcccagggaaatcagttaagaagtatttgtttttttaaaaaggaatggatgttcaaaggacatagctttattcataaaccagaccacatgcgggaatgtttttctatagcaggctgggcagcagtgcaagctatttgctccactgtacatttttgttcaggaatcagaattatttggtactttctaatagggataccctggaattctaattttttcttgtcctcaatctgataatttggcaaagtataaaacatacatcccatcattctcacaccaaatagaattcagattcatatgcatatttggttttcttttgaaaatagtgagctgctttctttgagaacaggtcatgttttcaggggaaagcaatagaaacaatttcaaagctgtttccttttgagtattttgcctttattacttggcatttgttagtccaaagatttctagtgatcaaattttgtgtccataaactaatactgtatgattacagagcaataaaattcattgcaggaaataatgcaaaatttctgaatattatctcttgcatatacctgacaagtgtttttcaaaaacatcaggctacaggaatcctatttgacctgcacatctactgttggcccttctaacatttctgacgtcttccttctaatcattgccgtcccttcattgtcctaacatcagtaggctgatctatatccacacatctaaagtaaaatttaaccagggagcaatatctggtaattctctatcagaaaacttgagaccagcttaattttcagaaacactgtttgccttagttatccaaagaaccacttgtagtttccacttagcttcccctatgaaattccagccacaacagcactgacatcttcttgtagcacgagtattctagtatgttcaaattcttgtgaaattttaaaaatataaaatgagaataaaaaagaaaagcaaattgtatatccaagagtcatttaaaatatttcttgatttatctgagcctatatgtgcttagataagtttttattttcaagatgattttaaatttctttaaaaatataaacttatttatttcttctttcaccctgaaaatcagcaaaatctgaagggatttttttttcttttctttttaaaatttattttagatccagggggtacatatgcaggtttgtttcatgggtatattgcataatggtgaggcttgggcttccagtgaactcatcagccaaattgcgaacattatacgcaacaggtaaattttcagcccttaacctgccactccccttttagagtcctcagtgtctattatttccagctttgtgtccatgtgcaccccattgttagcttccacttataagtgagaacatgtgttgactttctgtttctgggttattttaccctaggagattggcctacagctccatccacgttgctgccaagggcacgatttcattctttttatggctgcatagtattccatgctgtatatatacaacagtttctttatctaatcaaccattgatggacaacttgataccatgaccttgctgttgtgaacagtgctgcaataaatgtacaaatgcaggtgcccttttgatttaaaaaaaaaaaaaaaagttattttcctttgggatttacccagaagtgggactgctaggtagaatggtagttctatttttagttctttgagaaatctccatactgtttcccaaggagactgaactaacttacattcctaccaacagtgtataagcattcccttttctctgcagcctcaccaccatcttttttttttttttttgaccttttagtattagccattctgactggtgtgagatggcatctcattgtggttttgatttacatttctctgatgttcagtgatattgagcatttgttcatctgttggttggctgcttatatgtcctcttttgagaaatgtgtgttcatgtcctttgcccactttttaataggattttttcttgttgaattgtttgcattccttgtagaaatttgttggatgcatagtttgcaaatattttctcccatcatgtaggttgtctccttactctgttgattgtttattttgccacacagaagctcattagcttattaattaagtcccatttgtctttttttgtttttgttgcatttgcttttgaggtgttagtcataaacatgttgtctaggccaatatccagaagagtttttcctaggttttcttattatagttttgggtacatttaaatctttaatccatcgtgagttaatttttgtatatggtaagagataaggatctagtttcattcttctgcatatggctagccaattttcccagggtgtcctttcctcattgtttatgtttgttgactttgttgaagatcagttggttgtaggtatgtggctttatttctgggttctctattctgttccattgatctgtatgtctatttttgtatcagtaacatgcttctttggttattacagtcttacagtatagtttgatgtcaggtaatgtgataccttcaactttgttcttttagcttaggattgctttggctatttgggctcttttttggttccatatgaattttagaattgtcttttctaattctgtaaaaaacaacattggcaatttgtagactgcttttggcagtatagtcactttaacaatattgattcttcctatccatgagcacgggatgtttttccattcatttgtgtcatctgtggtttcttcatcagtgctttgtagttctccttgtaggggtctttcaccttcttggttaaatgtattatcctaggggtgtgtgtggggtgtgtgtgtgtgtctgttattataaatgggattgagctcttgatttgattctcagcttgagcattattgatgtaactgatttttgtgcattaattttgtgtcctgaaactttactgaagttatcagcactaagagtcttttggaggaatctttagggttttctaggcataagatcctgtcatcagcagagataatttcacttcctcttttccaatttggatgctttttatttttttatcttgcctgactgttctggctaggacttccaatactataggagtggtaagagtggaaattcttgtcttgttccagttcttagggggaatgctcttagctttttcccattcagtatgatgttggctctgggtttgtcatatatggctcttattattttgaggtatgttccttcaatgccaagagctgtggatcttttcctaggtttcagatgaagagatcagcaaaaatagtctaataaacactttatgtcatgaaaagttataaagcaagtaactggaaacttaatgtcatttaagtatattaaaatttttcctacctagtttctttaggactcagaatattctgtttcttgagatattttaccaagaaactgactgccatgtgtaccaactgtggattacgaattctctaagaattagaatccacacttaacagcaaaagattcagaaggcacttaaaggattgttcaatttctcaaggtcatcaccgtaaacattgcttattattctatcagagacacacacgtaggtaagagtaatgaagagaatgccagacaacagtctgttcttccatttttccattcaataagcatttattgagtactactttgtgtaggcaaaagcattgtggggactcaatcatttaactaagcttctgtccatagaatttacaatgcttaatattccatctttctaaagagtaaaaggatttgtcagtattcgtagccctttaagccactaacagaacccaagactcctaacacccccctttcgttagaagcataaataagcaattatttcacttggtaattggaattcaaatataaataataagcaaatggcagcctttatatctgcccatttgctaatttttctaccatcttgccatatctgctctcagctacttaaatatgggtgaacgtaaaagccaggcaagctaacatgaaggaaattatgcacattcttattacaatgaatatcaacatcaagacctagtgttaaagacagtcctaagcagttatatctctggatgatgaaaagtcttcaatataaagcaaaagccataagtattctgccaaccaaagttcgctaagggaagctaaatcagtatctatgaaaaaatcccacaccaggaatatcaccttcatgaagctgacacccaacatcaatatttaaatttacatattgttgcttatacattcattaatattaatacaaagaacttgagtaaattgatgtactttttcactcataatttttctattacagttaaatatgaaaggatcaaatttttggtgattgccttaaagaatgctgtggaaatatatgcttgggctcctaaaccgtatcataaattcatggcatttaaggtaagcagggatgtgattatctaaaatgtgctttttaaaaattttccgtttctacccattaataaaatagtccatatagaccaataccaattttcatatagataataaacctgttttaaaagtgtaggtactctagggtttattgtttcaaaagtaaagactgaatatttgtaaatgctataaaattagattaaaatttgggtatgccctcctccttgagatctatgaatcatcatcctcaagaggcatttagaatggttagtaggcatagcattgattatgatcttatgcaatgacatttgttataaagccacctaaaccagggtattccctgatattttgtttgaaaaaggcagacaaatggcagcactgaatctcagagttaaactgagtctcttttaatcctcataaatctttctgaatgaagtccctaaaactcaggtgatgcttatatgtccccagtgctaacttacagaaatgacctagtttctctgcattcttctattttgattgccttttcatttttttaccttgtctaagtctgtacccaccatggttggattggtcactcatgagatttgccaggagtgggatggggatatgctagtcctgttgaccccagctcatgaagctgacacccgaataccaggaggaccagtacttacaggcacccagatgtgttcagagccgcataacctatccatagcccaagtgaacttatcttctgttttctctcactctctctctctgatctctctctgtctctctctctctcagcttatgtctgtctacttctttatgtctcattggctctcactttttctccccacctttatgactgttatctccatttggctccttattattttctgccacattctcatgaagggcaaaactgcccttggaacaccatgtaggcccacttcagagctgaatcacttctatcttgttcccttagggcagatggcttctgatgtgctcaagaaaatagattcattaatggaaatgggctcccctccatgacctcacttttatggaaaaaaattggaatgcattaggttactaataacaagggataactcctaaaagccaaagtggtactcctgttctgccaaaatctatctccacaaaagcttttcaatcaacatcccattcccattcttgctctgaagttattgccattattttatgacccagagacacatgagagagtgcaaaatgttctttctgacagaccctatccagcccagaaagagggaagagcaaaggcaaagacttgaacaggaaagagtggaactggcaagaggccaagccttcccataggacaaggacaggacgctagagcttcccatgctgtcagaatggtgttagcaaaagatgagaagagaagggtctgagaggtagcagtggcattatagttaaggcaattgtagtttcacaaatgctctcccagatctcaaggcccaaaggtagagcgtggttaaaaaatagcaaaggaaaatggcagaggaacacttgacagttagttggggcttgggctctggattcaaacacagagaactttgacaaacttggcaagatctctctttttgctttctagttaaacccaaatagtcaatgcaagccatcaatcttgtgatgttccactcccacctctttctctaccacccaaacccaagtctcagattccaacattaagagaaagtgccaatcttatgcctactcattcactgaagaaaaatccaaaccagagcatgcccattaatactaaacaggctgagaaaacagccggccttggctgtccctcccaggctgtctctgaaagggtagttgctgtggatgggcctggttgccacatgggaaagaggggggccagagaggtgactgggccttcttcagaggacaaaggccagaaataaacaggaaaaaacagcaatacccaggcaccaggtttttaatatacattaccactatcaaaatttacacctgtgcaccaacttaaacttcactgccccgaaggacaaagggtagagaaaggggcacaaatggatgctagacccttcctcctagggccagaatatcaacagacctaaaactgaaagagaaattttctagtttttcactttaataaagttagaagttaacttcctctagacagtggctaaaggaaaaaaattaagatgcctctttgagtgatgcggatactaatggggtgatttttaaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatgtaagtactcagaagtagactttcaagggctctctgtacaacagcctgcatgtagaaagagatttgttttgcatagttttagtagaagtcatgcacactttactaaccagcaaatggactttcgttcttcattaagtatactgcttttaataactaaaatatataaatttaactaatttttatgacttcctaaaattggggaatacataatagaaatcatttggcatttacatgttgtctctttggactttagattaaaatgaatatgacatatttctttcaagggcatgaattatattcggtagacaagtttccacattcagtttttgaagggaaattcgttcattttatgttagagaaagccaatggtcaggtactaatttattggagaaaattctttttttgctatttttagttcctctcttcagcttgagggcagtgtggtacactggagtcagacacagtggctctagcatgtattagctttgcagtaatggacacagtaggcagcctctccaatcctcagctttcgcatctgtaaaatatggataaaaagacttatcccataggattatcattagtattaaatgaggtaatggatctaaagcagttggtacagggccctgcaaattgtagatcttcttattagccctaaaatattcatattactatcctgacatattgcttgaaacataactgttaaagggaaatgctgcacatggattcacttattaggattaagtgtagtgtaaagtgtgtgtcctgtgtgtaatcccaagactaacacacaggagaaactatttatcaggaatgtttgaagctaccgctgactggtattttgagagttttaagactttattctaatgaaacgcaataactaaaagaagttgtttcagtatattacatacacacacacgactgccattcattgctgcattattaccacttttaactcatgtggatgtgggtgaacacaaggactcacagctcacattcctggtgaggcagctaaggtgtaactatgataatcctcaactctcttagtccaatctgtcaagcacatgttgggctgccatggcattctcaactaggggatcacaacaacatcacatttcctttcctagaacaaattaatatacacttatttcaatagtgatttttttttttttttttttggatacggagtctcgctctgtcacccaagctggagtacagtggcgtgatctcggctcactgcaagctccgcctctcctgggttcacaccattctcctgcctcagcctcccgagtagctgggactacaggtgcccaccatcatgcccggctaattttttgtatttttagtagagacggggtttcatcgtgttagccaggatggtctcgatctcctgacgtcgtgatccgcccgcctcggcctcccaaagtgctgggattacaggcatgagccactgtgtgcggcaataatgattttttttaatgagtggtcattctaaatattttttctaaccaagccatgaattattctggcatttagacacccggataaacaatcctatatatatatttttttttcacagattattttggtagttcattttgaccccacttaagctatctccattagattcagctggcttacattctcctcatcttcttttggaagtggttgtgctaatagaaaacacattaatttcaacgtcagcaagatatacacaaatcccaactctaccaacaaatactagcacaactttggttaagacacaaagcccttctgagatgcagtttcctcatctgtaaacaaagctatctaccttggggagctattgtaggtactagaaattatatatgtaaagggccccatgactggcacatagtaggtgtgccatagatttacatgctctttttaggaacaggtaaattgaatttttaatctagtgactaagtttgatttaccagggtattttacaagtcagtggttaaattaaagcaaatttcagtctttagggtgacaatgaaaataaacaaaaacctcttttttgcagttgttagagatgaatagtcaaggtgttttattttttaaaagaataatgcttggcttttctttgtcttctagattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtgggtaggttaaccattccttatctccttcagcagttacaccccccaaatgaaacgaaaatcaagaaatgtgaaacaaccatttgattccacaaaaaaaaaaaaaaaaaaatctgtgaataactcttgtaagacttgctttgtccatttatctcaagtcgtttgtcatttttgtggttaagatgtgaacagatgctgtgagttattgcccatctaatgtttttaatgcagttttggaaattccttttgacagcctacattcattccaatcagataatgggctggggcgagaaagctattgagatccggtcagtggaaacaggacatttggatggagtatttatgcataagcgagctcaaaggttaaagtttctatgtgaaagaaatgataaggtaaatccgtttcaacatttgcattagtgtttgcattttaagagaccaccaggtacctgtgaaaccttcattttcctttatactgatttgaatcacatctgtgttaaacaatcaatattatcttgaaatggcattatttggtttgatccatgtgagcactcaatatattattcacatgtcaaaaactacataaaaacatttagaaatttcttgtaaacctcttagaaacctttgtggcctaaaggccttttgatgactcagcagacaccccaaattctcctaagcacttagagcagttggcccatcattaatcatctcacagtgggtcaactttatacttccacttttagacttttcacaaagtcactttcaagacctaaccaatcaccttatattcacctttaaatccaaaacatttgacgtttagaaatataagctttttaaaaatgtcacccattccttaaggaatgcacaatcacaaactcaactagtgccatgtcttgtgtcattccagccatgtttcttctgaaatgtcataggtgaactgttttccagtgaaattggctgtgtccgtctggcatgatcagtgacctcagaggggtattctgcagcagtactgcttctcccttaccctccctgtagagtaaccccgaggttttagtagctaagccatactgcatttgtgaattcatcctttgtggctgtggccaacatagaaatgctgtccccaaagccacagacataaacgcctatagaaaaacagtatgatgggttgaatttttgtatatccctttgtccaccccagttccccaaaggtcaggttggtcttagtccaaacctggtgatgtgggcctaaactatattcaaccctggcccactactctgacctgatgtggtctgggtggacagtagctgcaggtggcaaagatggttccagccatttagatttcccagaaaacaaacataacctagtaaaactccagctcccacccagtctctaagaatcaaaaaaccaggagtgatctgggtatggatacccacattccgattgaaaacctaccccagcagggctgttccaagccatgccacacccttaggagtaggctggggccacaccagttgtctgcaacccaaggtttacagccaggggcacacaacttggagggaagagcagccctttcttttcttcattgtggttttccataggccctctctgtccttctccgttttgattcattgaccctaagagtagcattactttcatatgcagcattaggtgaatgtcaagcatttccagagacctccctaagaagttgttgttagcattcttctgaagaagctgtagaaatgaagtagcagagactttagactagtgacaaaagcaactacctaacaaaagttaggtattgactgactgaagggctaggccatagcccaaaatattactttcctggggcagtggttctttaacattaaacattcagctcaagcaagcagtaacccaaatttttctcacgtttgtcagttgtttgataaaatgacttaacagactcagacctaatggactgtggttctcctcattaatgctatgatctcatttgccctgggatatgccaccatcagcagagaaaccatgcgttaactcttgaaatgccaaaatgagtaggcattaaataccttgccctatctgaccacactatttaatgtttttatcttaaatttaaaaaactgaaatctgaaactgtatgatagtcagtaggcctaaaactcccccttgactttgagaatttgaagggattcccttccatcctgaagtctactttcttgtcatttaagggtgagagaagggaagcttctgtgcctttctagaaattaacaaagaacctgttgggtcctagaccagaaatccagcacgttatcctagcatgaaactcccttttaaaaagtgaacacccaaagagatgttacaaatgaagatatagccccttcagcatctctggagaccaataccacaataaggaataataacaacctaggaataaaggcaggagtttttacataggatgcacgatatccaaagggactttataaacacaagccattgagtcttaagacctgacacatggcaaggataggacatgtgagagaaaatggatggacggttgaagaaaagaggggaaaagaccatgcagttgaactaacttctttttaatttcaaacaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagaggtcacttggtttgggcttcattaggactgagactttgttgagttctttctgggacttggagagtggatgatattcaggctctgaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagaggcatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactcttactcaaatgatttgaacttt

SEQ ID NO: 37851 - DNA, 257622 bp, Homo sapiens
aggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggtaagtccttcctcccctcccccgcgcccatcaccgctctttcacgctgaaattaccttttttttggggggggggtccctttatcttccttttggcgttgactagggaattcaaatttgctttctcatgtttaggaagaaacgttatttgcaacaccggtaactcaagccttctgaagtccaacggagaggtttaagtgcttaaaaatagggctgcttgcttccctgcagctagctcctccgggggcaagagcaaagtcagaagtgggggacgctaattaaaggctcactaggctgtggtgggtatttaaaacttttcctcccctccctccaccgtcgggtgtttccctgcctggcgactaaccttttcactacttgtacccagcccactctttgaattttgtctgtagtttaatattttggctcttcgaaaatccagcttccatcaaagtgtttttagcgcctcagtgaagttcgtcccctttgctctttccttaagcaacaggaacctacccccacctcaggtcattcaagccactgacctccttttcccttttgacatccttgttacaaatgaaatgctaaggcaacataccaagaagagtgaggtaaagtctcaggcttcaggtcttttgcgtctttttgttgttgttgttttttctaaattatgggtttttttgtttgtttacttttttttaaacctaccaaggcatctgaacaaattgagaatttgcccatcacctattcaaaggaaaatactcctttttcaaaggagaatcagtgttccagtttaaaggaaagtgggggaggaggtacatgtgaaatagcagcaaaaagctccattcagttttaggaatgtagaattcaaacctcagtatatctcttagaagggtatctgggtagtcccacccactgtcctattggggatgagggccagatgttaaaaaaatgaatggctttgtgagagaaaatgttctccagcctgaagcccatcatctttaatttcatataacctctgaagaataagtgtgtgacaaattatttaaatttatttgagtgatcattatggatagttttaaaaactgtttaatatgagatcatggcttaggccttcacatggttgagtgaccgtcaattctttgtaagcagctgctatgttacagctcatctgggtccacttttaagttagctgtctagcttccctatagcacttagcatgcctcaaatcacatgtcctctttctatccttctgaaggtgtgtacccggtgtatgaaaactaactttcatattactctgagcacaacataattataatagcaaatttgctgaaaaaccatgcatatcaaatatttttactatgcatgccataattttcttccatcaaagtagacaaatgatttaaaaatgcttttttgatgcagagcatcttaatgggggtaaggtttagccagtcaatagggctacagacttggataaaactgcaattgtgctgttgaaaatagttcattttaaaaacatcttcttggtgccctctgtttctggcatttggcccagggacaaagattttgtagatgtttgattaaatatatatatgttttttgatgttacttttaacaaatttgcaccagatgacaactatacaggtatgtatagcaacactacacatcaattaatattaaatcaatttatgttaacaatgaggtttctttttattgacaaaacttgagagcaagcttgttttcttggattcttaaactaatgagtattcatgaagtcattacagctctttcccttttcctcctatataatttttaaagaacattttatatccccttttcctatcattaggatattgtgcctctattaaaaccaagggtttgtttttcctggttcatacataaatattttaataggctcaaaaatatgaatgatatcggctctgcatacttgtgctggagatatcggtgaccatttctagagtaaaactggttggtggtagggctagtctttgactggagtagtttagtattggggtttttatatcaaaaaagtgttgctatttaaagtgctttactcttttataggtaaatgatttctttatctctgaaatcatgccaaattggtacatcacaaatatgtggaagatcttttttttaggtagagcattcattaggtggaataaagtaacctctatgccaaaaggttagtaataagagaagacagttttaagttggaaatataatttttagtgatggaaataacatttttatgtgaaggtaattatacctgtactgattcactgtcagtgggatatgcacttagatttgtggatgtgggtagtatgtaaaattatgttagttttattttacatagttagtaagttgttttctgtgcagtagattggatatttttgtctactttaaacgtactatcttccttgtgaccagcggcacgaatttatcaagggtaggagtgttgtttgtagccatgaaacacttcatcctctatgaagtatattgctccataggaaaaacttgtcatcattgtcatcattattaatgtagataacataatgagtgtttactatgtgccaggcactgtgctaatatgataatacatattatcatatttaatcttcagaacagacttatgagacatataccgttattatcctcactttacagatgagaaaactacaaattacagacgttgaatacattcccagaaatccagtcatgtaggcagtaacttgtgaagctggaaaatttgaatccaggcagtttgactctagaatctttgcccttaatgactgtcctatactgcctactttgtatgtggtctatagagatttactggtgtgtaaagtatttggatctctgccactttttttggacacaggaggtgaaatggaaatgataatgggggttacatgtcttcctgctgatgttaggagaagcagcatggtgtaatggaaatagctttgggcctagaataaaaagatcagagtttgacctctgtatctgtatctagagtgagattatttaaaagcaatctaaaagcaaatgctgttgaaggttttatgattttatgtaatcacaatatgtaaacatttcaacttatataactactataatttgtgacagatgatttgttttgaaggaagatttgccttatgattatttaattactcagttactgcattaattttaagtccaccaaacttttcaggagcatgtctattgtgaaacaaccgggtatgtgtgtatggtaacacactttacttaacatgcttaatttagttttgttctttttttgtactaatttgcctacctatcatatccaattttattcacaaactatatagatatatatctttagtcttatgcatatatctatatatgtatctgtcccatggcagtgtaagagtttgtattttttcatgtgtttttatttaccttttgatgtctatacatgtaagacatgagactctttacatccctgaaagcttggttaagatggtgtctgctaggtttattcactataaagtcactattttttcttttgtaattacaaagtgagactatgcagggcaatattgtgagacaatgtaaatatcctgtttctcatcatatatttgcccactaattttagcatatgttgatgattctggcttgaataaattattgttgtgacatttgccagacattgatttcaattttcaacatttttacatttattaattgattgaattatactgtaataaaaaactttctctttacgcttaatgtatatatttattcagctgtttatagcagtatggacttaatgaatatttgttttattctataggttataatgaattatgctcttactactttttgtttttgctgaaacccagatttggccaacaggagccccttcaaattggctcctgtgtcctttcaacatgtctccatcattttttaagcaccctcttactttctggcaccacagatgttccagactcttttttttttctttttttttttgagatggagtcttgctctgtcacccaggctagagtgcagtggcgcgatgatctcggctcactgcaagctctgcctcccgggttcacaccattctcctgcctcagcctcccaagtagctgggactacaggtgccagccaccatgccgggctaattttttgcatttttagtagagacggggtttcaccatgttagccaggatggtctcgaactcctgacctcgtgatccacccgccttggcctcccaaagtgctgggattacaggcgtgagccaccgcacctggcctccagactcattttttaatttccttgccccaactctggaatcagaatcttttctccaaggagctctgattctttttattggagaatggtatgtagaagccaagatctgggtgcttggcatgcttattgctactgaggtgtcattgcctctaggccctctcagcaggcagaactaggaaatatatgtatatatgcacacatacctgtttctatatcgatttcttgaagtccctctttatatatgtcaaaatcatggattcataatgatacatctgattccagtccaagaccctagaataaatatacatgatctcattctcttctggtatttctcttcacacgttttgtggactttgtagaggtcttatacagagtcttcaagaggttggcctctgaagtcagacatggaatctgactggtagatgtgtaactttcagcaaaatagtaatctttgagacttaatttcctcattggcaaaaggaaggccgtagcacctatctcacatatttttttttttaggatgaaatgagaaaagttatgtaaaacatatagtatttgacaccatagtaaatgttaaatcaattttagatttcattattgtcattatatttattgacttaccatttcttactacatcaactctcaaatctcctgtctgattttcaaggcctatcatgatcttttcccttatccaaccttatttttcattacagtttataatatactccctccagtctagcctaggtaagctttcctacaatcccgtgagcactgcatacacattttggccctccatcttgattagaattttgtggattcaagtctttgctcaattccagcaaatgtttacatttattcagcagatatttattcagcaacttctaagtactcaaaaattctatttatgctgttctatttctattcatggaggtgtactgcctacaaaatcattttgtgctagacactatggctaaaaccaaataaagacaaggttcttcccttcatggtgtttacatactggtgagaatagctaaatagtcctgtgaaactttcccttattatagtatcaaatactgattgtacctttctttgaacatttgtaatatttagcctctcccagtttcgtatctgcatgtatttggtcttataggcattttgttttatgacattttatctgttctttttatttgattaaagtcccttttgaagcaataactatatatttgttcattcaaccaattcatatgttgattttatatggtaacaaaagtaacagctgctcaatgttggaaacttgaaaaacataaagaaaataaaaatatgtccacagttctaccagcaggccagaactgtgctggctgagcacagaataatggtgtgtgttttgattattgttgtttttactattttctttcctatatatataatatgtttttaaaaataaatttggcatagaacaatgacttgtaagagtacaatttttgaattgtaaatgatatgttaaggtttggatgtgaatcacgaaactctaagcacaattcatgtttcaattgctatggtaaagttttcatttcatgaagatactgaatttttaaaatactaaaaaacctgattaaataaacactagctaataactaaaaaaaaagttggttaaaataaaaaagtaagttgggcttattctacatatagttttatttcttactgtttgatcacttatcaagcagtttcccatgttaacattcttagttttaaaacgttattttaaaatgattacatacaacttgtatttatacacactccaatttatttacctgttcacttttgtagagtatattttaaaatgtcaagatttgttagccatcgtaagaagtgctgccatgaacatttcttattccatatttttattattttattgctacagccgccttcatggggaattagtgggttaaacgctataagtatttttcaagtctttgatacatacagtagaccctgatatttaaaaaggctatatcaacagagaaattatggtaacttttttagtggttactatgttatatcctgttaggtagctaatgttatttccacttttatatacaaggaatcagaagcccacattggttaaataacttgccaaaggtcgtgcagttgatacatgattgggccaagatttaaaccaaggctctagaacctgctcatgagattctcctcaatccctatttcatacatggtagataatagagaaaagtaaagtcatgatgaaaagttgaataattctcattgccctttctgtaaacccttctgtgactggtcacttaagatgattctgaagaaagactctccattggctcatcttttaataagtctttaccataactgcctaggccgttcatccttaagggcttaaattttaattttgtgcacaatatatcctcctacttttctcccctgggcagaaggtggagcttgccctccacaaatacctctcctactgatctcttcccagctataacagtggtataacatactcaaattcattgacattctccctcccccagaagagttttgtgcatatgcatctgaaatgagagccccttctgaccactttccccacccctctcaccagcccctgcactgtagctgtctttcaggcttacacttaaatggctgtgtctttacctagtattgtccctagctttcatctctcccttagtgatactcagaaacttcccttcattaattcttaatcttttttttccactttggggagataatatcacagcctcaattccctctttttagaaaattaaactggttagtacatacggaatgtgaggtcccccatccattttgtaccactcccaatttgtaacatactcactttaccttctcctcacatttcctcagtagccaaatgacatcattgcctgtttgccagccctatagcttgcgcaattgaaatttatttctctgcaaagtcacaaactgttatgcattgtggtttttccaggtggcatttgaatagctgaactttaagctcctgagtgatagggatctgctcttgccaaattactttccagaatggttttaccaattatactcctatcagtagtgtataagagtgcctgtgagacagacttaatttttctttcctatctactacagtgactatggaattgatgctcaattgattgccagttggttggctgatttggtcttagtctctaatgattttcttttacaaatgtaatcattccatcatctcatccccttgtgatgatagcagctacggaacagaagtaatttttgaaaatgtattctttctaattaacattataaatgaaccacccagacacttagctaaatctttattataaagatttgtttttaaatagcagtaattcttgaggattttagagaaacaccttcagtgtgatatgtgacacataggcttctttcattttaacaaaccagattctcattttatgcaacttgaacttatttacctccatagtctgtccaggtccacccacactttgtgcctttagcagcttctgctggcctttaaccaaaagggcagtctatgatggtacttgctaccctgttgaaatgggaaccttaaatcccttgcttttcattaattaaagacagtcaaaggcaaatgttataaaagaaacaggcttttgctaaatttaatttttaacttttttattttaatgaatctgttataaatgtcagatgcttactaacttgtagagaatgtaagtaccatttacaagcaagttctattctggttaatggaattgtgtttttgacagtaataaaataagacttcaagaaattctgttaaggaatttgtatcatgctataattcaatcaaataatatttttcctgtatataggagaactggctggtttgctttcaaaatttcttacagtgtatatgacattaattgagtactgaaagagatatggaactttgagaggggcagtggtattaggagtgggacatgactgatgaattatttagtatattctgtgtttacaagccctccaaaagcttgctaaaggaggactggtccttctctgtccatattctcacaatttaattgatgtagtaaaatgtttctgtatgtggaagatagtcatggtggtgtctgtttatattagataggttgtttttcttgcaagtgctaaaaaacactatctgtcttaaacaataaaaacaatttttagctcacataacaagaagtttggaggttgattatctccaaagttaattaattcagccaaataatgacactagtaagggccagagtttgttccatttttctgtactgccatactctgcctatcaacttgccctctaatattagtgcccctcatactctcaagatggctgctgcagttccaggaatcacatgcagacactgcaatgcccactagaaagagagtatgaactattcatgtgtatctctttttactagcaatggaaactttctaaggagtcccacagcaccaccctgaaaacacctcttatttatcattggttgaaatcgtgttatatgtatatgcctacaccagtacattggcaagtggtatacggacataaacgtagagttagtccagtcactcacacaaccacctctccctgccctgcgtctggccaaaacacattgctacctagaaaagttggagggtggaaaatatgtaaataaactcatgatgttttggggggaaggaagaaacagtttctatttcacaacctcatgagtttgtcctcaggatcagttgatacaaaagatttgtaagaaactggtgtatttgttaaatgtgatatattacttatctagggaaacgaatgttttgtatagttctacaaatgaaagttgttgactgttcataggcattttagagctggagggacattagtgatcttttaggtcagtagttctcaaactgtggtctgtggacccctacggttcctgaaatcctattagagaacatgaggaatattttaacagtaatattatcttagtctgtttgggctgccataacaaaatacctcaggctgggtggcatataaacaacaaattatatctcattgttctgaaagctgagaagcctaagatcaaggcagatcaaacctaagattcagtgtctggtgagggccctctttctggttcacagatgttatggtctctctgtgacctcacatggtgaaaggggaaaggcgtttttttctctggagcgtcttttacaagggcactaatctcattcatgagggcttctccccgtgacataatcatctcccaaaggccccacctcctaatgccatcaccttgaagattataattttaaaacatatgaatttttttggaggggacataaacatgtatcatagcaaatacgaagaatgtttacttttctcactatgttgacatttgcactgatggtgagtaaaattactggtgcagtgtaccacattttcttagtagttgtattcgtcatactctcaggggggagaaagccagttttacctcagagggtcctcaatgtagcattaatttatattaattgaattttgacccttgagtgtatgtctttttaatattacatatgacaaaattggaagtatacacaaagcacttatgtacgctgaagtaagatagttgtttctaggaaaagcacttgtgcaattgtttgagttacgagctgaaccagttgatttttgcatggaacgcttttttgtttgttttagatacagggtcttgctgtgttgccccagctggtcttgaactcctggcctcaagaggtcctcctgcttcagccccccaaagagctgggattacaggcatgagccaccaagcccagccaaaattcatttttacttgaaaaacaactgagacaaactgtggttatttatacttgggtatttggcgggcattttcttgaaaatgagtagaattagcctaccacttcagggaaaactactggcagtatttgtggccaatgaaaaatttgagcttttcaagtaagaatgagaattttggaaaacttgaacctgacaccaagagtgtgacagcttcccaaatcttagacttttctaatgaagctggtaattatattaatgtgtattttttatattgtacaataaattgtgttaacatttggaagctctgcataggtcagtgaactaatgttttccaaatgactaatacacagtgttacaaaatcatgcatagggaaaagatcccttcaaagggcaagatagatcgagtttaatgtaattgaataaaaaaagctagtttttttatttttattttttatttttattttattattattatactttaagttttagggtacatgtgcacaatgtgcaggttagttacatacatgtgccatgctggtgtgctgcacccattaactcatcatttagcattaggtatatctcctaatgctatccctccccactccccccacccctcaacagtccccagagtgtgatgttccccttcctgtgtccatgtgttctcattgttcaattcccacctatgagtgagaacatgcggtgtttgattttttgtctttgcgatagtttactgagaatgatgatttccaatttcatccatgtccctacaaaggacaggaactcatccttttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccagtaatgggatggctgagtcaaatggtatttctagttctagaaccctgaggaatcgccacactgtcttctacaatggttgaactagtttacagtcccaccaacagtgtaaaagtgttcgtatttctccacatcctctccagcacctgctgttttctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgccgtgcagaaactctttagtttaattagatcccatttgtcaattttggcttttgttgccattgcttttggtgttttagacatgaagtccttgccaatgcctaggttttcttctagggtttttatggttttaggtctaacatttaagtctttaatccatcttgaattaatttttgtataaggtgtaaggaagggatccagtttcagctttctacatatagccagccagttttcccagcaccatttattaaatagggaatgctttccccattgcttgtttttctcaggtttgtgaaagatcagatagttgtagatttgtggcgttatttctgagggctctgttgtgttccattgatctatatctctgttttggtaccagtaccatgctgttttggtgactgtagccttgtagtatagtttgaagtcaggtagcatgatgcctccagctttgttcttttggcttaggattgacttggcgatgctggctcttttttggttccatatgaactttaaagtagttttttccaattctgtgaagaaagtcattggtagcttgatggggatggcattgaatctataaattgccttgggcagtatggccattttcacgatattgattcttcctacccatgagcatgacatgttcttccatttgtttgtatcctcttttatttcattgagcagtggtttgtagttctccttgaagaggtccttcacatcccttgtaagttggattcccaggtattttattctctttgaagcaattgtgaatgggagttccctcatgatttggctctctgtttgtctgttattggtgcataagaatgcttatgatttttgtacattgattttgtatcctgagactttgctgaagttgcttatcagcttaaggagattttgggctgagatgatggggttttctagatatacaatcatgtcatctgcaaacatggacagtttgacttcgtcttttcgtaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcctgaagggttgttgaattttgtcaaaggccttttctgcatctattgaggtaattatgtggtttttgtcattggttctgtttgtatgctggattacatttattgatttgcgtatattgaaccagccctgcatcccagggatgaaacccacttgatcatggtggataagcttaaaaaaagctagttgataaagtttcagattctacattacaactaaccttatcttaaaaggctattagaatgcacacttttccagctatataactattggaaaccagattttcttcatatattttaagtaaagcaatgtattccaacagaagaaatgcagaagcagataggaggattcagcttttgtcaaagcaaagaaatctacaaaaaaagtaaaataatctctcttcccactatttttttttgttttggaaaatataagtaattttcataaaaattcataatatatgttaacatttaatgggtttattgccacttgaaaatgaataaataattttaaatattactcagttttaatttttatatggtatatgttgatagatgtaatccagatgatggggtcttcaatactttttaagagagtaaaaaggtcttgaaaacaagaagtttgaaaactactgctataccgaggccaactccatcttttacatgaaagtgattaatgaaagatgataactagttatttagttgcagaggcagagatggaagctgtattttctgaatcttattctcgtcctctctccagtatactacattggtttagggattggtaaattgataatatgatgtggtaattttgttcatcgtggtagatacagttaaaataccaaacagaaaatgtagatactagattgtactcgtcttgcctaccattttcaatccaattgccaagtcagaaacattcttgctacacaaaccacagcagaagagacacacacaaaaaatagctaaagttgcagttacttttaggtactaaattggaaaattcatgaaaccagagttcttatcttacatatctttgtattcaccacagtgcatggactggtttcttctatatagttatctctcaggaaatagttgttgaatgaatgttgaatttggggaaggagtagatttatccggataacactaagaggcaaaacttagaatcaatgggttaagttacaggaaccctggatagcaataattttcttttttcttttcttttctgttttttgtttgttggtttgttttgtttttgttttgttttttgttttgaaggaatcttgctcttgtcgcccaggctggagtgcaatggcatgatctcagctcactgcaacctccccctcccaagttcaagtgattctcctgcctcagcctcctgagtagctgggattacaggcgcccgccaccacacccagctaattttttatttttagtagaggcagtgtttcaccacgttggccaggctggtctcaaactcctgacctcaggtgatccaccctcctcggcctcccaaagtgctgggattacagtcgtgagccaccatgcccagccagcaataattttctaacagttaattatttgctacttagtaatggaaatgtctcattagtaataggaatgttcctttactaaaaatgctcaaatagaaggtggatgctgctctgtctgccaacatacccatgaggtccctttggactctaagattctgttttttctggtaattagaaggaaaatactttcttactgagctcaagtctacttctatgattttatcgagacaaggtctcctgctgcctaggctggtctcaaactcctggactcaagggatcctccaacctcagcctcccaaagtgctgagattacaggtgtgagccaccacgcctggcctacttctatgattttaaagcaaattttaggtataattgacatacaataaaatgcatatatttgaagtgtacaatttgagttgtgacatatgtatacacctgcgaaaccatcacaacattcaagataatgaacatgtaaattgctccaaaagatttttattcctctttgtaatccctcccttcctacccccatcctccatccccaaataaccactgatctgctttctgtacagtagaaagtttcattttctagatttttatataaatgcaattatatgatatgtatacattctttgctctgacttatttcacttagcataattattttgagattcatccatgtcatggtgtgtgtccatagtttattattttattgcacagtagaattccattgtattgatacaccacactgttgatggacatttgggttgttttttgtttgtggctattaaagttgctatgggcattttcttgcactttaaaagtactaaattgagctataatttccataaagtgatacacagtgatcttaggtgaacagctcaattattacttaactcaattataacttaacaaagtgtataccaatcatatatactttggtaactaccaaccaagtgaagatgtagaacgtttccattaccttggaaaggtccctcatgcccgtcccatttcaatgtcttttgtgtcttgtctgaataagccacaaggttgtgaagatacatgttttcttccataatctgtatagcttcagattttgtatttatgtccatttttcttatatagatacccagttgttccagtattgtgtatttaaaagaaaaattcctttttttttcattgaattaccttgaggactttattgaaaatcaatggaatgtgtatatgcaggtgtaggttgaaactcactagtctgttctattcacctgtttgtgcatccttatgccagtatcacactgtattgattactgtggcattactttggtagcataagtcctttacatttcttcttattcaggattgtgttagcttttgtgttggctatttattccatataaattttacattaatcttgccaaattttgcttaaaaaccttttgaggttttgataggaattgtaacaattgtgtagatcaatttaggaacaactgaaatcttaaaattattatttttttcaatccatgaacaccatatacctctccattaatttaggtattctttaattagcttcatcatagaggtcatgcacatcatttgttaaatttcttcctatatgaataattctattctaaatggtatcatttttaaaattttatttttagttacttgttgctaagatgtagagatgtgattcatttatatattgatctgtttatccaaagataaaatgctaattaattttcttatggtatgatttacatactgtaaaattcacccactttatgcacagttctattatttttgacagatgtatacagtaatataaatatagtctctaatcaagatatagaacagcatttctaaatttattcattagttctagtagtcgtgtccatttctttggattttgtatgtatacaatcatatcatctgaaaataaagagggtcatagtttttcctttccattacctatgtctttttgtcctggctatcttattgcactggctaggacctccagtacaaatataatggaagtagtaaagaatgactttttttttgctgtcttttaaggaagatactcaatattttgctattatatcagctgtaggttttccataaactttacagatcgaggtggtcctttttcatttctatttgctgaaaatcttttttaaagtaatgaatgttaaatttcatcaaaaaataatttgtatctctttaaacaatcatattgtcaggagctcagccgagctgctaggtgtcagacaccaagccaaaatcaaaataatagtcaagcctttaatcacttagtgtgattatataaacaagaagctaaaccggagaaagtgctgaggactgtcctcacttcccagttacatttttccccatggtagattggaccagcacaggcttcgggggtctgtgttttctcactgacaagggagccccaaacaaaaggctctggcagtgttagggacccaggggtttgggggaggaagaaggaaaaggctaggtgtggaaaaatacctagtactgagtcagagtggaaagaagtgtcttcaacgtttgctcccacttcctctgctgtgaatatttgtaaacaagtctttgggtagacaaatgctttcattttccttggataaatatcaaggaatggaattgctgggttgtagcattagtctatttttagctttacaagaaactgccaaattgttttcctaagtggttgtaccattgtactttccactgaagtatgaaagttgtagttgttcctcgtcagaactgtgcataaaatgggtgaattttacagtatgttaatcataccgtaagaaaaataattagcattttatctttggataaacagatcaatatataaatgaatcacatctctacatcttagcaagtaattaaaaataaaatttttacctgcatttgatattgtcactctttttaattttagtcattttgatatcttagtattggtatgttcttgtcattttcttatagtcaccttttgtttatattgagtaaaattcgctatctttggtgtactgctctatgagttttgataaaagcatacaacctttaactactgccgtaatcaagactcagaatacttccataacctcaaaatgtttcctcatattgctatgtaattaacctctctacttacccacagtttctggcaatcactcatctattttctgttcctataattttaccttttttataaatgtcttatagattgactcatccagtatgtaaaattttgagtctagctttttcctcttagcataatacatttgagatccatccatgttatatgcatcagtagtccatttcttttttatttgttttcttataattgagtaggaagagctttttgtgcattctgcatataatatattcatttcatacatacatgccatgcggatatgctctgccatttggtggcttgcgtttttgttttcttacctataattttcagagaataaaagttgaattttgatatagtccattttatcacctttttatggttatagctttctgtcccctttataagaaatctttgacttccccaaggtcaccaagattttctttcatatttgcttctaaatgattttatagtttttgcttttgatccatttacttatttttgtgtggtgtttggtaagagttctggttcagtttttatcccatgtgtttagttccagcaccatttgttgaacagactatcccttccccattaaattaccttgatacttttgttttgtaggtctgttttgtattctagtctgtttcaccaatctctatgtctatccttatgccaataccacaatgtcttcactactgtacttttatgataaggtctgaaatcaggtaatgtaagttctccaaatttgttcttttcatattttggggtctcctcttcgcccccgcctccttctttgaatttctatataaattttacagttaccttggcaatttgtacaagtaaaactcctggagttttgaatgggattgtatttaatctataggtcatttttgggaaaaatgatgtcttaacagtattcagtgttctgataagtgaacatggtgtatctttccgtttattaagatcatctttggccgggtgcggtggctcacgcctgtaatccgagcactttgagaggccgaggcgggtggatcacgaggtcaggagatagagaccatcctggctaacacggtgaaaccccacctctactaaaaatacaaaaaattagttgggcgtggtggcgggcgcctgtagtcccagctactggggaggctgaggcaggagaatggcgtgaacccgggaggcggagcttgcagtgagcccagatcgcgccactgcactccagcctgggtgacagcgagactccgtctcaaaaaaaaaaaaaaatcatctttaatttctctcagcaatgttttcagtgtgcaggtcttatatgtactttattgaactcatcccctaagtattcatgtatttgaattgtactataaatggtatcgtgttttattttctttcaattgtttgttgttggtatatagaaatacaactgatttttttttctattgacctgtacactgtggtcttgctaaattgattatttttagtagctctttcatggattatttataattaactacatacatgattatgtcttctgtgaattaagatagatttgcttctttctttctagtcttcacactcctttttttccccttattgtactaattagggcctgtaggataacgtttaatgtaagtattaagaccccagttctttgctgccttttcccaatgtttgaaaacatatgcttcacacattttgtacagtttcctagttgtttgtagcaagagggcaagtctagtagcaatcattccaacaaaatctgctttcagttttttgatatttataaataacaatgatgtgaacatttttgaacgtatttgcacttcagattatttcctttgaacagagttctaaaactatatattgtaatctatatacatatatctgtatctatctctctgcctgcatatttaaacctacagtataagagctacctcaagagcagtgactatatttcaaatttatataccttgcatcatctagcagacagcctttcattggattaatggaaagtaaaatctttatgattaattttctcatacccagagtatctatttaactatagcatagagatatttctaatcttgcctgtgaagtctaaaaagactgtgatcattaccatagttttaatttactattactttattttgcttcattttaactgtcttatttctctttgataatgttgtaggaaacaagaaatatgtaggtcttaactttggccactgttaaaaattttttttaaaaaaatataatttggtttattttgagaaagggaagacatttttcctaactttcctacattttgtgttaactttgtaggatgttgtttgagcaatgaccctgtaggacgtggccttacacattttgagttcatttgagttaatttagtttcaggaaggcttctgaaataggaagcatttattcaagctttagtattccttctgaatagttttgctagctagctataaacaggccaatttgccctagctctaagtttatgttaattttcattactttgtttcaaaataaaagggccaattcccgttacattttgatttaaaaaattaagctatacatttttcttagatgtgggtatgttaaagcttttcaatgtctggcaaaattaatcaccctaggccgtggatttccttgcccccaactccctccaccccctaaagatacttgataatatgttggaaggagagaaataatagcttttttcttccagttcttatggtcaggtgagttcctagggtttttgtttgtttgtttgttttgagacagagtttcgctcttgttgcccaggctggagtgaaatggtgcggtcttggcacactgcaacctctgcctcccggattcaagcaattctcctgcctcagcctcctgagtagatgggattacagatgcctgccaccacgcctggcaaatttttttttttttttttttttttttttttttagtagagatgcgatttcaccatgttggccaggctggtctcgaactcctgacctcaagtaatccgcctgcctcggcctcccaaagtgctgggattataggagtgagccaccacgtttggctgagttcctagggtttaaatgttttaaaatatttttattcatagtatactcaagttataggaatttggttaatagtgaataaattcattcttagcaccagcctctctcaattctatttgcttgcttatcttttacagcctatttagacatatcatttttctccacagttgcagtaaagacttctttctgttatagcgcaagcttattagaccttatcacagccttcatgccttcatttgtgtatactatataatgggaaaaaaaagactaatgttgtaaattaacaagtgagatcaaactgaaaaaggtcacctttcttagaggctgaaaaagagattcattttctggggcctggatttgtttttctgactaattttactgccacttttgaatttgcagattgacaacctttatactaaaaatatttatctgtatcctagtagatttccaaatccatattctcagttttctctactccatgatatgcagatatggaaaaggaggcattttttttcccctcagatggttaatgttataatttgaaattggtaatatgctaataaacaaaggtaggttcaaaatcagatctttctgatttccatgaggcattgtaaatattatattacttaggatttgttttaaaatcaggttccaatttaagttggaaaaaactgaaaatgtttagaggtaacagtgattaaattatttcagattattatatttttcttagttttccctacatgtctacttcttcatctgttgttttactttatggtacttaaacattctataaagttttttgtttttttttgagttggagtttcgctcttgtcatccaggctggatggcatgatctcggctcactggaacctcacctcccgggttcaagccgttctcctgcctcagcctcccaagtagctgggattacaggcatgcgccactacccccggctaattttttgtatctttagtagagacaggttttcaccatgttggctaggctggtctcgaactcctgaactcaggtgatccgcctgccttggcctccaaaagtgctgggattacaggagtgggccaccacacccagcctctataaagatttgtagtgcgtttaaacattaatagaatgaaaaagtattataaaaggcaagaatatagacataggttctcattaaatcacaattaatggaaatgtatactcatagcaaaattaattatgctctttttgggtagaatattctggagcctaaagtttcatctccttttcataccactgtccttaaaaatgcaacattagcttaaacatgaatttgtttatattaacataaaacttctctataataaatgtttattcaaaattgaaggaggaaaaaagatttagagtaagatacatactaatattaaatactagtgctgagattatgagtcattttttcttatatgtattttctgttacctacagagaaatagtaatagtaaatgcctattactattacaataaaatgattttaaaatatttaatattagtttaacatatatttcaacagttttttgatttaaataatttaacaacatattttacagtcatagggttattttattttatttttgtttgtttcttttttcagacaggatctcactctatcacccaggctggagtgcagtggtatgatcatggctcactgcagccttaaccttcagggctgaatcaatccttccacttcagcctcctatgtagctgggattacaagtgcacgaccccatgccccgctaatttttgcagagacagggtctcactatgtttcccaggctggtctctactactgggcttaagtgatccactggccttggcctcccaaagtgctgggattacaggcctgagccattgcgtcccttcctatcctccctctcttgtaataaatgttttaggtagtttttaaagttttcttttacttggctttcttaaaggagaacttcagttgcttttttccagtaaaaaattccagagactgccagaagaagcctaatgccagtaataattctgtcattgaacataatggagaggagtcatcttaatttgtatgcactcttttttatatcaagtgtaacacatattcttcttgtccttccctccaagtgggttacaaacagcttttctctttcactttaccaacattaaaaagagtgattttaagaatgctggatccacctttttccacttatatttggaatgaaatgtgtaatttatgtatgaaacctttaattttaatttaaggtctcgtgaaagcaccaaaactctttagataaattgacacggagttgctttaagatacaaattccttcttagtaaaaaaaaggaagaattttaaaactttatgttttaattgtttctagttgaattcagaatattaaagctttgttatatatgtggtaactctctaataaatacttcaagaaagtatctcagtatttaattaattatgagtactataatttattctaaagccttaataaaatcaaatttctattagtttatgcttttctcaatgttcattgaaaatattgagtcatattacctattactgccccaatccccagcccagcttgtaactttcctgaggaggaaaattgagtaaacctcagtgattatttgacagttgactccatagctaagctggaagacagggtgttgtgggagggagataacgcttttagggttttactgaagaaaggatgtagattttctgattctgttttgaagatgatataggtggatgctgctgggagaaatgacagtggcatcccattaggcctgtcgtgcccatccccttttaggattctgcatatctcttagtttttcctttgtcaggtaacaaaggtgtaacatgggagatatattccacttctccacattgttagcttagtgtagtactctatccagcaaattattggaaagagcaggatttggaagttagactagattttattgcttgggtagagagagaatgctcaagagagcttatcctggacaccagaggatgagcaattggaaagatggactgctttatcatttttgtgttattttgcaatagatagggcagattcccctctttttattgcagtacaaaatccctttaatagctagctctaacgttactatggcactatagtgtaatggtttagtttagagtatgggcatggatgtcagactcgacttgtatcgagactcttccacctaccaattgggctaacattattagtctaaagtgtcttaatgcctggcgtagagtaagtgttcaataaataattttccacaggatctatagtgtcctcttccaatataatttagttcaatcttaagcctaatagtttgttttccttcctgatcccctttcttcatctctagcattttaccataggagggaaagatgtcttagaaacacttttttagtttatttctagaggtattggctagacttcatgtcagttatatgcatataccaatattttatatattaaaaacaaatataatccctagaatagcattgtctgattagagataaaatggtctcaaaagaggacaggaaaatagggaagtgggagtagtagtaaagagaaatgtaaaccaatgtgtaaacaagaaagcaggtttatctgcaactatagggaagaactgttcaaattaccttgcacatttttatttcttaggaggcttcttaagattttaaattaagttattaaactatttattgggttgaattaaatatttagataaatgcagtatatagatatgtctgtctgtatgcatatatgttaaatacacctaagtttcttatactttaactaattttgggattccttctcacccaaaagaaatttaaataaatactttggatatttctgtaaatacagcatgccatttagcaaatttaagggaacaagtgaataacttagctatgccaacaatgttttgcctccgcattccttggcgcaaacagggacctcagtgaagcgttcctcatgggagttgcctggggaaatcttactgaagaagtctaggtcccaattcaggctcctttcccttctactttctaaaatatcaactttattgaggtatagtttacatacaataaaatgtactagttttaagtgtacaatttaatgattgacaaatgtgcacacccacaacattttcaatattgagcagtttcatcaccccaaaaagttccgtttgtttttcttcccagtaaatctttccctatccctgtaccctgaaagccactgacctgctgtcactatgaatatttgtgtacaagtcattttgtacacataattttcatttctcttgggtgagtgcaaaggaatagaattgctgggctgcataaatatgtaatgtattgaaccttacaagaaacaaatatgtttgcaaaataataggaatattttacattctcaccagcagtttataagacttttttaattatagctatcctggtgggtatgaagtggtatcttgttgttttaatttgctttttctgatgttgagcatattttcatgtggttattggccattcaaatatcttcttttgtgatgcatattctcaaatctttgcccatttttttcaaaagttggattacttgccttcttataattgtaagagttctttatttgtcatgtttacataaatatacacacacgtatattatacacacacctagtatttttcccattctgtgggtcgtattttctttttcttaatggtatattttaattagcagaattcaaaaattttatgaagcgcagcttatcatttttttctttgatctttattgccctttgcattataaggaagaatcctttaactattaatacactaaagttttaaattttgcctgctttcttctagatatttggtgcttttaacttttgataaacttagtgttattttggtgtgcagtgtgagttaagggtcctggtttaatttttaaaaaaattatcaaggtgaaatttacataacataaaattagtcatttaaaagtgaacaatttagtgacatttcgtatattcatcatgttatgtgaccacttctacctagtactaaaaatttggtttctctcactccaccttgtccctggaaaccatcaatctgcattctgtctctgtggatttacctattctggatatttcatataaatgaaataatacattatgtgacattttgtgtttgacttatttcacttagtattttcaaagttcaacttcattgtacatcatccctttttatggctgaataattttgcattgtatggatataccacattttgcttattcgttcatccattgttggacatctgggctattaccactttttatctattgtgatgagtgctgctatgaacatgtatatatatatgtatttgtttgagtacttgtttttaatatttaagggtgtatccttaggtgtggtattatgggccatatggtaattctatatttacgttttaaggaaccaccagactattttccttggcggtttaaacattttacttcgccaccagcaaggtatcagcatttcaagttctccacaatcttatcaacacttgttatttttgttttgtttattttaagttttaattttttaattatggccatcctagtttgttatggagtggttcttcattgtggttttgatttgcattttccgaatgcctgatgatactaagcatttttcaagtgcttgttggcaatttgtatatcttctttggagaaatatctattcaagtcctttgaccatcagtatttttttttttagacttaaggtcttgctctgttgcccaggctggagtgcagtggtgtaatcatgcctcactgcagcctttaactcctgggctcaagtgatcttcccatctcagcctcctgagtagctgggcctgcaggcaggtggcaccacatggccaaggtggctttttttttttcttttagaaatggggtcttgctatgttgcccaggttggtctttcttgcctctgcctcccaagcagctgggattccagccctattttcaagttgggccgtttatctttttgttgttgaattgtaagagttatttatacattctgaatactagacaaatacataatttgcaagtattttctcctattctgtaggttgtttttttcacttttgtgataatgtgctttaatgcagaaacattttaaaatttcatgaaatccaatttgttttttttcctttcttgcttatgcttttggcgtcatatctaagaatccattgccaaatccaaagccatgaagagttatctctatgttttattatacaagttgtgtggttttagctcttatgtttaggttgttgattcattttgaaatagtttttgtaaatggcatagaggtccaactttattcttttaaatgtggatatacagttgtcccagctgttattttctcattgactagtctaggcacccttatcaaaaatcaatttaccattgatgtatgggcttatttctagactctccgttctatctcaatggctatgtttatctttatgccagtaccacactgttttgcttactgcagctatgtagtaaggtttgaaatcagaaagtgtgtgtcttccagctttcttttactttttccagattgttttggttcttagggccccttgcaattccatatgaatttgaagattgactttactattactctttctgcataaaaggctgttcaatagggatttcattgaatctgtagattgctttgggtagtattgccatcttaataatattaagtcttccaatccaggaacacaagatgccattcattcatttaggttttctttaatttctttcctcattgttttctagttttctgtgtacatgttttttacctccttggccaaatttattcctaggtgtgttttattcttttggatgttattgtaaatggaattattttcttaatttcctttgtagattgttcatttgggctctatagaaataaaactaattttgtgttttgattttgtaccctagaactttgctgaatttattagctttagtagtttatttgtggattctttaaggctttctgtatacaggttgagtatctcttatctgaaatgcctaggaccaaaagtgtttcagattttggagtttttcaggttttggaatgtttgcatatacataatgagatatcttggggatgggacccaggtttcaatatgaaattcgtttatgttttatatacatcttatacacatagcctcaaggtaattttatactatattttaaataattttatgcatgaaccaaagtttagactgcgtttttactgtgacccatcacatgaaatcaggtgtggaatttcccacttgtggcatcttgttggcggcactcataatgacttgaattttggagcattttggattttggattttcaggttaggaatgctcaacctgtatgaaaaaaatatatctgcaaagagagatagctttgtttcttcctttccaatttggttgtcttttatgtctttttctagcctaattacttagctaaaacttccagtactatgttgaatggaattggtgaaaccaagcatccttagtttgttcctgatcttataggaaaacagtttttcacctttgagcattcagttagatgtgggtttttcgtaagtgtttttttttttttttatcatgctgagactgctcctttacattcctggatttgagtgtatttattaggaaagggtgttggattttgtcagatttttttttttatcattgagatgatccaaatgttttttcctattggttctattaatgtggcatattgcatcagtgggttttcttgtattgaaccacattgcattcctgggataattctcatttggtcatggtttataattcttttagcatgctgttggatgtggtttgctagcatctgttgagggttttttttttgcctctatttttacagggactattaatctataattttattttctttagcatctttggctttcatatcagaataaaactatatttatagaatgagttaggtagtgctattctgctttttggaagagtgcgagagtaattggtgttgttttctttaaatttttggtagaattcactagtgaagctatctagctatggactttacttcgttgttaggtttttgattattgagtcaatgtctttacttgttatgaatcttttcagattttctattttttcttgagttagtttaggtaatttgtatgtttctagaaatttgcccatttcatctaggttgcctaatttactggtgtatgatttttcatagtattttctctctctctctcttttttttttttttttttgaaacgggatcttgctctgtcacctaggctagtctcaaactcctgagctcaaaggatcctccttcctcagtctcccgagtagctgggactacaggcacctgtcactgtgcctggctaattttttaatttttattttttgcagagatggggtcttgctttgttgcccaggctggtctcaaactcctgggctcaagtgatcctcctgcctcggtcttccaaagtgctgggattacagggatgagtcatcatgcctggctcatagtattttcttataattctttttatatctgtaaggttagtagtaatgtcttcattttcattttttatttcagttatttgtatcttctccctttattttttagtttagctaaagatttgtcaattttcttggtcttttcagagcactaacctttgttattttattttattttcaagttttctttttgctttaaagctataatagtaaacaacataatttgcacatatattcaggctcattttcaaattttattttcatttcaaagggcacatgtgcaggtttgttacatgggtaaattgtgtgtaactgaggtttgatgtatgaatgatcccattacccaggctacctcctctagtagtccccagtgtttattgcccctctctttgtgtctgtgtgtactcattgtttagctcccacttataagtgagaacacgtggtatccggttttctcttcctgcattatttcacttaggataatggcctccagctgcatccatattgctgcaaaagactcgatttcactcatttttatggctgtgtagtgttccatggtgtatatgtaccacatattctctatccaattcaccatcgatgggaatctaggttgattccatgtctttgctattgtgaatggtactgcagtgaacaaagacatatatgaaagtgcatgtttttggtataatgatttcttttttggggggtatatacccagtaatgggattgctgggccaagtggtagtcatgttttaagttctttgagaaatctccaaactgcttttcacagtggctgaactaacatacatttacaccaacggtgtacaagcattcccttttctctgcagtctcaccagcatctgttttttgttttgttttgctttttaataatagccattctgactggtctaagatggtatatcattgtggttttgatttgtatttctctaatgattagtgatgttgagcattttttcatatatttgttgcttgcatgtatgacatcttttgagaagtgtctgttcatgtcctttgcccatttttaaatggagttatttgtcttttgcttgttgaattaagttatttgtagattctggatactatacttttgttagatgcatagtctgttaatattttctcccattttgtaggttgtttgtttactgtgttgatagtttcttttgctgtgcagaagctctttagtttaatgaggtcccacttgtcaatttttgtttttgttgccattgcgtttggggatttagtcataaattatttcccaaggctaatgtccaggatggtggttcctaggttttcttctaggattcttatagtttgatgtgctacatttaagtctttaatccatcttgagttaattttcatatatggtgagaggtagggattgagtttcatttttcttcatatggctagtcagttatcacagcaccatttattgaatagagagtcattttcccattacttgttattgctgagtttgtcgaagatcagatggctgtaggtgaaaggctttatttctgggttctttaccctgttccattaatctatgtgtctgtttttgtaccagtaccatgctgttttggttgctgtatccttgtagtgtagtttgaagtcaggtaacgtgaggcctccagctttgttcttttggcttaggattgctttggctatttgggctcttttttggttccatatgaatgtataaatagtctttttctaattctgtgaaaaatgacattgatagtttgataggaatagttttgaatctgtagattgttttgggcagtatggccattttaacgatattgattcttctcatctgtaagcctggaatgtttttccatttgtttctatcatctatgatttacttctgcaatgttttgtagttcttcttgtagagatatttcacctccttggttaggtatattcctacatattttttggtgactattgataatgagattgctttcttgatttggctctcagcttgaaccttaccagtatatagaagtggcaatcatttttgtaccatgattttgtaacctgaaactttactgaactcgtttgtcagctctaggagccttttggtggagtcaatagggttttctaagtaaagaatcatagcatcagtgaagggagataatttgacttcttttacaatttggatgccttttatttgtttgtgctgcctgattgctctgcctaggacttcagtactatgtcgaaaaggagtggtgagaatgggcatttttatcttgctctggttcttaagtagaatactttcagcttttgcccttgcggtatgaacttggatgggggttaaagaaccaacttttggtttcattgattgtctcgattgtttttatattttctatattgcttatctccactctaatctttcataatttcctttcttttgctagctttgggtttagtttgctcttccttttctagtttcagaaggtataaatataggtcatttatttgagctctttctcatcttttaatgtaagcatcgactactataaattttcctcgttacaatttccttcactacatcccataatttttagtatgttgtatttttattttcattcttctcttaagtattttctaattagttttgtaatttcttctttgacctattggttgtttaagggctacattatttaatttgtacatatttgtgaaatttccagctttcttctttttattgatttgtagtttaattccattgtgattggagattacattttgtatgacttcagtttttgatattttttcagacttattttgtggccgtacatatgttgtgtcttagagaatgttacatatgcacttgggaggaatgtgtattttactgttgtgtattctatatatgtctagaaataggcttatgatgttgttcaagacttctgtttccttattggtcttctgtgtagatgttcaatccattattgaaaattgattttcgaagtatccaacaatcattatagaactgtctatttcttttttaaattctgtcaagatttgcttcctatatttagaggctcagttacttggtgtgtatatgtttataattgttatatgttgacgaatttacacttttcaataaataatattgttgtcttttgtaacaggggtgacttaaagcctaatttgttggatattattataatcagccaccccagctctcttttggtcattattttcctgggatatctttttttctttcttgaaatttcagcccatttgcatctttgaatctaaggtgaacctcttgttgaaagaatcccttcagaatgctaatttcatttcctttgggaatatacctagtagtgggattgccagatcttatggtaataacacttttagttttttgaggaaccgccatactgttttccaaaatggctgtactaatttgcagtaccaccaacagtatataagggctcccttttctccacatcctcgctaacattcatcttttagctttttgataacagccagtctaacaggtgtggggtgttattgtggttttgatttgcatttctctggtgattaaagatgttggacatttttttgtgtatctgttgaccatttgtatgtcttcttttgctaaatgtctattcaagtctttagaacatacattcctcacatgtttgtggtgatgctggtttaaaccaattgcagtgctagtcatataaaagtatagtacatacaattatttatagtatgtaatataataagtcactatgttactggtttatgtgtttaccatactacactcttaccattattttgttatcactacttcataagtagaaggagtgtattccttcttctcataacacaaaaaagttaactgtaaaatagcctcagtcaggtacttcagaaggtatttgagaggaaagtattgttatcataggaggtgacagctccatgcatgttattgcccccaaagaccttccagtgggacaagatgtggaggtagaagacagtgatattgatgattctgaccctgtgtacgcctagactaatacgtgtgcttgtgtcttagtttttaacaaaaagttttaaaagttaaacaataaatacagtattttaacaatagaaaaaaggttatagaataaggatataaagttttatatatatatatatatgtatatatatatatatatatatttttttttttttgagatgaagtcttgctctccagtagcccaggctggagtgcagtggtgcaatctcggttcactgcaacctctgcctcccaagttcaagcgattctcctgcctcagcctcccaagtagctgggatcacaggcacctgccatcacgcctgggtaatttttgtatttttagtagagatgggattttaccatgttggccaggctggtctcaaactcctgacctcaagtgatctgcctgcctctgcctcccaaagtgctgggattacaggtgtgagccactgtgcgctgccaataaaatatttttgtacagctgtacaatatatctgtgttttcagctaagtgttattacaaaagtatcagaaagctaaaacaattctaaaaagtttataaagacagtcaaagtaagctaaggttaatttattattgaaggaagaaattttttatgaatttaatgtagcctaagtgtacagggtttacagagtctatagtaatatgcagcaatatcctagttcttcatgttcacatactacccactcaactggttcaaccagaacaacttcaagccttgcaatgtccattcatggtaagtgccctatacaggtgtaccatttttaatcttttatatcatttttaaaatcttttatatcatattttatatttcatatcatattttactgtaccttttctatatttagatatttctagatacatacttaccattgtgttacagttgcctacaatatttagtacagtaacatgctgtacagatttatagcctagaagcaatagattatactatgtagcgtaggaatatagtagactataccatttaggtttgtgcaggtacactctatgatgtttgcacaatgatgaaattgcctaacaatgcatttctcagaacatatccccattattaagtgatgcatgactgtaattgtttcctttgctttgtagatttttagtttgatgcaataccatttgtttatttttccttttattgcttgtgcttttggggtcatatacaagaaattgctgcccagaacaatgtcatggagctttccccctatgttttattctagtaattttatagtttcagatcttacatttaatccatttggggttgatttttctataagggatgagataagagttcattttctttcttctttatgtggatatccagttttctcaacgtcatttattaaagagactgtcctttctccaatttgtgtttttggtgcctttgtcaaaaatcaactgactgtagatgtatgggtttatttctgggctctctatcttattccattggttgatatgtctgtttttattccagtaccatgttgttttgattactgtagctttgttatatatattgacatctggtagtgtgacacctcctgctttgctccttttggtcaagatcgttttgactatttggggtcttttgtggttttatattaattttattattgttttttgtatttctgtgaagaatagcattttaattttgatagggatggcattgaatctgtggatcgctttgagtctttgtatacatgtttatggtatatttagttttttaggcctttaagaacttattttagcaatgttttatacatttcagtgtacctgttttattatttcttgtagtagtagtagtattagtagtagtattcgtagctttttgtagatttttcaagatttttaatatgcacaattatggtgtctttgaaaagagacagtcttacttctccctttcttccctatatgcttgttatttgttttccgtgccttgttaaactagctaggacctccaatataatattcaaaagaagcagtgagagcaaagcagtgagatcagacatcctcaacttgcttctattattagtgggaaggcattcagtctgttaccattaaatgtgatattatctcagtggttctcaatgagtgggggatcttcacccaccagaggacagttggcaatgtctggagacattctttgttgtcacaactgggggctgttattggttttttaatgagtagaagctcaccagagcccctcttccaggcctagagccccttcatgttttactaactctggcaccaaaactcaattgatcgcaaaaactgatgggaacgtatatgaaactacttatagtcttgatccaaccttaggatattcataagttttactgctaaatattaatttgttcaattacaaaatgttatgtaacttgtacagtatataaacctctctaaattctgattttcaaacagtatatagacataaggatttcaggatttcatttaagggtctatagagatgctgccaaacatcctacaattcacaggacacccactcacccagactctgcaacaagaaatcatctagcccaaaacgtccatagtgttgctgtggagaaactatgtactacctgtaggttttaagggatatcctttaccagattgaagaagctatctcttagtctgctaagagttttcatcagaaatggctatgaaatttatgtcagatggtttttcttctaattgtatacgcctttatactcatgtattctatgaatataaaaaataccttgatttatttattttaaatttttaattaaaaaagtttttgattttaatttttatgggtacatagtaggtatatttatgggatatgtgagatgttttgatacagacacacaatgcgtaataatgacatcatgtaaaatggggtatccgtcccctcaagcatttattctttgtgttacaaacaatccagttatactctcttagttattttatatgtacaattaaattattattgactatagtcatcctgttgtggtatcaaatactaggcattttctaactgttcttttttttttttttttttttttttacctattaaccatccccacctcctccctaccacaacctcactacccttcccagcctctggtaaccatccttctactctctatctccatgagttcaattgttttgatttttaggtccccaaaataagtgagaacatgcagtttgtctttctgtgcctgacttatttcacttaacataatgacttctagttccatccaccttgttgcaaatgacaagatctcattccttttatggctgaatagtactccattgtgtatatataccacattttctttatctattcatctgttgatggacacatggttgcttccaaatcttggctcttgtgaatagcgctacaaccaacatgggagtgaagatatctctttgatctacttatttcctttattttgtatattgcattagttggggttctcttagagggacagaacgaataggacaggaagcatacagcatgggagaaagatgtaggctgggaggctaggcccatctctcattttcatgtttttctgcctgctttatattcgctggcagctaattagattgtgcccaccagattaagggtggatctgccttccccagcccactgactcaaatgttaatctcttttggtgacaccctcagagacacgcctaggagcaatgctttgtatccttcagtcgaatcaagttgacaactcagttttaaccatcacaagtccaccccttgtcaacttgaacccatacacatctcctgggatcatacataatcttcaaataaagacaataataaggtcataattacgcctaacataatacagctatccttcatacaaccagaaacacaacaatccccaacccaaatactattacataaagttaacatacttaaatgctgatatgaagtcaataaatcgtacatcacatgataaaggagaaaggaaataaaatgaagatattagtacaagtgtgtacatgcacaaacatgtttttaacaaaagaaagaggaaaggccgggcgcggtggctcatgcctgtaatcccagcactttgggaggccgaggtgggtggatcacctgaggtcgggagttcgagaccagcctggccaacgtggagaaaaaccctgtctctactaaaaatataaaaatgagccgggtgtggtggtgcatgcctgtaaccccagctatttggaaagctgaggcaggagaatggcttgaacctgggaggcagaggttgcagtgagctgagatcgcgccactgcactccagcctgggcaacagagagagactttgtctcaaaaaaaaaaaaaaaaaaaagaagaaggagaaatactcatgacaattagtccccatttctgtagctggtcacatggttgtagctaatattgatgattaccttgttctactacctattctgtattccctttgccttcagcaagcagcttagcaggtcgtggttttttttcctggtggagtgacccaaaccttccttcctgaagggtctgggccatttgtagtcctatctggattgcattgttgtagtttcccattgaccttaatcacagagatggtaataccctaatggatctcctgtattccatgcatactctttcttacctccgttatggagtagtacactgaattcatcttgatagtatgggtcagtcaccccagccaacactgtaactcccttcttagcttgttgacttaaaggtaggaggggcccaaagtgtccaggtggcaatcttgacttacggtttaatggaattgttgttgtgtctcctggtggcagctttcctccctctggaactaagacctctaggccagtagaacgtaatgttgtgggaacaggaagcaaaaattttgctagtggatcactaggggtgatggtgagtgctgccacttccacttccaccccttgattcctggacctgtgaatcctggctatggagaaagagtaccatatattggatgctgattcagatcacacacagccttctggagaactttgcctcagctctgcaatgtattgtcacctagttggcattgtatttgtgacttcaaaaggccattccaccgttctatcaatccagctgcttcaggatgatggggaacatggaaagaccagtgaattccatgaccatgagcccactgccacactgctttagccaaaaagttagtgccttggtcaggggcaatgctgtgtggaataccatgatggtggataaggcatttcgtgagtccaaggatcgtagtcttggcagaagcattgcgtgcaggataggaaaacccatatctggagtaagtgtctgtttccagtgaggacaaacctctgccttttccatatggaagaggtccaatataatcaacctgccaccaggtagctggctggtcaccccgaggaatggtgccatatcgagtgctcatttttggtctctgctgctggcaaattgggcactcagcagaggctgtagccaggtcagcattgatgagtgcaagcccatgttgctgagcccatgcataacctccacccctgccaccatggccagggcccattggtgatgacaggggtggctggggaaagagactgagtggtgtccacagaatgggtcattctatccatttgattattaaaatcctcctctgttgaggtcacctgttggtgagcaatcacatgggatacaaatatcctcacagtttttgaccactcagagaggtccatccacatacctctttcccaaatttctttgtcaccaatttcccagtcatgctttttccaagtccctgaccatccagccaaagcattggctacagcccgtgaatcagtatacaatcgcacatctggccatttctccttccatgcaaagtgcacatccagatgcactgctcaaagttctgcccacttggaagatttcccttcactggtgtccttcagggatgtcctagaaagggaccgtagtgttgcagctgtccactttcgggtggtgcctgcatatcgtgcagaacgatctgtgagccaggccctggtcttctcttcctctgtcaactgatcataggaaactccccatgacaccatcattgcatgctggggaagagaagacagggtggcaggagtgaagaccatggtcatttgacccacttcctcacgtaacttacttgtaccttcaggacctgctcgagcccaatcacgtatataccacttccatttgatgatggattgctgctgtgcatgaccactttatggctagatgggtcagaaaagcacccagtttatgacaggcagtttaagttgcacagtggcttgatgacccatagtcaaatgttcagtttccgccaaagcccagtaacaggccaagagctgtctctcaaaaggagagtagttttttgcagaggatggcagggtcttggtccaaaatcctagaggcctctgccgttactcacctatgggggcctgccaaagggtccaaacagcatccctatctgccactgatagctcaagcacaattggatctgctggatcatatggcccaagtggtagagcagcttgcagggcagcctggacctgttgcagagccttctcgtgttccggaccccactcaaaactggcagcctttcgggtcactcgataaatgggcctgagtaactcacccaaatgaggaatgtgttggctccaaaatccaaataggcccactaggcgttgtgcctctttcttgattgtaggaggggccaaatgcagcaacttatccttcaccttggaaggaatatcttgacaggtcccacactactggacccctagaaattttactgaggtagaagttcctggaattttagtcggatttatttcctatcctctggcatgcaaatgtctcaccaataagtccaatgtgtttgctgtttcttgctcactgatccaatcagcataatgtcatcaacataatggaccaatgcaatatcttgcagaagtgaaaagcaatcaaggtctctctgaataagattatgacacaaagccagagagttgatatacccctgaggtaggacagtaaagctatattgctggctttgccagctgaaggcaaattgcttcgggtgggcctcatgcacaggaatggagaaaaaggcatttgccaagtcaatggctgcatactaggtaccaggagatgtgttaatttgctcaagcaatgaaacacacctggtacagcagatgcaattggagtaaccacttggttaagcttaccataatccactgtcattctccaagatccgtctgtcttctgcacaggccaaatgggagacttgaaaggggatgtggtaggaatcaccacccctgcatatttcaagtccttgatcttggcactaatctctgcaatctctccacggatacgatattgttgttgacttactatttttctaggtagaggctgctctaatggcttccatttggccttttccaccatagtagccctcaccttaccagtcagggatccaacgtgggggttctgccagctgccaagtatgtctatgccaattatgcattccagaactggggaaatgaccacaggatgagtctggggaccctctggaaccacagtaagttggacctgagctaaaactccattaattacctgactttcataagcccctactttaactggaggaccacaatgacattttgggtcccctggaatcaacatcagctcagagccagtgtccagtagtccccgaaatatctgaccatttccctctccccaatgcatagttaccatggtaaaaggtcagaggtctccttggggaaggatgggaaaaagattcactgcataaattgttggtaatgtagtggggtgcttcctcaaggggacccagcctccccttcattcaaggggttctgagtctgtaaactggctcaagtctggaaattgatggaggggttgcgattctctgtttttataattcaaattaggcttttgtctattcaacctagaagttttctctgtataatttaagtaggaatgaagtaggcttcctatcagtttcgcttctaggaacactgtgattgattagccaatgccagaactctacatgagtcagactatgctgattgctgcttcgcttttgctgtccattacggtaggtacacccaccttgcctttggcggttgagtaccaccacttggccgctgccacctcaggatccaattattcccatcgaatttaaattttgtagttgagtgactgcagttcccaccattagatctgacatacagagatgagcaattacagggctctttgaagatgcatgttctgccctcacaaatctatttcacaaggcattggtcaagggtatatcttctggaccctcccagctgggatgagtaggtctaaaatgactaatccactccaccatcccaatctccctaagcctttagatcccttcctctacataaaaccaagggagatcaggcatttccatcttgctcacagtgggccatcttttaatccatatttcagctaaccaagcatataaactgttagaaccatttttaactccccgagctgaaacactgaatgcagagtccctaagcagtgggcccaaatcaacaaattcagcctgatccaactctgtgttccttccaccattatcccatacccttaatatccattctcatgcctgttctccagattgctgttcttatataaatcacagaactaaaacagttcttttctagtgtagtgcacctcctcatgggtcacactctcaaactcacctctagtggccgctgggactttaatctaattataggtctagaagcaaatggaggtgttgggggtagcttctgaagagaatcaacattatcttgcctggcaattgcctcaggggaggccatcactgttgcttcaggcagtgtttatctccttagacaaaggtggaaaggctgatggcagcatgggtcagggaggggatgttgccactactggggatggggaagctattccttctggcaaaaaaggttcatcagagtttacaaactcagtgtccccagctttatcagggtctccccacacatccccattccaagttgcagggtcccattattttccaatcaatgccctcactttaacagtagccacctggagaggctgtgcatgcatctttcattgcaggccagtcactcacataagagcttgtgtatgtttttccacaattttagctctttctctacaagggcgaagactctcactcaggacaatcttagcagatttgaggctcagtatctccttctgaagccaggaggcagaatccctgagttccttattttctttcatcactttgtcctctgaacttaggagcaaccaactggcttcattatgttccttggttctccacataaggtcaaatgtattatgcatagagtcactaaattctttgccactcatgagtggtgaatcaagagtgtcaaatgcatttattttgcataattctctaaatagttcatgccaaagactatcattgttctccatactatttgaagtagagtccttagcattttggggtctaatcatattaagcagccaactccagaaacctccaaaagaactccatccttaatattctgttcctctagaaccactcctcgtaccagaatctgtattagtcaggattctcttaaagggacagaactaataggatatgtgtgtgtgtgtgtgtgtatgtgtgtgtgtgtgtgtgtgtgtgtatgtaaaggggagtttattacgtattaacgtacatgatcacaaggtcccacaatatgctgtctgcaacctgaggagcgaggagaaccagtctgaatcccaaaactgaagaatttggagtctgattttcaagggcaggaagcatccaggataggagaaaggtgtagactgggaagctaggccaatctctccttttcaggtttttctgcctgctttatattcgctggcagctgattagattgtgcccaccagattaagggtggatctaccactgactcaaatgttaatctcttttggcaataccctcacagacacacccaggatcaatgctttgtatccttcaatccaatcaagttgacactcagtattaaccatcaaagatgtctacctaggagtggaattgctagattatatggttgctctatcttgttttttgaggatcctccaaactgttttccatagtggttgtactaatttacattcccactgacaatgtacaagtgttcccttttctccacatcctttccagaatttgttattgcctgtcttcttgataaaagccattaactggggtaaggtgatatattattgtaggtttcatttgcatttctctgatgaacaatgtttagcactttttcatatatctgtttgccatttgtatgtcttcttttgggaaatgtctatttagatcttttgcctattttttattcagattattagactttatcttgttcagctgtttgagctccttatatattctggttattaatctcttgtcagatgggtaatttgcagttatttctttcagtctttgggttttctattcactttgctgatagtttttttgttttttgctgtgcagaagctttttaatttcaatatgtcaattgcattttcaactctagaatttctgcttgattcttttaaattatttcaatctctatgttaaatttatctgatagaattatgaattccttctctgtgtttgaattttttgagattcctcatcacatctattttgaattctctgtctgaatggtcacatatctccatttttctgggattggtctctggtgctttatttagtttggtgatgttttcctggatagtcatggtgcttgtagatgttcatctgtgtctgggcattgaatagttaggtagttattgttcacagtttgggcttgtttgtacctgtacttcttgggaaggctttccaggtattcaaaagcacctggctgttgtgatttaagccgtatctgcattagggaacatcccaagcccaatagtgctgtggttcttgcagactcgcagaggtaccaccttggcggtgttgcataagatccagaagaattctctggattaccaggcagagattcttgttctcttcccttatttgctcacaaacaaagggaatctctctgtggtgagccacctggggctggagatgtgttgacacaagcacccctgtggccaccacccctgggattgtgctgggtcagacctgaagctaggacagcactgtgtctcatccaaggctcaatgcaacgacttcttggctaccacctatgtttgtgcaaggccctagggctctatagttagcaggtggcgaatccaggcttgtgtccttcccttcagggcagcgggttcccccaggccccaagcaagtccagagatactgtcagggagctagggactggaattaaaaatctttgcactctacctggtgtgttctattttactctagcagatttgaccctcaatccatgaggcatagtctttcccactcttctctgcccttatcacaggcagaggagcctcacctcatggtcaccaccaccacaggcccacggggactactgccaggctaccatctatgttcacttaaggcccaagagctcttcattcaacttgtggtgaatgctgccaggcctgggcctcatgtttcagggcagtgggctccccattgtcccagggcaggtcccaaaatgctgtgcaaaagccaaggcctggaattgaggaccccaagagccctcttgttgttgtaccccactgtggcagagttggtacctaaagtgcaagccgaagtcccctttacttttccctctccttttcttaagcagaaggagactttcccaatagccaccacagctgggaatatattgagtcttacctgaagctagtgtatctcagtcttacccaaggcccatggtgtactacctgggtagctgggtattgctactggttatttagggctactggttatttagtctgcaggtgatggatcctgccaggacttggcccttctcttcaaaacagccagttcctttctggcctggggtgtgtctggaaatgtcacctggggattaggacatgtaatggagtcctcatgactctgactggagccctatcctactgtgtctgagctagtaccccagacacaggcaaaactcctctttactcttccctctcgtctcctcaagtggaaggaagggatctgtggtggacgagtgatctttgcagcctggggttgagggagcggtgacacaagcattcccttagctgcaccaactggtgtctcagtaagtcgtgtgcctccccacccccaaatccactgtctccaagcccagctcagcactgggacttgcagactttgtggcctagattttctttcaagtttatttaatgtcccagagcaatttagcctgcagtggtgagccttgctggaactcaagttctagtcacagggatgggtgatttcctctgactagggctggtttgaatgctcccactgtaggcgggtgtcagctgtgttcagccttgttttgctttctgctgtgacagggcagcattgaattcaatgcaacatctcactatcactgcagcctccttctcctaagcacatgtattctctctcagtccacatggctgctgccaatgggtggggaaggggtggtgtcagtgattcaagactcttttctaccctctccagtgcctccttcagtgatatgaagttaaaatcaggtactgtgagtgctcacctaatttttaggttttttttatgaagatggttttttgtgtagataattgttaaatttggtgttcagggcggggatgatcaatgcggccttttattctactatcttgctccacccccaattgattaagtttcaatttatttatttattcaaatagatttttgcggaacaggtggtgtttggttatatgaataagttctttagtggtaatttctgagattttggtgcacccatcacccgagcagtgtacactgtactcaatgtgcagtcttttatcccttacacccctcccaccctttcccatgagtccccaaagtccattgtatcattcttatgcctttgcgtcctcatagcttagctcccacttatgagtgagagcatacaatgtttgattttccattcctgagttacttcacttagaataatggtctccaactccatccaggttgctgccaaagccattatttcattcctttttatgactgagtagtattccatgctatttatataccatattttctttatccacccattgattcattgattgatgggtatttgggctggtttccatatttttgcaattgtgaattgtgctgctgtaaacacaagtgtgcaaggttttgttttgttttttctgtttgtttttgcttgtttgtttgtttgttttttgtataatgacttcttttcctctgggtagataaccagtagtgggattgctggaaagaatggtagatctacttttagttctttaagaaatctccacagtgttttccatagtggttgtaccagtttacattccccccagtagtgtagaagtgttcccttttcagctgggtgtggtggctcacgcctgtaatcccagcactttgggaggctgaggcaggtgatcaccggaggtcaggagttggagaccagcctgaccaacatggagaaaccccatctctactaaaaatacaaaattagctgggcgtggtggtgcatgcctgtaatcccaactactcaggaggctgaggcaagagaatcacttgaacccgggagatggaggttgcggtgagccgagattgtgccgttccacttcaacctgggcaataaaagcgaaactctgtctcaaaaaaaaaaaaaaaaagaagaaaagaagaagtgttcccttttcagcacattcacaccaacatctattatttttttatttttttttaattatggccattcttggggagtgagatggtatcacatggtggttttgatttacatttccctgatcattagtgatgtttatcattttttcatatgtttgttggccatttgccaactgatatgttttcaaaggcaaaataattaaatgagattgtttattccacttaaacgaattcaaaaataatgacttacaaagtagtaatataattccaccgcccatgtgtccaaaatgttgatttatttatgccagaatgttgtttctctgaccaaatattgtcttttggagctggaggatctccaaaagggaaagctcttatagctaatcaagaagtttcagtggggaaacttataataccatgaactaagcatcagcctgattagctactgattttgtgactgaaataaaatggtacctttcgttcttaccctgccccaaggtgttttttagacaggggaaattaggtgtaataatttcctctgaaaggtgagttatgctacttttgattatttttctttttacttctttgtattttttcctcttacatttatttttgattaggtaacacattcatgtggttcagaatttgaaatttacaatagagtgtacaattaaaggtctcacattctttgtgcccacccccacagttcttcccagaggcaaccagtgtttttacttttataaatattttatgcatacacaagcacaggcacttgcaaacatgtgcacacattcttccccccagttgtttttacacatttttctgtactatgctttagagcatttcatatcagtgcataaggagctatggctacatggtattatttgtttgtatagagatgacataatttatttaacaagtcccctattgagggatgtttaatttgttgcctgtcttttgctattgcatttctgcagtaagtaatcttgtaatacatcatttcagatgtgtgctatctgtagggtgaatttctagaaatggagctgttgggttggatagtatggacccttgtcattttggtagatattgccagaatgtcctctatagaagttgtgcccaatttacactcctaccagcaatgtataactgtgttttcctaaccctcaccaacacattgtattatcaaacattatatctttatgaatatgatatgtaaaaaatactatgtttttaatatgcatttctgttctgaataaggttgagcaccttttcatatatttaagatcctgtgatatttataaaaataatttccttttttataatggctggaatgctgcaggattgataggcacaatgtcttttctccttaacttatacctgcaggtatattcttttacacagcagtatgagagtgattccaaagagcatatttaggttaaataaataatccaggaacactttgtgttttaaaatttcggtagcattttataattcactcattatacaactaacatattatagttgacaaacaaatgaaccaacatcccctagtaactttaaatgatttaaattactcaagaaatttaactcagtggttttgttacttcttaatatacaccatactttataattttttcatattccaagaaaaatagaattatcctttatttaggaagttaccagtgtgttagaatttgcacggagttatcttaaattatggtctgtttacatttgcaatatgtatttgaaattttcttccttaatacctaagccacattgcaggaaggtgagaagttcagtgtatatttaaatgtgttgactgattcataaatggccccggactcttttgcatcacacaacaaatttttgtcagatctttgtctatggcactgtagatcacctctattatagcagctatcaaagtctgtcatgtattgtcattatttatttatgtgtctgcttttgtcactagattatgaacttctagaggatacaatttgtattcccctctagcactggtctggagctttgcatatatttcagacttataaaatgtttgttgaactgaattgaatcacatttatatagaggttctgaggttgccttttaaaaaacgtttttccacgtattgtttgcttttttaaatgtaaagtcttattttaataccgcccaagtttgctttctgctaatattattgaatttgtattgagaataattattcaaaatactcctgtaataatatcagtgaagaggcagatttttattgtgcatatttcctagctgttcatagttttaaccatcagagtcctgctttaattttagcctcaggcaattctaaatatttagtgagcaaagtgggaatattagacactttagtgcgggatgttatttgtttcatctcactaagattcccaatttatataggccatttgaaatgtgcaattaaagttctggtcattgctaatattaaggaatttagaaggttctatagcagagtaaacagctttacaaatgatagtggtgttttttaatttaaatttttattgagatatttgtggattcatatgtagctctaagaaataatatagagagatcccttatacactttatgcatttctccccagtggtaacatcttgcagaacagttgcctactatcataaccaggatactaatagtaatataatctgccactctatattcagatttcaccagttttacttgtgttcatgtgtatgtgtgttctgtacaattttattacctatatatgttcatgtttccaccaccacagttaaaatactaaacagttccaacatcgcatatattcagaagtatgctatctgtagggtgaatttctacaaatggagctgttgggttggatgtttgtacctttgtcattttgatagatattgccagaatgtcctctatcgaagttctatcagatttacactcctaccagcaatgtataactgtgtttgttttcctaaccctcaccaacacattgcgttatcaaacattgcccttttataaccaccccctgacccctatcatcctaaatcattgcagccactaatctgttctccacttctaaattttgtcatttaaaaatgttatttatttagaataatgtagtataaccttttatgattagccttttttatcattatcaagtattatgtactttgcataattgtatgtgctatactttttaatgagtatttttatgtaaatatttaaaaatttatcttattttaggtttgggggtacatgtgaaggtttgttacacaggtaaacacgtgtcatgggggtttgttttacatattattacatcacccatgaattaagcttagtacccaatagttatcttttctgctcctcttcatccttccaccctctgttctcaagtagaccccagtgtctgttgattccttcttggtgttcgtaagttcttataatttagctcccacttataagtgagaacatacagtatttggttttctgttcctgcattagtttgctaaggatgatagcttccagctccatctgtgttctcacaaaagacatgatcttgttctttattatggctgcataatattacatggtatatatgtaccacattttctttatccagtctgtcacggatggggatttaggttgatttcatgtctttgctattgtgaacagtgctgcagtgaacattcatgtgtgcacatgtctttatggtagaatactcatgaaagtgtcttggagctatttggacaaggaattttaggatcttgggtactcaaattatgatatggaaggggaaacacaggctttcagtggttctttcccttttgccccacagactcttcctctctgaaactgacagcagctgaggaatggctagagtggggtctgctacattggagagcatctcttgtccatgtcaaagtgtgacgcttcatttattaattgtttgctatgatttaactactaaatgctattttaatttttttggcttgaaaataagtcttaagatgtcatcaagcttgatgccagcaaatatggcagagtagggaaccctcaaaatttatctttttttacaattgcactaaataaactggcaaatactctcagaatcaactttactggcattatggaaactaatcaaaagtttacagcaaccagacaaatgcttaataataaaaaaagttgaatctcagtaggagagatttgtggcattttagcttacccttgtcccaccccctgctctctagcttggcagtggctctgaagacaacagtctacatttcactgtactagtccactgagtacaggttcttagtacctgagggagtagaagtaaccttattcttaaataagtgtgtttgttggttttgatctgtgttgtggatctgagggaccagttcagaaggcttgcctttattttgcctaactcagaacttttccaaggttgaggcagctatgggggtggaggagagatttgtgaaaacatttacaggcaaatgtattagctgctacttcctaggggtagggataaaggttggtcaaacagtaaactagctaaaaagcttgggaaaaaagtctgggaaatgagatgctttggagaattagagctttgaaaagcttcaacatattcctggtaatttcgaaggccatgtgcccccaaggctatgtggatgctcagaaaagacctgagaacgccctaagctttcacctctggcttatcttcagggtctcaactagcaggaatttaaggctaatgcagaatagtaaacttcctggctgagtgttgaaggtgtgcacatctgcaaagactgggaatttattgttgttgttgttccaggcgttttaggaaatttctgtttcaaatcactagatgctcactacgataatgaaacagatttcagtggccacacaacaaagaatacagactttacaaaattagtttagaaaaagtcactaaacaaacaaacaactactataataagcatcaataacaaaccctggagagggaagagaatctgattttcagatttgctgcatcataatattcaaaatgtcctatcttcataaaaatatgaaccatgcaaattaaaaagaaagtattacacataggaaagaagaaattactataattccccaaagaatcccctggctgtagtatgggagagtcattaatctgctatttagctaattgaacaagtaaaatggacaaatcgaatattgagcactactagaggatccccatttactagtaaaacatgcttttatagagatggatagctgttccaaaaatgtctggccatttttattgcattataaccttaagttaaattttagttttcattttatcttgtgatatatgatatatggaagctaactcatttcctatgagcaaatgaattgatgagttttgctcaactgcagaaaatcattgagtcttttataggattttttggtctctgactttagataaaatggtatgtatgaactctttcccaaatagtacctggatctgctatgtttctctttctaccaagcagatagcctaattctcaatgcctggctgtctcacttgtgtcttgtgctggatatttttatttgctgaatattatgttaagtacagttgactatcattttcatctttataaggaaatcattgtatagctatattaaaaaatgagtagtttttatactgttttaactatagacccttagtggttataaagacttagcaaagggccaaagagtttttaaaatgatatatttataagcaagtatagagaggaattcaataagtgagtctggcattgtgcatctgttttagagatttcattcattagaaaatagagaacaccatggggaaagactctcaattttattaactaagtatggtccatgcatatgaagcgacttcagtagaataagttcaaaggaaaaatgaatgatgtcaaagagaaaagtaataattttacttcataagttgccaactcaggtagttgtcatttaggaaatatactgggacagcctaaaggtaagttaacttttttcttaattaagccttctttgaagaagttaagtttagtgagtaagatgcttcttttttataatggtttttatttacatatctcatgttggtgaatcatgtgttagtagaaatcataagggaatagatatgctgctatttaacttcagttctgttttttcaaaaaaataataaattaatggataatgtagcttctcacttatacaggggttacagggacctaattcttggatctacatagccatcaactgtagtaccatatttctcttgagggagctccccaaatgaatgggagagttaaccagcatttatatggcttaccttgtatctcaaatctaaaaagaaaaaaaaaaaaaaacggatgtagctaatggtatcttttaaatgttctttgacatttaatcaattttcactcttaatggttctgtatatcttattttgctcggaaagggtcaaagccatgcctgaaagaccttaaaataaaatgttaaattttgactatgctttggtaactttgtttattttgatattgcctgatgcacagaaaatgataaaaatttccataagaaaatagattgcaactatttaagtctacaatacttttccttgtttttataaattaaaatttaaatacaattttaagtctattttttgacctaaacaattgtaatactgagttctttgtgtatttcttaagaatttctttgcaggtccaaacagatctagcattattgagactgaataaaagatgcttctttcaggtggcccctaatttaattgtttgtaatgattattctagaaaaaagcaccactctgacacatggattttcttgtaggtcagcattttataaaaagtatcctaacgacaaatggatgataggaagagcaaaagaggaaaaaatatccgtaagaaaagatgtaatacaattagtacaaggggcaggaggtaacaggaatttggttcttctttctatatttttttactttgagttcctcaaatattttatatgcaagaaaatatttcaagttttaacacatatgtcataccattttcttagtttgtattccatcatgccataagcatttactttcagaaggacttttggttttataaattaaaggcctgattttttttttttcagtgcacttctaagttagataacgcagagggaggtttatgtggaaatgatcgtttttctaagtgaatgttcaaacactgagtcactcacaagttcttaaaatcctatatgttttaagatatattagaggcagattctatactgaagaaatagtgcaaattttgcgcagttaacataaaatttagcatttttcatcctcccattatcttcagccccatgattttgtgtctttggggatgaatacttagactttcacttgatgcattcaggctctgggttagaaaaagatgcttaaagactgagtcatgaatattggaaaagaatatagtgggaggaatcactctacatgatattatgacctactatatagctgtagttaattaaaacagttgcagtagtagagaaggaatagacacatagatcaatatgatagaagggagaattaagaaatagacctttacaatatgcccagctattttttgacaaaggagcaaaagcaatttaatagaggaagaataactttttttttcaacaaatgattctggaacaattgagcatccatagacaaaaatatgaaccttgacctaagcctcacaccttacaaaaaagttaactcagaatggatcatgggtttaaatataaaaagaaaacaataaaacgtttagaaaaaaataaaatcatcacctagagctagatgaagaattcttagacgtaataccaaaagcctagttcatgaaataatcaaaatttaaaaatgtttattctgtgaaagtccttgttaaacagagaatgaaaacactagctataaacggagaaaatatttgcaaaacacatatccagtagaagattattatttagaatatatatttttaaaactcccaaaactgatcagttcaataaaacccccccaaatcccattagaaaatggacaaaagatatgatcatacatttcatgtaagaggatatacatggaaggaacattattgggaaattggtgacaaagaaatttggagaagagatgtgtgaatagacctccctgaatgggcaaaaaacatgaagataattgtgtctcatcaaagggcaacctcagcagaggaggattttaatagccaagtggataggatgacccgttctatggatatcagtcagtctctttcccaaccactcctgtcagtgcccaatgggctcatgagcaaaatggccatgatggcagggatggaaattatgcatgggttcagcatcctggacttccactcaccaagaccaaactggctatagccattgctggatgtccaatctgccagtagcagagaccaacactggtagcaacaccagatgaggcaacattgcctggagtgatcagccaactctctggtgggaggttgattacatcggaccccttctaccatggaagaggcagcgttttgtctttaatggaacagacaatcgggatatggatttgccttccctgctttgcagtgcttctcccaaaactgtccatgaatggcttcattttgttttttcctctccagtttctcaggatgtagctttagattattgaattgagacatttcttctaatgtatgcatttaatgtaataaatttccctctaagaacattttagctacacaccactcatttttgacatgttatgttttcgttttcattttaatttactcaaaacagtttttttcaataattttactttgactcatatgttaatacttggaagtgtcttgtttcatttgcaaacatttgaggatcttctcaatatcattctcttttttgatttctagttcaactctattatgatcagataatgtactttgtatgattgctattttttaaatttataatttttttatgtcccagaatatgttctatcttggtgtgtgttctatatacatttgagaagaatgtgcattctggctggatggaatattctatatcaaattggttgatagtattattcatatccttactgatttcttcatattttttctgttaattactgagagagaactgatgaagtcacaaaatatagttgtgtgtttgcgtttttttccttttatttctgacaggttctgcctcatgttttgaagctctgttagttgtatacacattcaaatattatgtcatcttggataatcgatccctttattgttatgtatgtttcctctttctcttggattatatttcttattctatagtgtcaaaaattaatatcactattacaactttgttttttgatagtcgtttctttttgaaaaaagctttattgacttgtgattcaccaatttaaaatgtataaatcaatgtttattagcatattcacagagctgtacaatcatactcacagtctaaattttgagcattttaatcactccatagagaaatcccataccctttaccagtaactctcccgtaatcccccaaatcttggcaaccactaacctactctctgtttctatagatttgcctattctggacatttcgtagaaattgaattatacattacgtggtattttgtgattagtttctttcacttagcagaatgtttacaaggttcagccatgttgtaacatgaatcagtattagattcattttcatcactgaatcacattacattgtatggatataccacattttggttatcggtttataagttgatggacattcaagttgtttcctcatttggctattagaaataatgctgctatgaatatttgtgtaaaagtttttgtatagatatatgtttttttaatcttgggtatatacctagaagtagatttccacgtgatgtggtaactctatgtgtaaacatttggggacctaacatcctgttttctaaagtgactgcatcattttctattttcaccagagagcctggtggggttcctggagaaggctgttagagagtgtgagttcctctatgtttgtgggccccagaagtttcacattatcttattagcccacacctggcctttagcaattagttgaaatgtctaattgaatcttcctacctgcttgtattctgtattgcattctatattgtcattcaatattcaattttcttataagtaaggaaatgctctggacctatttctctctggaggttttgggctgattctttgctgtgatctctattatctctgataggtccaagaaaaattgttactctgaaacctgcttgacttttttcttattgcaagtttaggagtaacatctttctagctctctacatcttcaagctaaaaaatgtcatttaataatgagtttacctgttttttatatattatggataccagttctttattatatgtacatttcacaaaagttttcttccagtttgttgctggcttattctttttcttaatgattttttgatgagcaggtgttttacattttaatgaatctagtttatcattctttcttttattatttgtgctttctgctgcctaacaaatatttttctatgccaaggtcacaaagctgtttcctgttgttttttctagaaactttaaagtattttatatttaagaacatctttgatcttgaagtaattttttgaatggtgtgaattagaggttgacgtttctgttttaaaatatgggtatactgttgtttcatcaaaatttattggagagatttcctttcccagtgaacttttatgttaccattttcaaagatcatttgactttatttgtctgtgtctaattttggactctccattttgtttgtttgacctgttcattcattaataccacactgtcttggtattgtatagtgagtgttaaaataaggtagagtaaatattaaatataaatattaaaacttccttcctcttttcaatattattttggatagtttatgttctttccatttctgtataaattatataatcactttgtcaatttttacaacaatatctctgatgattttgatgggtgttgtagtgaatctatgggcaaattttgggaagattgttaactgaagaatatttcatctccagtatatgagtctagcatatatttccatttacttgataggtatatatttactttacattacatttaatatttctcagcaatgtttttatcattttcatagcataggttttgcacatctttcactaattttatctctaagtaatttatgactttggatgccattgtaaatggtattagtataaaatttttcattttataatgataactgatttactaacttcagttttataatcacttttatactgtgagtatacaaaatttacttgtttaaattttatggctttttaaagattacttagaagtttctacaattaataatcacattatcttcaaataagagatgattttgctcttcccttttcaattattttgcatttttccttatctaattgcggtggatgagctcaatggcaaatgctaaataaaagtgatgagataagatatttttgtctgtttcccaagcataaggaggaaaaacttcagtatttcactattaagtattatgcaatatgtatgtattttacatgcacatcatcagattgaagaagttccctctatttttagtttggtgacaatttttatcatgaatggatattgaattttgttcaatgatcatataattttacccctttaatttgttaatgagtaagttttatttgttgatttttattgttaagccaatcttgcattttggggattaaattctatttgagcaagatgtagtatccttttaatatgttgttgtattctatttagtaatattctattaaatatttttggatctgtgttcttgagagatatttgtgtataattacattttcttgtaattcatttatctggttttcatatcagtgtaatataggcctcctaaatgagtttgaatgtgcttcctcttccttcattttccaaaaatgcatttgtagtattggtatttttctcttaaatatttgattgaattaactaatgaagctgtcttggcctagatttttctttgtgcaacagtacaattttgtattgtgtttatttaattaacgttttatcatgggcacttttctatttcattaaatatttttcaaaaccaagatttttcagttacataatactcatttgaataaatatactgtaatatatgtaactagtcccctacataactgttactttttttctcaaacatacgtctgtgtgtatgtgtgtatttgtatacaaacatatgtatacgtttatatataatatgaagtatgcataatatagtatattgcatacatagtatacatacataataaatacatgtatgtataaaaatgtacatatgcatgcccacacacatagacccactaagagaggcagacagactgatggactctagaattagatatatcagtacattaacagagtttaactttggatgttgggagtttgggcactttttactttctttcacagttttcagtattcctattcttttcagaccaagagtgttactctataattagaaagtaaatacctgaactgttttcattcttgagaattaaaaaatggataatttcttaagctagcacaggcaggtagggaaattaccaaaatactgcgtggtaattaaaattatagcaatgttcatgtttgtgatccccaaccacccaagagcggaacattaaatgatgtcggaggaggtgcagtctttcaggctcccatgagaattgccaaatggggcacttatgctttttgggacgaggtccaggttttatttttttcttcttcaaaagtcttaaaataaatgaaaattgtcacagcaaaatgcattttccctttcatttagagcattgaaggctacgcaacgtcaggtgacactggaagaatttggcttgaatttttaaagttgcttgataggggaaagggagatgaaaattactttgaagaattatctagtcacatttggttaatgtgggcaatgatagaataaagtaaaaattttagacatgtaatccattgtgatggctccagtttttcaggacaattaagaaatagcctctattgctcaaagtctcaagaaatactggaaaaaaatgcatggatactttattgggtgcttgttaaattattaaataggtgacaacttaggggtgctggctaaactttttaacttcttgtttggccttgtacagtttataaattttagaagtaacactgagaggacagaaaatatctagaagactttttaaaggtgcatacatatatatacacacatgcatttcagaccaacgagtgagggatgagtatggcaggaggagtggggacagaggaccgaagaagaatgagaggatgttgggaggtggagagagagataagaaacaaaataattagagaaaaattaaaaggtgtatttattaggtatagggtgaaaaaatttgcctaattcctgaatttggatgatttcagagtgttcttatctggttctgtacccaaaataatttattcttagggattctgtgagggattaaatgacactagagacaaacgatgaggcaatgagaaaattatgaagaaattaaggagaagagcaatatcttcttatttgctataattcataatacatggatgtttgagaatcactattatctagtgtataaggctgacttgttcccattatttcctaatccataatgctgctccttttttaccccataatccttcccttaaaccacatgtgcatcatttctttcatctggaatggatgtcttgtgtttcaaaaatgttttaccttatcactcttattttcacttctgaactaaaggtacattgcttgtataaccccctttttgctgttttgataaggtactaaattgaataatgtacctttaggccagagagcagtatagggcaagttacttagtttgtgagagagcctaggcaaccgattgctgaacagctattatctccttgtgatttcatttcctttgctcattattaggcacactataagtattgtgatattttctttggaaaattttggtcctaatcagaaagccatctgctaacaattgtgctggaagtgaagcagcatgataaagttacctttagccatgatatagttgtgtcaatgacctttcagttacatattactattatataatttgtggggaacatttcatgtcttagtgctttttgtaatgtgggaatttggcagtttgaaaatgtatggaaagcactacagttattgactcttttttttggtcatccaagtttcattgggttcttcatgtttctttatttcccttagactatttgagaggtaggaaaccaagggagaaggaaatggactcttatggtggagcaaattgaagtatcacttctgcttttctttttttcttttaatccagatgtacagtaaacatagacaagagtatagactacagccaggttatagaacagataggtctcagtagtaggcagtatgttagctcagatatctgggtagtcaacatggttgagagtgtggtagctatcattcataggtgagttgagtgcaagagccagggtagctggtagcaggcaatatccagagatccaggtgaacattatagttctgacagtgggattggagttcatgttactatttttccacatcaggtatgctggaaggtaatagttttgttttgttttgttttgttttgttttgttttgtttttttggagatggagtttcgttcttgttgcccaggctgcagtgcaatggcgcaatctcggctcactgcaacctctgcctcccgggttcaagtgattctcctgcctcagcctcctgagtagctgggattacgggcatgcaccaccatgcccggctaattttgtatttttagtagagacggggtttttccatgttagtcaggctattctcgaactcccgacctcaggtgatctgcctgcctcggcctcccaaagtgctgggattacaggcatgagccaccgcgcccggctactggaaggtaatagttttttgtgtagtccgttgcctgaaatttaaaacattttttttcatttaaaaataaagacaggcttagaaaatcacacacacaatatatggtttaataaattattaccaagtaaatacctttgtaactaacacccaggtcaagaaataagaactatgctacccaccccaaaagctccttttgtggaccacatcctaatcccaacccagttgctccacagaaataaacattgtcttgactttctttggactttttatggttttatcacccaaattcgcgttcctaggtattactgttttattcttgttcatttagaaaactttgatatgttttttaaatatctcttaaatgtgtgggttttccctctatcccttacttttctttacaattaatatttcgaagaacctatgccatctgacttacagagcatctcaccttttggattcttctgactgcaaattcaaggtgcagtttaacatttttttctgccatttatattttctacatattggcagctggatccagtggcttgatcagacttagttttgatctctggcaagattataagtggtgtctgacagtcatatatggggaagataatgggtactcgtctttctttttgtgatagtagtagctattggtgattaatgacaatattagttaactcagtttgaaaagtagtgatattcttggccaatatcatactgaatggggaaaagttgaaagcattcctcgtaagaacttgaacaagataaggatgcccaccacattcaccacttgtcttcaacatagtacttgaagtcctagtcagagcaattaagcaagagaaagaaataaagagcatccaaattggaaaggaggaagccaaactatctctcttagtcaatgatataatcttatacctagaaaaccctaaaggctcctccaaaagccttctaggcttgataaatgaattcagtaaagtctcaggttacaaaatcaatgtatacaaatcagtagcaccactatgcaccaacaacaatgaagctgagaatcaaatcaagaactcagtcccttttacaacagctacaaaaagtaaaacacctaggaatatatttaaccaaagaggtgaaagatctctacaaggataatgacaaaacactgatgaaagaaatcatagatgacaaaaacaatggttcatggattggaagagtcaatgttgtgaaaatgaccatactgtccaaagcaatctacagattcaatgcaatacctatcaaaataccaatgtcagttttcacagaattagaaaaaacaatcccaaaattcatatggaaccaaaaaggagcctgcatagccaaagcaatcctaaaccaaaagaacaaatctggaggcatcacactacctgacttcaaattatactataaggctacagtaatccaaacagtatggactggtacaaaagtaggcacataacaaattgaaaagaatagagaactgagaaataaagccaaatacaaccaaccgatcttctatgaagcagacaaaaatatacaatggagaaggactccctattcaatatatggtgctgggaaaattggatatctgcatgtagaagaatgaaactggatccttaagtctcaccatatacaaaaattaactcaagatagattaaagacttaaatttaagacctgaaactatacaattttagaagaaaacataggaaaaactcttctggacattgacctaggcaaataatttatgactcagaccccaaaagcaaatgtaacaaaaacaaaaataaataaatgggacctatttaaattacaagcttctgcataggaaaaaaataatcaacagagtgaacagacaacctacagaatgggagaaaatatttgtaaactatgcatctgataaaagactaatagccacaatctacaaggaactgaaacaaatcagcaagaaaaaatcaaataatcccatcaaaatgtgggcaaatgacatgaatagacatttctgtcttcaaaagaaggcatgcaaatggccaagaaacatggaatcatgctcaatatcactaatcatcaatgtaaatgcaaattaaaaccacaatgaagtgccaccttaccccagctagaatagccagtattaaaaagtcaaagaacaatacatgttggcatggatgtagtgaaaagggaacacttctacactgctggtgagaatataaattagtacaacctctatggaaaacagtagggagatttctcaaagaactcaaagtagacctaccattcaatccagcaatcccactactgggtatctgtctaaaggaaaataagttattgtatgaaaaagacatgtgcatgcatatgtttattgcagcacaattcaaagatatggaaccaacctaagtgcccatcaaccaaggagtagataaagaaaatgtggtatatatgcatcatggaatgctactcaaccacaaaaaaggaatggaataatgtcttttgcagcaacttggatgaaactggaggccattattttaagtgatgtaattcaggaatggaaaataaaatactgtatattcccacttgtaagtgggagttaagctatgggtacagaaaagcatacagagttgtataatggactttggacactcagaagtgaggagtcggtgagggataaaaaaaaaaaactacatactcagtacagtgtacattatttgggtgttggagtacactaaaatcccagactttgccactatacaattcatccatgtaaccaaaaaccacttgtacccctaaagctattgaaataaaaaaaaaactcaaagaaaagtagtgatattctaatgtaattttttttcatgtgttagttggtgttatggactgaattgtgtccctcaaaattcatatgttgaatctcaaaccccaaggtaactgtatatggagtaagaaagtaattaaggttaaatgaggtcataaaggtggaactctaatcaatattagtgtccttataaaaagagacaccagagagttcactcactccctgccatgtaaagacgcagcaggaaagcaggcatctgcaagccaggaagagacccctcaccagaaatcacaccttgccagaaccttgatctcacagccttgagaagagtgaaagaaataattttctgttgtttaagccactcagtctacaatattttgttttggtaggctgagttgactaatacagttggaatacttttaaaaagagatagtttcccccatccattatttggttatcaagtgatactgtttatattgaagagactataaatgtttgaggctttctctgtatgtacttaccagttttcaagaaaatgaactggttccccatcatcctcttaaagtgagtaattcttttctctttacaatatcattatgaactcttgaacttaaacatatttgatgggtttcaatccatttcaaatattgttgtcactgaagcacatattgtgtcatagttgactaatgggagtgtccacaagttggctcctgagtcctttaacaagactctagtctttaaaagctttcttattacctagtatgacacaatgtttctggttcattttatacattccttgcctcaaatttagaatcaggcattctacatatgtcacttgtttctattaattcataatggtatctcaataccacagtcttggtggaaaagatacttattgttacttctttgataattgttttttttcccactagccttttattctatcatctatctatctatctatctatctatctatctatctatctatctatctacctacctgtctataagacagtgttctccaacatttttggcaccagggacaggttttgtggaagacaatttttccacatactcaggggatgaggtggatgattccaggatgaaactgttccacctcagatcatcatgcattggattctcataaggagagtgcaacttagattcctcccatgtgcagttcacaatagggttcacattgcactcctatgagaatctaatgtcaatgatgatctgacaggagacagagttcaggtggtaatatttgctcgcccaccactcacctcctgctgtgtggcctggttcctaatggtacgatttggttccatagactggtacctgtccatggcccgggggttggggactcctaagagataggtctgactctgtgcctaggctacactgcactggggcagtcatggctgactgcagccttgatctcctgggctcaagcaatcctcctgcctcagcctcctgagtagctgggattacaggtgcaagccaccacacctggtggtcattgtttatacatcttttcagtggagagagctaagaaatataaaaataaattcacatacaccctcccaagactgaaccaggaagaaatggattccctgaacaaaccaataacaagctccaaagttgaatcagtaataaatagcctaccaacaaaaaaaagcccaggaccaggtggattcacagccgaattctaccagatgtacaaagaagggatgacactgttcctactgaaactattccaaaaatttgaggaggagggactccttcccaactcattctatgaggccagcattatcctgataccaaaacctggcagaaacacaacaacaacaacaaaaaaaaaaaaaagaaaaaaaaaaaaagaaaacttcaggccaatgtccctgaacatcagtgcaaaaatcctcaacaatatagttgcacacaaaatctagcagcacaacaaaaagctaatccactgcaatcaagtaggcttcatccctgggatgcaaggttggttcaacatacacaaatcaagaaatgtgattcatcatgtaaacacaactaaagacaagtccacatgatgatctcaatagataatgcagaaaaggctttttataaaactcaacattccggccgggcatggtggctcacgcctgtagtctcagcactttgggaggcagaggtgggtggatcacaaggtcaggagatcaagaccatcctggctaacatggtgaaaccctgtctctactgaaaatacaaaacattagctgggcatggcagcatgcacctgtagtcccagctgctggggaggctgaggcaggagaatggcgtgaacctgggaggtagagcttgcagtgagcctagatcacaccactgcattccagcctgggcgacagagcgagactccatctcaaaataaacaaataaccaaaaactcaacattccttcatgttgaaaactttcaataaactaggtattgaaggaacatgcctcaaaataataagagctctctgtgacaaacccacagccaacctcatactgaatgggcaaaatctggaagcattctccttgaaaaccagcacaaggcaaggatgctctctctcgccacttctattcaacatagtactggaagtcctggccagagcagtcaggcaagagaaagaaataaagggcatccaaacaggaagagaggaagtcaaactattcctgtttgtagacgatatgattctatatctagaaaaccccagagtcttggcccagaagctccttcagctgataaacaactttggcaaagtttccagatacaaaatcaatgcagaaaatcactaccattcccatacaccaacaacagccacaccaagagccgaatcaggaaggcagtctcattcacaattgccacaaaaaggatgaaatacctgctaatacagctaaccagggaggagaaatatctctacaatgataattacaaaacacttctcaaagcagtcagagaagacacaaacaaatggaaaaacattccatgctcatggataggaaaaatcaatatcattaaaacggccacactgcccaatgcaatttacagattcagtgctattcctatcagactaccagtgacattcttcgcagaactagaaaaaactagttttaaattcatgtaggaccaaaaaaaaaaaaaaaaaaaaaaaagacaagaaagagcctgcatagccaaggtaatcctaagcaaaaagaacaaagctggaggcatcacatcacccaacttcaaactacactacagggctacagtaaccaaaacagcatggtactggtataaaaaacaggcacatagaccaatggaacataatagcccataaataaggcttcactctgcaaccatctgattttagacaaatatgacaaaagcaagcaatggggaaaagactttatattcaataaatggtgctgggataaccagctagccataagcagaagattgaaattggaccccttccttacatcacatacaaaaatcaactcaaaatgtattaaacaattaaatgtaaaactcaaaactgtaaaaaccctagaagacgatctaggcaataccaatctggacatgggcatgggcaaagatttcatgacaaagacaccaaaagcaattgcaacaaaagcaaaaattggcaatgcgatctaattaaacataagagattctgcacagcaaagagcaaaagaaactatcaacagactaaaaagacaacctacagaatgggagaaaatagcttgcagactatgcatctgacaatggtctaatatccagcatctatgttctcagttataagtgggagctaaatgatgagaacacatggacacatagagtggaacaacacacaatggggtctttcagagagtggagggtgggaagagggagaggatcaggaaaaataactaatgggtactaggcttaatatctgcgtaattaaataatttgtacaacaaacccccatggcacagttcacctatgtaagtaacctgaacttgtacccctgaactaaaaagttaaaacaaatttaaaaaacaaatttacaagagaaaaaccaacaacctcattaataagtggccaaaggacataaacagacacttttcaaagaagacaaaacatgcggccaacacacatgaaaaaatgctcaatgtcactgatcattagagaaatgcaaataaaaaccacagtgagataccatcttacaccagtcagaatggctgttttttaaaagtcaaaaataacagatgctgttgaagatgtggaggcaaaggagcacttatacactgttggtgggtctgtaaagtagttcaaccattgtggaaagcagtatggcaattcctcaaagagctaaaaacagaactaccattgcacccagcaatcccattactgggtatatacccagaggaatataaagcattctgccataaagaaacatgcacacaaatgttcattgtcacactagtcacaatagcaaagacatggaatcaacctaaatgcccatcagtgacagattacataaagaaaatgtggtacatttacaccatggaatactatgcaggcataaaaaagaatgatctcatgtattttgtgggaacagagatggagctggaggttattatccttagcaaactaatgccagaacagaataccaaatgctgcatgttcttacttgtaagtgggagctaaatgatgagaactcatgaacacagaaggaaataatagacactgtggcctatgtgagggtggaggctgggaggagggagaagagcagataaaataaatattggatactaggcttactacctgggtgatgaaataatctgtacaacaaacccccgtgacaagactttaccaatataacaagcctgcacatttaccccagcacctaaaataaaagttaaaataataataatttaaaaagtactttgtaatcttaaaaaattaacacacataaaaccttatgagtttatactgatacttgcaattcaaatgcagtgccatatatatagacttctggttaactttttttttcctgttccatcctttgtctttcccaccaagaattgtgctttttaaggccagaagggatgacagaattagaataccctgaaagtattcatttatcttatttcacaatagaaatacagcagcctcagaataacaatacgaatactaccaccatagtcggatgaatattaaataaaagcaggaaaggaattagaacagagagaaaaggggaggaaggaataatagataccattctattgaaggtttggtggctattggtagttttcctcattctcatattttgcctttgtgataccttgtctcccaaagttttatgaaacattcatgtgtttttggttttgctttagttcctctatttttactgtctatgtacttttcatacaactttttgtttattttttaaattttattttttaattgacaataattgcacatattcatggggtgcatagtgatgtttcaaaacatattatgtgtagtgatcagatttggtaactagcatatctatcatctcatacctttattatttcttcatgtggtgaatatacaatatcttccttctagctatttgaaactatatattattgttcaaaactacaaagaagtttaaagaatagtacaatgaacccttgtatacttttcacccagattcaccaatttttaatattgtgtcactacatttataaatatataattctttctttctacttaatattttaatatgagaaattttaagcataaagttgaaagagttttacagtggccactcctgtagctgctgcctggattttactgttaaattttgctatagttttatcagtgtcagtttatccattccattatctatatattaatacatattgatgcattcagaaataaattgcagaaagacattcatgatcatgcatcagaaaaattaatattgttaatatgactgtacttccccaaattgatctaagcattcagtgcagtcttccttaaagtctcagctggtttctttgcagaaatatgagaagctgacctaaaattcatatcgtatggaaatgtaagagatccggaatagtcaaaacagtcttgaaaaagaacaaagttggaagactcttccaagatttcaaaattcactagtaagttacagtaatcaagactgtttggtgctgacataaggatagacataaatcaatggagtagagttgaaagctcagaaaaaaactctcacctttatagtcaattgtttttcaacaaggatgccaagacagttggaggaaagaaaatattcttcaacaaatggtgctgggaaaactgaatatcaggtgcaaaagaataaagttggacctatattacctaccttatgccaaatttaattcaaaaaggattttttatatgcaatgtacaaaataggcaaatctatagagacagaaactagattggtggttgcctaggactgggtgggggatgtggttggaagaaaatttgaagtgactcattggtatggggtttctttttgggatgataaaaatgttctaaaattgattgtggtaatggttgcataactctgtgaatatactgaaaaccattgacctgtacggaagtcatagcccaataagctgttagagaaaaacaattgcagaaaccaatacactttctcctaaatggttcaacatttatattaataactagggttcaatattggtttatgcattttagttttgatataaaaattccataagatgaaatgcagaaatcttaagtgaacattcactgagttttgacaatacatacatctgtgtaatccattccccatcatgttatagaacattaacatcaccgttggaagttccctcctgtcatccttctagtgagttttctcctatgtaccacctaaggcatactttgatctgattgttttccagcacggaattatccacctgatttagtattttacataaaatgcataatttaataggtacttttttatgtaagactttcactcagtatgctattaatgagattaatccatattgttgcatttctttagtgactgagtcatattccattgtatgaatataccaatgaagatttatttttttttaattttttttattttttgaagttttaaagctgggcatccgggggagacatcacatgtcagtaggttccgtgatgccccacaagccgcaaaaccagcaagtttttattagggactttcaaaaggggagggagtgtacgaataggtgtgggtcacagagatcacgtacttcacaaggtaatagaatatcacaaggcaaatggaggcagagcaagatcacaggaccacaggacccgggcgaaattaaaattgctaatgaagtttcgggcaccattgtcattgataacatcttatcaggagacagggtttgagagcaaccggtctgaccaaaatttattaggcgagaatttcctcttcctaataagcctgggagcgctatgggagactggggtttatttcatccctacagtttcgaccatagaagacggccacacccaagggggccattttagagacccaccctcaggggtgcattcaccaatgaagatttattatcataatgatacttaggctcagtttagtttctgtatattgtgaataaaggtgcagtgaatatttttaagcaggctttgtgtgaacctatgttttaatttcttttggattaatagctgggagtggaattgttgagtcatagggaaggtgtatgcttagtttcatttaaaattgcctcagttcaggagaatggcgtgaacccaggaggcggagcttgcagtgagccgagatcgtgccaccgcactccagcctgggcgacagagcaagactctgtctcaaaaaaaaaaattgcctcagttttctcaaaatggttatatcattttatattcccatcaatcaagtatgacagttccagttgttctataattactccaatatttgatgtcagtcttttaaattttaaccattctagtggttttattgtagtatctcaatgtgcttttaatttgcatttccctgatgactagtgatgtcgagcccttttcatgtgcttattggacatttgtgtattttcttttgtgaggagtctgttaaaatcttgtgcctatatgtcaattgggttgtttgtatttttattgttgagctgtagtaattccttttatatcttggataccagttttttgtcagatgtatgtattgtgaatatcttctttcagtctctggcttgcttattcatattaataattgtatattttgatgagttatttatccactttttgtggtttttcctgtctttgccctgtccaaaaaatcctgcttaatctcaagtcatgttttgttttttatatgtttgtttataaaggttttttcctctgtgttcctgtaaaagttttgtaggtttttatgttttatgtttctaatccatgaccttttatgttttaatcgatgatctttctcaaataatttttgcacttagtaatgaagtagggattcaggctcatttttttccaatagggatatccagtattccagtaccatttttggaatatgttttttccctattggattgctttggcacctttgttgaaaatcaagtacactatctctattctgtttcattgatttatttgctgattcttaagatgataccacaccgtcttaattactgtacctttataataagtctggaagtcaagtttgtggccaacccacatcccaagattatgcagaagatctaataaagaaaagcaagcttttaactaaattataatcaatgccttcatctttataatatgaataatgattcacttggagcattttcagcttgtttatctgaaccattaaagtcattttaaagtcagtttaaagtcattaccatttcctgggaaaattgctctaataatttgtataatttgaagcataatccttaggaatatttagacctagcattaggtaatgtttcctggaactcttggtcaaacttgggctttcaggaccactgcactagttttgcactgctcagctccagggaaccatttacactggcatagttgctagaaaggtaaataaaagcaagaaagaagttagaacagagtggaaagaagttagaacagagtggaaagatgaggaaagagataaaagaaatatttgtggtataacgtggtaggtcgtcatgtgtctggtatcttttagatagactagtaaggttagtttcaatcacttattttaattgtatcaaaaaagtaaagcagataaaagtagagctttctggctaaagtatatgtgtataagatcaccgcagatcatccccttcacacctcctcttttatcacccacagtccctaaagctgaaatccagcatatagtaaggttgttacattgcatattgcagtttggacatttataaattatggaggcaaaaaagtggtgtgcttttttgccaaagtggaaactatgtgtttataattctttgagcttttttgacactaaagcagttgtctcatgggtatagcatctccaatcaatttcgaccattgggaatcctgtgtataagatagatttatgtaagaacattatatatattgaggttgctaacatgtgtctagttaaaaatgtaatgaataaactacaattttatatatacacttacatagttttttatttctccatttgttccagtttctttccatgttctgttaactaatagatgctcaaaaagttaattatcagcatgattgcctcaatcagaaactatgactttttcctaacttaggaagagagagaatagttgcttggataatagttttctactgttgtggttagtcctgaggcctccatcttggcaggaataatttatgctaataagaaataggttgatgataaatatcaagtataacctcatgtcaacaagaggcgaagcagcaaattgccaggttgttgctatttttattaagatcaaagctcattggttgacgatatgcatataagacatatcctggactctttctgcctgtaaagaattctgcacctccatcttccagacctgtttattaaatctctttctcacccatgcttccactgatttctgtaagatggagctaattaaaggacagttttttttttgtcatgacaagagcataaagtgacagtagattttgagtagtatataaatggaagctgctttggaaataattgctatatttgagtgacgagtattgagaaaacactactagctttaatatttgaggaagtcatatgttttctaaatattaatcactagcctgttgcatagaactggagcttttgaatttgggaaggtctgtggtggcagtggtacattttttcccaccattggtatctgattttatgtaatcagtgtttgataataaaaaacattattaagactgcatttttttttctgttggttacaaatgaaacagccagaactgtagcattccttgtttttgtgatcctactaaactatggttttcctgatttctgctcatgttggaaaataccatgggaactttcatgcagaacacttgccttactgaaaatggtagcagagcttcttctttgctgcctgtgaagtaaagatcatattagctctttctattgtgagttccagatgctttgatgatcagccagtaattgtgttagaaatgcacaggaaatggttgatccacttggtgtaaaggcaaaaaccaatttcttcttactgcctgtcagcaggcaacagggaggcctatggcatgttagtgcatttttacactggcatagagccctggagttagacttactgagtcttaaatgcacttcgaacacaggttttgactgcttcataggagacattccagacatatttatgctcagcacaactctgaagtttttattcttattatcatggtactgtggtctttttgtttgcttcttttatctgtgatgttagtacttttccaaggccaagttaaaacaaataactacagttaagttcaacttgtgttaatctgtttacatttatggaacagctttgctgcaatctggagaaagataatgaaacacaggatacgtctgtacatgcctggtagaatggaaagctgcagtactgtcaataggccatcaataaagatattcttaccataaaattaaggttcatcttatttcccagttttctttttacagtaaggctatatctgttgattaactcatttatctggaagtaaatcattctaaatgatactggacattttcataacatccagaaataaattctagcttaaaatctgatgattttattatgttactcatgttttttacttcaccattctcgaccactaatttttagttggaagtcttggataatttcttccagtgaaattagttagtaatggaaggaatgtggcatttgaaagcaaaagatggagttcaagtgttagcctacggtgctattctaatctaaatattcatttaagccttctaaacctcagtttctatatctgaaaacataggtaaatattcctgcatacatcagagcattattactgagaggaccagataagtatatgtcatattatttataaattgcaaagaaatatacaaatgttcatcatcatttttgttgtttgcaatgcttttaactcaagcttcttaacacatcaatcccatgtatataattccttatgtgccaggttagatataataatataacttgagaatgtatatttcattttatttttgaaaatatacgtatcttaagattttcttcccaaggtttcatattataaatgaataacaatcatgactgcagaagaaatttaattataagcactgtccatctctccccattcccaaagtaaaataactgctttcagtttgaataggtaaattaaatgtttctctgctccttctattatagcttttaagaaacagtattaaatgattccttgagttgatttcactttaagattattttaatccattactcatttgagtttgcatcattgaattttctttatcaaggacgtaagcaggttaaatgtgtattggggaaatgtcttaaatgtcagtactatggtctggctgccttgtgagtacctcatcattggaggtgttaataaggtgtgactggatggctagaaatattttaggtggatatcatacatcatgtagagctgaagactggaaaactgctaattctatgctgtgatccttacttatgtttattttccaatttagatgattaacagatacaaatagttatttccttcaaacattgcttgtttcacttcaaaactttgggaatgcatgctacggaaaaatctacttcagtagcatgtgaaaaaatacatcttatttgccttaccatcagttttctaagcattttttttctcttttgaatactcataatattttatgtttgtcttataccatttatctcattctatctaataaatactaacttgtttatttctcttattgtccttattgggttttaaagttcttctggggagatatttaacaatctccgtataccccacatgagctatacagagccaacactatataaaataaagttatcaaatttcatttattgtcattagtgcctaaaacttggggaaaagttgctattgaataaaatagcgtacacttggtttctttcttatctgccagtcacagaatctactcttagcaaatgtcattctgatttagagtaattttctaatatagaaatctcatttacccaaataccattaaaattatctaataaggtaacgatttttaaaaggtcccatttcactatttccaaatggtatccaaaagtacttgtaaataaaaaatttaccctaagtgagctgtaggcatagcttccccatccaaaacataaagttatagaggctaatctcacgaacttttctgtggatttttaaggttaaactactggtaaagaagcaattggtaatttgttcagactggatgccagaatagctccgttgtctgttagctgatgtctttgaatctttgggctcactttttatcaatgtgagtttatgagaagccttaaactctggcatacttcaaagtctggtaactttttttaggcctctcacctcctttctgcaacctttcttaactctcacattagggggaaaaaacatatgggatctcaaaaaaactaagtaagcatattttattgtttatcttaaaaaatgcatttttttaaatcaaggaaaatcattaactacatcagtatcgatgaattacatgttgtagtcatcatattttaatgagtcttctctaatatttttagttctgagtttgtagaaagtggcagatgctgttctggttaaaaggctttccaactgattaacgtgttcatccctaatttaattttttaagaaagacacttatgacagcgagaagaaaacgtttcatcttcataggaaatctggcaaaatatcttggcttttgctcaaaatttgaaagcaaatgggaatcagtttcaaatattggaaaagtcaagaaaacgattctagctctggctctgtcattggctctctatttcttcatgtataaaatgatggaaatagattaatttctaatacctctttcaactccactaacattcttttattgatagcatttgttagggagaaataacaagatttgtttatggattgtgataggatatcaataagggggtataacaaagatacctaaaattttcatccttggactagtaaagaatggtcagtccacaaaaacaaaataggggttttgtgttaagggtagccaggtcgaagataacttctgttttgaaatgttaaaggaatatcttctacaagtttatgagactcatgggagtggccattgcatggtaatatggcatagtattatattgtttacatacaatttaaaaagtacaggtagtactgaaaaacatctgttcctgtcctcatcccttttgactcctagatcagtttttccagggcaaaagttgcaaataatttttgctttatcaacattttttattaacttcatgctatgatagatgatgtactctttgtgctacttcccttatccctcttccaccatctcctcccaatgtgttactgtttttaattaaatcaataagcaatgtttacattattttgaatatgtacatattataaatatgttgcttattgtattgtcaggtaatactctatggttctatttctttttatcttttccctatagtttctaattacatttcttttattcctgtaatacatttcttatactatttgggtttttcttaatgctccatgatatccactttcctcactttttccctgagagactacactgggaaccaaattgtcagtggtctttttttattttctgattttgtttatggtacataaaaatagaattcactttaacatattggtttcatatccagcaactttgctaaaattcattaattctaatttctttgtagattcttttgaattttctctgtatgcaatcatatcacctgtgaataacatttttgtttcttttttttaaacaaactttttcttttctttcaataatggctaggccctaggttaaatccaactttatcacattttatttaatatttttgcatctgtattcattggtaagattggcctgtaatttttctttcagactcagttctgtttaggtttgatataatggttatgctaggtttatctctcctcttctgttttctggaagagtttggttaggtttaatgctttttgttctagcttaattacattatggttagagatcatgttctgtacaaattccatccttcgagatttgtttagacaagccttaaggtccagtatatggttagtttttataaatatcccggatgtgcctgatataaatgtgtgtctttcatttcatgaggcattgtattatatatgtccattagaacacgtttcttagtcatgttcaaatctttctacatttttacagtttattttctttacatgttcaatcagccattagaggtctgtttaaaatctccgactctgattgtggatttgtttatttcaatttgtttatttcaatttattttaatatcttccttgggaaccaaaccttttatcattctgaagtggccttgtttcagcttttgcaacacttgtgcctcaaaatctactttgactgaaattaatacagctatactagcttcttttggttattatttgtgtatgacttttaaaatttttaattccaacctttctgtgtaactgtatgtttttgatatctctgatgaatggctcaaatgttgaaatttgcccctgtttttgcagtctgaaggtatttgtctctagaatgtttctcaatgtacttacctaactttttagtaaccagattttcaaaaaatttaaagacgatataatgaacaccattgtatattcatctagattcaacacttgttagtattttgccatatttgtttgtctcttgctttccagggtatctatgtgtgtgcatgtgtttaatgattatgtaagtatatgtgtgtttatacacattttgctaagccatttaaaagtaagttgcagaaatcagacactttatatgcataaatacctgagcatgcatcatgcctcacctaaggaaacataaacatgacataattatcaaacataagaaaatcaacagcaatcttaaagtgttatttaatattcaagtcataaacaaatttccctaatggtcctaaaaagtctttcatagctgttcatgtactgcatttatttattctcttacaaatttgaatatctagaatgcgttggaggaaaattttccgtggatctttcatgtctctgtacatcctgagaagagaggcattgtcattgttctgaactctcttttcaaggatctgttataatgaataactcggaaaattgagatagtatctcactttggaggaaaggccaggtttgtctaccttctagtacaataaagatattaaaaatatctctgggcaaagataaagcaagcttactgcccactataaaatatatggattccctaaacacccagtttttcttctataacctattgcactgcatgtgaaggcatcaccttgtctgctttacatcaccttgtgggaattggggctcgcggaaacccagggtattactgtaaataataaattagttgttgtctctgattaagaagtcttgtagcgtttgctggtgtctataaaactatggcaaggctaacttgttaactttcaagcatagaaaagtcttagtcccttcacggttcttgacagaatggtcttcccactttttacttcattgcactgattttttttaacagcttcattgagatataatttacataccatacattttacccatttaaagttctcagtaattttagaatatttacagtagggcaagcatcaccaaaatcaattttagattttttatcaacccaaaaagaaacctcatgtctcttagctgtcacgttccatggcagcccagccccccagccctaggaaaccatcaatctacttgtcactataggtttgtctattctgaacatttcatagaagtaaaatcatgcaacgtgtggtattttttgtctggcttctttcacttagcataatgttttcaaggttcatccatgctgtagcataaatcggtacttcattcctctttattgccaaataatattatattgtatgcatatactacattttgtttttcagttcattttttcatggacatttaggttgttttatacttttttgactcttataaataatgatgctatgaacattcatgtacagatttttgcatagacatgtttctgttttatacctaagagtggaattgctggatcacgtttactttgtttaggaactgcccgacttttataaagtggttactccattttgcattcccactagcaatgtaggagagtttcagtttctccacatcctcaataatacctgttattgtctgtcttgattatagctatctagtgtgcgtgaagtggtatttcattgtggttttgattttcttttcatttccctgattattaacgatgttgagcatatatttatgtacaataagcccataaaaagatatatatatattttgaaaaatgtctattcaaatcttttgcccattataaattgtattatttgctttctagtacattataagaattctttatatattcttgatatgattctcctgtaaggtatatgattggcaaatacattttcccattctgtaggttgtcttttcactttcttggtagtgtcctttgaagctcaaacttttacaattttgataaaattgtttttaactttttttgttacttgtactgttgctataatatctaagaaggctttgactaaacaaaggtaaaaaaaaaattactttttttttttttttgagacagagtcttgctctgtcacccatgctggagttcactggctcaatcttggctcactgcaacctccgcctcccgggttcaagtgattctcctgcctcagcctcctgagtagctggaattacaggtgcgcgtgccaccatgccctaatttttgtatttttagtagagatggggtttcaccatgttggccaggctggtcttgaactcctgacctcaggtgacctgccttcctcagcctcccaaagtgctgggattacaggcatgagccaccctccccggcccaagaatatttagctctgtgttttcttctaagagttttatagttttagttcttgtgtttaatctttgatctgttttaagttaatttctatgtatagtgtgtagaagaggtccaagtttattcatttgcatataggtatccagttgttccagcagtgtttgttgtaatactattccttccctcagtgaatgtccttggcacctttgtcaaaaatctattcaccatagatgtatgggtttatttttgtaatctcaattctgtcccattgatctacacgtctgtccttttgccagtaccacactggtttgattattgtaggtttgtagcaaattttgaaattggaaagtgtaaatccttcagctttgttctttaaatattattttggcctttggggttccttgcaattccctatgaatttcatgtcagttttatgatcagcttttccatttctgcaaagagggcggttggaatttttataaggattgccttgaaggtgcagaaaaatgtagggagcattatcatcttagcaatattaagtcttctgatccatgaacatgggataattttttatttagttaggttttctctaaattctgtcaacaatgatttgtagtttttcagagtaaaaatttttcatttcttaagtttattcctaagaattttatcattttcatgcagttgtaaatggattttttcacttaactttatgctagtctataggaatacaattgatttttatatagtgatcttgtaccatgtgaccttgctaaattcatttatttgctctaataggattttctgtttacaagactgtgtcttatgcaaagagatagggctttacttccttctttttgatatggatggtttgtgatgtgattatttcacattgcatgcctgtatcaaaacatctcatataccccataaatacataaacctactatgtacccacaaaaaattaaaaatgaaaaaatttgcatagggattgttaatttccttgtgtaattgccctacatagaacctgtaggattatgtggaaaagaaatgacagagtggacattcttgtcttgttcctggtcttatagggaaatgatttagtcttttaccattaagtatagcgttagctgtgggttttttgtagatgcccttatcaagttgaggaatttccctgttattctgatcttaatagtaatgtcctctcttttatttctgattttaatttgagtcttctcttttcttggtggtttgacaatttttttgagcttttctgagaaccagcttttgatcttgttgattttccctattcattttttattgttcatttcattaatttcagctcaaatctttattatttccttctttctacttgttttggggttacttcgctctctttttctgatgttttacattgaaatgttagtttatgatttggcatcttttttaatataggcagttactgctgcaaatttatctctaatcactgctttaaatgagtcccatatgttttggtattgtgtggttttattttcactcacctcaaaatatttctaataaaccttgtcatttgttctttgacctataggttaattaaaagtgaaatatttcttttctttatacttgttgatatcctgtttatttctgttattgatttctaattttattccattgtggttggaaaacatgctttgtgtaattgcaatacttttaagtttattgatgtttgttttatggcctagcatatgatctatcctggagaatgttctatgcattcttgagaaaaaggtatattctactgtaattgggcagagtgttgaatagatgtgtcttaaatgcagttggtttatagtgttgttcaagtcctctatttccttgttgatcttctgtctctcactgttccactgattattaaaagtggagtattgaagtccccaactatttttgaattgtctatttcttactttgattcagccagtttttgtttcatgtatcttggtgttctgttgttagatgtatctgtgtttataattgacatggcatcctgtagaattgacccttttatcattataaaattcctctctctatctctagactttttttgttttagaatatattttatctgttattagcacatctactctagcttccttaaggttgctgttagcatgactgtatttttcaatccttgtagtttcaacctttttgtatgttttaatctaatgtgttctgtagctgccattggatcttgatttttttatgaagtctgccaatctctgatttttgtttggcttgtttaatccatgcacattcaatgttattattgatatagttggatttttgtccgtaatttcactttttgttttctatgtatctcatggttttttgttgttgttcttatgttcctcctttactgccttctttttttttattaagtgaatattttctagtttaatattgcagtttctttaatgattttatttaatgtatttttatttgtttttcttaatggttgcttaccacgtaaattataacctattagagtttacttaagatttatagagttctctattcttactgtcttctcttactctaggcaaaattgctgatactgttccagagctgggagcgggaacactgttccccttcttttggagtaacacacctgctttattagcagggcactaagcaggaagaatagcctttgatcttcctggcttgcctctttcagcatcatcttctgttctatgagcaagttagagtgagggcaaccagatcaaatactcctgggctgctgtgcctggctggagtagagcttttgccttatgagttagggctgtgtggaggacaagagtctaagaactctcagctactctcacttggaacagagcttctataacaggacacacacggtaggggaagatcagaaatgctgatgacttgttccttcctgtgagatactgtagtgcttaactgggagctgggaggagaaggagccctggtttatggatgcacctaccttgggtgaagcctttgtgaagctgagcaagggaggtggagaaggaaggagcaggtcataatgccatagatacctgttgtacatatcaagatttaacacatattgttgaacgtttgttcattggctgtatgttcgtaggacaatatccagatacttgagtttttaaaacataaatttccccacttatcattgttttgctagggagatggtccacagaggtcctcacactgccattcacaaagtcatctctcccatggcatggcattgactttttccctttccttttcctctttctttcttcctttctttctttctctttctttcttctttccttctttctttctttctctcgctctcccttccttccttccctccctccttcctttcctccctccctccctccctccctcctttctttctttctttctttctttctttctttctttctttctttctttctttctttctttctttcttctttctttctctttctttctttctttctttctttctttctttctttctttctttctttctttcttcctcctcctcctccttcttcttcttttcttttcttttcctttcctttcttctttttttttgacagggtcttgctctgttgcacatactggagtgcagtggaacaatcatggctcactgcagccttaatctcataggctcaagtgatcctccctcctcagtctcctgagtagctaagactacaggtgcatgtcaccatggctggttgatgtttaattttttttgtagagatagggatctcatcttgtgtcccaggctggatgtgaactcccaggctcaagtggtcctcccaccttggcctcccaaagtgctgggattacaggaatgagtcaccacacccagctggcattgactttttgaagagtccgtgctagttgttttttataatgtaccttattccaaatttgtcccatgttgtgtcgatttacacttaattacacttaatgtaattactgatatatttgttttatttgtcttgcattttaaggtatcactttctctgtctgcctctctttcgtcttcttttggatgtattaagtattgtgcccctcaattactttgggattaatactctatttatcttttttaaaggtttaccctagaagtgacaatttctaggttgtatatgtatcaaagtccaaagtaatcaatatccttaccagttttctatacaattacaaagaccttaagaatgctttaacttctttcaccctatctcacttacatcatattaccaatgtgtatttctttcaattctatattttaaatgccacagtatgaaagagatgcatgttgcctacccaccagcccaagctgaggctaccaaggcagccccactctttccagtggcagagtctcagcatggctgctaccacccctcacctgaacactccacctggatactgaatattaccctacccccacctaacagagctggtgcttgcactcaccattggggtcctgagcacaagccgcagagccgagcttctgctctgagagagaacacatagcctgaggtcctggggattatctaacccaatccaccaccgtgggccccagtcctcctgggggcctgaggttgggcctaaactcccaaccactaccacttcagctggtacctgcctgcaagcaccacatatgggcctggacatgggcctacccagcccattgcagctactatcaacgtcagtgcacactgctcaagacccagacaattgtccgtccactgctactgccatcacccacaccatgccagctgcccagggactgaagaacctgctcacccacctggtccactgctggcattatcagcatccaagcaagacacctggaggcctaagaataggcccactgacaacagccaacaccagtgccagtgtaaaatgctctagggcacaaagatatgcatgctcagcccactggtgccaccaccgcagccttaagactagcacacctgttgttccagtccccagcacaacttcaccacagccttcactaataaccataccctaacacaccaaggaaaccataaacaccactaatgctgtttacagccaaagaaatcacacagagactatagcactatgaacagaatcaaagtcaaagtaccatacacagccaatatcttagatacatcttcagaaaaatatccttccctatgaaagtaaattcaaaaataggaagaaatgattgttacaccagatgcacagttaccaacacaaggacacaagaaatatgaaaaagcaaggaaatatgacacttgcaaaggaacacaataattctacaacaatagatcttaatcaaaaagacacttttgaaattccagagaaagaattcaaaatattgattttaaagaagctgggtgagatataagataattccgaaaaacaatacaaagaaatcaaaacacagttaaggataagaatgaacaatattactaaagagataagtatttttaaaaagaaccaaatagattaggtggaataaagaacctcaaaacttgaagtcagttctttttaaataaaccagtcaggtaggaataaagaaataagaattttaaaaagaatgagcgaagctttgtgtcatttgggacaacataaattgatcaaatcttaaaaattattgttagccccaaggatgaagagacaaagaaaggattagaaaacctatttaaagaataggtgaaaacttcccaagtctagtgagagatttacataatcagatacaggaggctcagtgatccctaggtagatataatgcaaagaaatcttctccatgacacattatagtcagaaagtctaaagtcaaatataaagagcaaatcctgaaaacagtaagagaaaagtgtctagtcacttctaaatgaaaccctatcaaattaacagtggattgctcagcagaaccttacaggccagaagagaaagggaataaatatattcgaagtgctgaaagaaaaaaattgccagccaagaatactacatccctcaaaattatccttcatcaatgaagaagaaataaaaaatctttcacagataagcaaatgctgagggaattctttatgactagactgaccctacaagaaatgctcaagtgagtcctaaacctggaagcaaaaggacaatatttaagatcatgaaagaacatgaaagtataaaactcacagataaaccagtcaatcaaagaaggaaaagaaaggactgaagcggtaacactatagcaatctaccaaacctcaaaaacaattaaaaagagaaaaagaaataaacaaagaatatataaaacaaccagaaaaccattaacaaaattacagaaacagagcttcacatattaataataaccttgaatgtaaatggattatattttccacttaaaatatattaaatggctgaatgaatttttaaaaaaacatgatgcaactatatgccatgtataagaaactcaccctaacagtaaagacacatatagactgaaagtaaagggatggcaaaagatattccatacaaatgggaaatagtagtaagcaggaatagctatacctatatcagataaaagagagtttaagtcaagaacagttaaaaaaaaaaggcagagaaggtcattatgtaatgataaatggaacaatccagcaagaagatacgacaactccaaatatatatgcaccccatactgtagcttccagattcataaagcaaatattccaaagagagaaatagatgacaatacaatcaaagtgggggtttcaacactccactctcagcatttagacacatcatctagacagaaaatcaacaaagaaacattgggtataaatagggcttcagacccaataaacctaacagacatttacaaaacatcctacccaacaactgcaggttatacatcctgcagttatacatggaccattctccaggatagatcatgtgttaggtcacaatataagtctcaacaaattttaaaaattgaaataatatcagttttcttttcagaccactttggaataaaactagaaatcaatacaaagaggaagattggaaactctgaaaatacatggaaattaaataacatgctcctgagtggccactgggtcaatgaagaaattatgatggaaatttaaaaatttatttgacaaatgggatctaattaaactaaagagcttctgcacagcaaaagaaactaccatcagagtgaacaggcaacctacaaaatgggagaaaattttcgcaacctactcatctgacaaagggctaatatacagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccattcgacccagccatcatcccattactaggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagctcatgtcctttgtggggacatggatgaaattggaaatcatcattctcagtaaactatctcaaggacaaaaaaccaagcaccacatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtacacatatgtaactaacctgcacattgtgcacatgtaccctaaaacttaaagtataataataatgaaataaataaataaaaaataaaataaataaataaataaaaatttattgaaatgaaaatgtaaacacaacatacatattcagcaaaaatagtgctatgagagaagtttatagcaataaatgcctacattaaaaacgtagaaaaataaaaatttaacaatctagcaatgcacctcaaggaactagaaaagcaagaacaaaccaaatcgaaagttagcagaagaaaaaaaatagcaaagatcagagcagaactaaacagagactacaaaagcaaacataagggcccaacaaaatgtaaaactgcttctttgaaaagatacacaaaatttgtaaactgctagctagtctaaccaagaaaagacccaaataaaatcagaaatgaaaaaaagacactacaattgatatcacaaaaatacacaagatcatcagagattattatggacaactatacactgacacactggaaatcctagaagaaatggataaattcctggaaacatactacttaccaagattgaatcaggaagaaatagaaaacctgaacagaccaataatgagtagtgagattgaatcagtaataaaaattctccctacgaagaaaagcccaggaccagatggatacacagccaaattctaacaatcgtacaagacagaaataataccaatcctcctgaaactattccagaaaatccaagggtaggaaattctccctaattcattcctcgaggacagcatcaccctgatatgaaaatcagacaaggattcaaccaaaaaagaaaactgctggcaaatatccctggtgaagattgattgaaaaacaatttaaaaaatactagcaaatccaattcaacagtacgtcaaaaatataatacacatgggtccattgggattgaaggcaaggaaggcacaacctttgcaaatcaataaatgtgatacattacatcaacagattgaaggacaaaacaatatgaccatctcaatagatgcagaaaaggcatttgataaaatttaacatcccttcgtgattgaaactctcaacaaactaggcatagaaggaatataccgtagcataataaaggccatatacttcaaatccactgcaaacatcatattaaatgaagaaaagctgaaatcctttcctctaaaaactggaacaagacaaggatgttgactttcaccactcctattcaacatagtactggaggtcctattaagagcaatcaagcaagtgaaaaataaaaaaggcatccaaatgggaaaagaagcagtcaaattgcccctctttaccgatatatctatctagagaagcttaaagaatgaattcagtgaagttgcaggatacaaaatcaatgtacaagaatcagtagcctttctacacaccgataatgatctaaccaggaaagaaagaaagaaagcaattccatttacatttggtaaaataagtaaaatacataggaataaatttaaccaaggaggattgattctacaaggaaacctacaaaacactgttgaaagaaatgcaggtgatagaaacaaatggaaaaatattttatactcatggatcagaagaattaatattgttaaagtcatcgtattgcccaaaggaatctatacattcaacataatcgctatcaaaatgccaatgcaattttttcacagaattagaaaacaaatcctaaaatgtatatgaaaccaaaaaagagcctgaatagccaatgcaaccctgacctaaaaacaaagctggaggcatcacattacctgacttcaaaatatattacaaggctgtagtaacccaaactgcattatattgttatgaaaatatagaccaatggaacagaatagagaacccagaaataaagccacatcttcatagccaattgatcttcaacaaagctgacaagagcttacactggggaaaggtaatcctcttcattaaatggtgctggaaaaattggatagccacatgtagaagaatgaaactggacccgtatttctcaccatatacaaaaattaactcaggatggattaaagacttaaatcttcttttgcacaggaaaagaaactatcaacagagtaaacagacaacctacagaatgggagaaaatattcgtgaactgtgcatccaacaaaggtctaatatccagaatctacaaggaacttaagcaattcaacaagctaaaattttatgtaaatataagacctgaaaatataaaactactagaagaaattccaggggaaaactctcctggacattggtctaggcaaagaatttgactaagacctcaaaagcacaggcaacaaaaacaaaaatagccaaatggggctatattaaataaaaagcttctgaacagcaaacgaagcaatcaacagagggaataaacaacttgttgaatgggagacaatttttgcaaagtatttatctgacaggggactaatattgagaatacaaaaggaactcaaacaacaggaaaaaacaaacaaaacaaaataaaactccaattaatcccgtttaaagtaagcaaaagacctgaatagacatttctcataaaaaagacatacaaatggtatatgtaaaatgctcaacatcgctaatcatcagagaaatgcagatgaaaaccacaatgagatatcatcttatcccagtcaaaatggctattaataaaaagacaaaaaacaacagatgttggcaaggataaaaaaaataagggaactcttatatgctgttgtgaacataatctagtacagccaccagaaaactgtatggatatttaaaagaaagagagaaagagaaagagagagagagaaagagaaagaaagaaagaaagaaactaaacatagcatcaccatacaacccagcaattccactactaggtatctatccaaaggtaaagaaatcaatatatcaaagaaatacctacacttgcctgtttattgcagcagtattcataatcacaaagatatgcaattaacctaagtgtgtatcaacaggtgaatggataaagaaaatgtggtacatatacagaatggaatactacttagccataaaaactagtgaaatcatgtcatttgcagcaacatggatggaactcgatgtcattctcttaagtgaaataagccagccacagattgacaaatattgcatgttctcacttgtatgtgggagctaaaaaattgaccatatggaggtagacagtggaaagacagagaacagagactgggaagggtaagtgtcaaggagggggaggatgaagagaactgggttcttagcatattaaagatgtcattccgtggtcttctggctttgattattgcttctgagaactaatctgtaaattaattttcactctcttgaaggcggtctgtcttgtcttttttgatgcttttaaggcctttcctttacttttatgttatgcagttatgttctgctgcacctagtttcaggttttatttttatgccattgaatctgtttggtttcttgaatcacaaatatctgtagatttttcttgagaaatcttagccgttgtctctttagtattgtctttattccctctctcacctcttctagaatcccaatttcctttatgttattcttcctcactctttcttccatgtctcttaatgattatttcacagtttccatgttttatctctatgccacattatatataatttctttttagctttactaagtcttttaactttatactgtctctcttcagctctatctagtctgttgtgaagcccatccattgagttttaaatttcaattactatagcttttacttctagaatttatattttatttcgattgagctatgtcattttcatacaattgctggctccctttattatttttaagttagaaaaattcttctataattgtaaagatagttactatatattttttatctgataattccaatgtgtgaaatatttagtgagtactttctgttgtcatatgtttcttttggcttttgcttatggttttttttcttgtatgcttaatggtttttaattaggaaatctcatcttcctttaaaaaaatgatacattagaattatttgaagtttactatgaaggcatgttttttctacgtagagtcagtatgtatttttgcccagcctctagaaggtcaatgcagtcagagtccactcaggtaatgctaatttggattgcaaatctggccagtttgtggtgagttttttaagggttttttttcctgtacttctctgctaagcaccaagagatcttttcttccacctccctgggtgtgggattgtgaggtacatttatgcgtggtacacccttatagtaaaagaaattataaaacaaaacccaaaaattatccaagtttggcatatgtcctccgggaaaaagtagtttcattgatcagttcattttttggttttccctagattttgatttgataaatcctactgtgcttccctttgatgcttttaggaagaagtttttacttttttccaagcattttttttttaagtaagcatttcagtctggatacctaactggccacattattggaatatttcttatttctctctgccattattttgtagtatgtgtctccttggaacacctgaatcaaaattacttagagatgtttattaaaatttcagattctgctattcaacttcagcttactggaagaatctttacgatgggttgctggtatgtaaatttttgtgaggttctttaggtgaccctaattcatacagaatttgtttttatttgtacttttaagtctaatatctgctgttttaattgtagcagcatgagatctaaatttattattttttatatttattctagcaccatatgttgaaaaattcattgttttcacatctatttgacgtcaacttttatcatatagtagttgtgtgtgtgtgtgtgtgtgtgcacgtgcttgcatgtgtaaatctgtttctggccttcctatttttgttaactgaataccatactattttaattattgtagtgttgtgatgtgttttactgtgtgataatacaaaactttccttactcatttattactttctcccacaataaaaatttaaaatattactgtagtttcatcattttcttgcttctttcatcttcagtgatttcgaaaaattagtttttttcatatgaacttagccttttagactgaggtacttaatgttcattttacttctttgccccaatcaattttgtattttaatcatgcttagcatggcaatttttcctctaggtagctttctgtctatccttccaagttgaagtccaggtattcactttctccacagagcctttgtcaatactttcaggctcaagggaactgtttttcttaactttgatagcaattattgactataccactcatttttacctggcaaatcctacagaatcacagagagtgaaatctggaagctacctaaggagatcatattgtctatgtatgccattttacaaatgagaaaacagccaaagagtatggaaatgatttgtccatggtcaaatgtttcaacttctgaagtaaaattatgatataccgctgtatcattattccattgtattttgatattcttttcatatgtcctgaaaatacccagttacttaaaaaataaaatacctagttacttaaaaaaacaaaaaacctagactggaagttccttaaaggtagcacctgcatgtacttttgtacaactcatagaactattattgtgcttgtgtttattagacacctaatcaatattaatagatgttggtaaaaaaacaaattgttccattaaccagatgtcaaactggggctatctccttgtgggcgccactgttataactgtatagaaagtggcatctagtggttggtgtgcgtattacaattgcctgttttgttttaacctatgagtaccagagtcattctcataacctaggtggaataaatagactataaattaaaattttaaattgaatttaaacacatttatctataattcacaactgttttaatctgtgctctctctaaagtaaagctacatgttaataaaaaattgcaaaaaattatacaaaattacttgtaaaatgacatgcgagagtatttaaggttttgcttgtttataaattatattaggagttaggggctatcgttggatactgagaagtcaaaatgcaattataaagaaaggtcacatagaaacttgttcatatcaatgaaatcctgtcaggttattgctttgcattatttttaggagcttaatttgtatttaaaagaagaagatctctcaataaaggctgaagatggaaagctacactgtcttctactcgcaacaacaaaaacccatgcacatatattcacatataaagttcagacatgcatttcagtgtcaaatgttaattattcttacattaacagccatttggggttatcactactctttacctctccattaatgcatgagtgttgacaatatgcacaatttaattcagggactacgactgttgacagttactgtcttgtgaacttgtgaatcagtatcttcttgtgaaacggtatcttctaaattttataaaatccatagtctggaacttaaaatttatgtttgcagaaaaatattatatatttttaattaacctctgtttcctgcacattgtaatataattttttgtagatgggttcatccttcccattagagagcaatgatgtactttgtacttctacttgcacctaacataacatagtggctgtcacataacaggtgatcaataagtatttcttgaattagttacacatgttggagggagctgtgtgttactcatcttagaagtctagtgcctaacaatttttctgtcctctagtaatattcaattcatatttgatgaatgagtaagtctgaataagcctatttaatctgtagtgtagttagcgtaaaatactaaaatcagtatataacccccaaacatctatgaataataaataatagcggcatagcagactttctgtttgacgtgtcaggagcacagctttcactggagcagcctcttgtagtgtgagtgagagattactgcaacatcaagccattgtagtttgctcttataatcaggaaaagaggtttcagtatgaaggtgacttttagttgcagctgagtgagttaggagttctgaccagaaggataaggtcagtactttcaaaagggttgaggagggtactttggtagtgactagagtaaaggaaatcatggaatgttgagcagcaggctaaggtattttatatcaaaggccctcaagattgatgggcattatttggtatttatgtcacatgaaggtttcagtaactcagtctggtatctatctgatgaaaagaatgccacctccttgtaagtaaacactgagctatccatgtatattaaactaacttgtttttctaagcagttcattttctaagagtaaaggatagtactgaatggcagaagtcacatactgtattcttttcctctataggttttctattttggaggaggatatttttctggcttgaggacctcaattcctaatatgattgaatgcctgtttagaacatctagactgtgggagcagcatttatggtaaagctgttagagactgagctattattagtgatgaaggagtaggagcaaagaaaagaaagaaaggtggtaaaagatagtgttatatattttatgctccatgattgctcatgaatggagagaaacaagtgacttgaagtggtaggcattgttgtctagttgccaaggtcattgctaatacagagtgagaggtaattttttacaagcaatgttagaagaaaaaaaggagagttcctgagagtttggacatgtggcaaatcatattacagggaagttgtatgaatttcttttccatttttaacatattttagattgtgcatactgtcaacactcatgcattaatgaagaggtaaagggtagtgataaccccaaatggctgttaatgtaagaataattaactttgaaatgtatgtctgtactttatatgtgaatatatgtgcatgggtttttgttgttgtaagtagaagatggtgtagctttccatctttagcctttattgagagatatctcatttttaatgtcttgtaaaatgatatttttcactttaaaattataaaaattatgtttgctcattttgaaaagttaagacagaagtgtatataataaaaggtgcaagcttcctgagaggtaactgttatttgcaatttcgtatatcttttcagatatttttctggtatctatctttcaagtttggattgttgatttcagttgagctgtaagtcagagtctgatttttgggttcatatttaatgattttttccctctttctcttccttataggcttgctatgggtgttctccaggatcaaagtgtgactgcagtggcataaaaggggaaaaggtgaggtcttagattggcatttgaaaatttagtaaagccagtaaactaatggttttaataaatatttttttaaaaacagagcttctatctcagtacttaagtaagtgaaatgaatcctattgcattgcttattttagagagcttataaggattagattatatcttaaggtcagcaaagattttctgtaaaaggccatatagcaaacattttaggatttatgggacacatcagtttctgtcacatattcttatttatataaatagaactttaaaagtgactaaaaaatattcttagctcttggatcatagaacatgagcctcttgggatctggatcaggacctctttcccgtaacatatttctggcgaccacagaagggactatagtgcagaaaccctagcttaatggctacctttgggtaagtgttggggtcctttaatatctgcatttggcctgagagctataatctgccaaactctgattggtcttgttgaaggcactgacttacttaataggcaaagacaggggaaaaacacttaagaaggaaactaaacatttatcaagctactaatctctgccagataccaggcaatatcatgtatttttatctagtctatgcagtttaataatagatgaaagtctttttttttgttttttcgtttttgagacacggtcttgctctgtcacccaggctggagtgcagtgtcacaatcaaggctcactgcaacctccgcctcctgggttcaagcagttctcgtgcctcagcctgccaagtagctgggattgtaggcatgcaccaccatgcctggcttatttttgtatttttagtagagatggggtttcgccttgttggctaggctggtctcgaactcctggcctcaagtgatctgcccaccttggcaggggattccaggagtgagccaccatgcccagctgaatgtttatttctatcttactttttccacagcagcatctcctattgtacagatattatgattacaaagtaagtattggtgaagattatatagcataagcctaatcactatcagtgaatgacattaatattatcaaatataaaagggatagtaaattatagcctaaagagagttatactaggagatgggatcatactcttgtctccactctttggggctcagtatttttgaatgaatgagtgaatgctgctaattatatatgaagcagtttaggacagtatgtctagggcataatctacttagaggtatagaaggtacgttagcatattagacattcttaaaagttctggagcaaagaaacctatttgtttgttttgtaatgctacatttccaagccccatttgaccatgttatagactttccccttaacagagcagctattaatattaattggatagtcttctgcagaacacttatttgagtaacattagtttgatgggagtagtttcgcagtaagggtgctttctgtagtggagaaaataccaagagggattaacttcatataatagtagagtgatgtttatcagattaacttttgagataagaatggaatactctggacaaaatataacagctacttgatagtacaagagaataaccaaaggaaaaagaggagaggcatctgcacttgaaagaaaggaaatacactgggcatatttgcatttatatggcttttcccctgagtacagcccttagtctgcatggcaaaggaaggctaaaacccagacaaaaacccatggtcttactggcttgagtcagcagagttgaggatgccagaatggctgaaaagtgaagagggatatactggaatgtagggaaacacattggaaagagctcaaaaaattgcttatagattccatccaaattcttgcttgaatcctgaagtttataactatagaggaaggttcatacaacccagcaaaaaggaacagctggaagtctgcaataactgagcatagatttaaccgttgtccgttgaaaggagaatggagttttaagttcaagttcagctgagttaactatactatttcttaaaatagaagtttaatcaatactcttcagaggaagttaagagaatccagaatctctccatattacctacaatatccagtatgcaattaaaaattaccaagtaaaagtgatctacagtcaataaaaagaccaatcaatgaaaaccaaccctgaactaacacagatgttggaatttgtagactatgatttaaagcagaaaatagaaaaggaaaatctcctcatgatgcgtgaccaaataaggaatcacaacagagtaatggaaactgtattttatttaatttttttttattgttatactttaagttctagggtacatgtgcacaacgtgcaggtttgttacatatgtatacatgtgccatgttggtgtgctgcacccattagctcgtcatttacattaggtatatctcctaatgctatccttccccccacccccaccccacaacaggccctggtgtgtgatgtcccccttcctgtgtccaagtgttctcattgttcaattcccacctatgaatgagaacatgcagtgtttggtttcttgtccttgtgatagtttgctgagaatgatggtttccagcttcatccatgtccctacaaaggacatgaactcatccttttttatggctgcatagtattccatggtgcgtatgtgccacattttcttaatccagcctatcattgttggacatttgggttggttccaagtctttgctattgtgaatagtgccgcaataaatatacatgtgcatgtgtctttatagcagcatgatttataatcctttgggtatatacccagtaatgggatggctgggtcaaatggtatttctagttctatatccttgaggaatcgccacacagtcttccgcaatggttgaactagtttacagtcccaacaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatatgtttgagttcattgtagattctggatattagccctttgtcagataataggttgcaaaaattttctcccattttgtaggttgcctgttcactctgatagtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttagatctagcatttaagtctttcatctgccttgaataaatttttgtataaggtgtaaggaagggatccagtttcagctttctacatatggctaggcagttttcctagcaccatttattaaatagggaatcctttccccattgcttgtttttctcaggtttgtgaaagatcagaaagttgtagatgtgtggtattatttctgagggctctgctgtgttccatttgtctatatctctgttttggtaccagtaccatgctgttttggtgactgtagccttgtagtatagtttgaagtcaggtagtatgatgcctccagctttgttcttttggcttaggactgacttggcgatgcaggctcttttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttgcatttgtttgtatcctcttttatttcgttgagcagtggtttgtaattctcctcgaagaggtccttcacatcccttgtaagttggattcctaggtgtttcattctctttgaagcaattgtgaatgggagttcactcatgatttggctctctgtttgtctgttactggtgtataagaaggcttgtgatttttgcacattgattttgcatcctgagactttgctgaagttgcttatcagcttaaggagattttaggctgagacgatggggttttctagatatacaatcatgtcatctgcaaacagggacaatttgacttccttttttcctaattgaatactctttatttctttctcctgcctgattgccctggccagaacttccaacactatgttgaataggagtggtgagagagggcatctctgtcttgtgccagttttcaaagggagtgcttccagtttttgcccattcagtatgatgttggctgtgggtttgtcatagatagctcttattattttgagatatgtcccatcaatacctaatttattaagagcttttagcctgaagggctgttgaattttgtcaaaggccttttctgcatctattgagataatcatgtggtttttgtctttggttctgtttatatgctggattacatttattgattggcgtatgttgaaccagccttgcatcccagggatgaagcccacttgatcgtggtggataaggtttttgatgtgctcttggattcagtttgccagtattttattgagaatttttgcatcgatgttcatcagggatattggtctaaaattctcttttttgttgtgtctctgccaggctttggtatcaggatgctgctggcctcataaaatgagttagggaggattcccttttttttttattgattggaatagtttcagaaggaatggtagcagctcctccttgtacctctggtagaattcggctgtgaatccatctggtcctggactttttttggtttgtaagctattaattattgcctcaatttcagagcctgttattggtctattcagagattcaacttcttcctggtttagtcttgggagagtgtatgtgttgaggagtttatccatttcttctagattttctagtttatttgcgtagaggtgtttacaatattttctgatggtagtttgtatttctgtgggatcggtggtgatatctcctttatcattttttattgcatctatttgattcttctctcttttcttctttattagtcttgctagcagtctatcagttttattgatcttttcaaaaaaccagctcctggattcattgattatttgaaggatttttgtgtctctatctctttcagttctgccctgatcttagttatttcttgccttctgctagcttttgaatgtgtttgctcttgcttctctagttcttttaattgtgatgttagggtgtcaattttagatctttcctgctttctcttgtgggcatttagtgctgtaagtttccctctatacactgctttaaatatgtcccagagattctggtatgttgtgtctttgttctcgttggtttcaaagaacatctttatttctgccttcatttccttatgtacccagtaggcattcaggagccggtcgttcagtttcatgtagttgagcagttttcagtgagtttcttaatcctgagttctagtttgattgcactgtggtctgagagacagtttgttataatttctgttcttttacatttgctgaggagtgctttacttccaatgatgtggtcaattttggagtaagtgcggtgtggtgctgagaagaatgtatattcttttgatttggggtggagagttctgtagatgtctattaggtctgcttggtgcagagctgagttcaattcctggatatccttgttaactttctgtcttgttgatttgtttaatgttgacagtggggtgttaaagtctcccattattattgtgtgggagtctaagtctctttctaggtctctaaggacttgctttatgaatctgggtgctcctgtattgggtgcatatatatttaggatagttagctcttcttgttgaattgatccctttaccattatgtaatggccttctttgtctcttttgatctttgttggtttaaagtgtgttttatcagagactaggattgcaacccctgcctttttttgttttccatttgcttggaagatcttcctccatcccattattttgagcctatgtgtgtctctgcacatgagatgggtctcctgaatacagcaccctggtgggtcttcactctttatccaatttgccagtctgggtcttttaattggaacattcagcccatttacattcaatgttaatattgttatgtgtgaatttgatcctgtcattatgatgttagctggttattttgctcgttagttgatgcagtttcttcctagcatcaatggtctttacaatttggcatgattttgcagtggctggtactggttgttcctttccatgtttagtgcttccttcaggagctcttgtaaggcaggcctggtggtgacaaaatctctcagcatttgcttgtctgtaaaggattttatttcttcttcacttatgaagtttagtttggctggatatgaaattctgggttgaaaattcttttctttaagaatgttgaatattggcccccactctcttctggcttgtagagtttctgccaagagatccactgttagtctgatgggcttccctttgtgggtaacccgacctttctctctggctgcccttagctttttttccttcatttcaactttggtgaatctgacaattatgtgtcttggagttgctcttctcgaggagtatctttgtggcgttctctgtatttcctgaatttgaatgttggcctgccttgctaggttggggaagttctcctggataatatcctgcagagtgttttccaacttggttccattctccccatcactttcaggtacaccaatcagatgtagatttggtcttttcacatagtcccatatttcttggaggctttgttcgtttctttttattcttttttctctaaacttctcttctcacttcatttcattcatttgatcttcaatcactgataccctttcttccagttgatcgaattggctactgaaacttgtgcattcatcacgtagttctcgtgccatggttttcagccccatcaggtcctttaaggacttctctgcattggttattctagttagccattcgtctaatcttttttcaaggtttttaacttgtttgcattgggttcgaacttcctcctttagctcaaagaagtttgatcatctgtagccttcttctctcaactcttcaaagtcattctccttccagctttgttctgttgctggtgaggagctgcgttcctttggaggaggagaggcactctgacttttagaattttcagtttttctgctctgttttttccccatctttgtggttttatctacctttggtctttgatgatggtgacatacagatggggtttcggtgtggatgtcctttctgtttgttagttttccttctaacagtcaggaccctcagctgcaggtctgttggagtttgccggaggtccactccagaccctgtttgcatgggtatcagcagcagaggctgcacaagagtgaatattggtgaacagcaaatgttactgcctgatcgttcctctggaagtttcatctcagaggggtacccggccgtgtgaggtgtcagtctgcccctactgggggttgcgtcccagttaggctactcaggggtcagggacccacttgaggaggcagtctgtccgttctcagatctcaagctccatgctgggagaaccgctaatctcttccaagctgtcagatagggacatgtaagtctgcagaggtttctgctgccttttgttcagctatgccctgcccccagaggtggagtctacagaggcaggcaggcctctttgaggtgcggtgggctccacccagtttgagcttccaggctgctttgtttacctactcaggcctcagcaatggcagacgcccctcccccagccttgctgccaccttgcagttcgatctcagactgctgtgctagcaatgagcgaggctccgtgggtttaggaccctccgagccaggcacgggatataatctcctggtgtaccatgtgctaagaccatcagaaaagtgcagtattagggtgggagtgacccgattttccaggtgccgtttgtcccctcttcccttggctaggaaagggaattccctgaccccttgcacttcccgggtgaggcgatgcctcaccctgctttggctcacgctcggtgcgctgcacccattgtcctgcacccactgtctgacaatccccagtgaggtgaacctggcacctcagttggaaatgcagaaattacctgtcttctgcatcgctcacgctgggagctgtagactggggctgttcctattcagccatcttggaaccacccattttggaaactgtattttaaaaaggaaaatttatatttgaaaagcagaatataagaaaaaacaattgaccttatgggcttaacaatagaatggagatgtcagaagaaatagtcagtaatcttaaagataaatcagaagaaacaactgaatctgaagagcactgaagagaaaatgaaaaaaagaaaaaacagaataggaccccagtgacctctgtgacagtgtcaaatggtctaatacaaatataaatggagtcctctaaggacaggagagaaagaacagggaagcaaaaagaagaataaattatggggcactaagaatggcaagaattctccacacttggtgaaaagtataaatttacagatataagaagtccagcaaacctcaagcaaagtaaaaacgaagaaaactatacctaggcccatcataatgaaactactgaaaaaatagagattgaaagaaaatcttgaaaaaagctagagaaaaatttacaccgtgtatagtggaacaattatacgaatgatgacagacttctcatcaaaaagattggataatgtacagcaatgtgaaaacatcgttagagagctaaaaaaaaatttgcaagcacaattattatatacagttaaaatatacttcaaaaataaaggcagatttaagacattttctcataataaaaatagggaattattcatgaagaggcttgcattaaaataaatataaagaaatttcttcaggctaaggggaaatctcactagatggatgtgtgaatttataggaaggaatggaaagtaatagaaatggtgtaaatgcgggtaaatataagaggattatatctcttttcctctatttatttaacagaaagcactgtttcaagtgtaacaacagagattcaaaatacatgaagccaaaactgagagaattaaagggagaaatagacaaatccacaatcatggttgtgattctaacactcctatttcagttgttccactcttaacaacttaggctttattgacataaaaagagcccaacatcaaacaactacagaatataatttttttcaagagccaaggaattttcaccagtgtagactatgtgataggtcacaaaatgagaccctctaaataccaaaagattaaaaatatcagtatattctcttattacaatggaatgagtaagaaataaataataatatttgtagaaaattcctactatttggaatttagaaagcactgttctaaataactgctggaccaaggaataaatcaaggaaaattagaaaatgattttagttacatattgttgaaaactgaaaattttggaatggggttaaagcagggcataggtgggaaatagatttaaatgtctatgttagaaaagaagaaagatttaacattggtgacctatgtttctcactttagaagctagaaaaggacaagcaaattaaatttaagagaatgaaggaaataataaagacaaaagtaacaatatattaactacaaaaaaaatagaaaacacagtcaaaatttggtaattgatagcacaaaagatgataagaaaatagaaaacacaaattacccatatcaggaatgttcctacagccattaaaagatcaataagggactatcataaatcactttgtaacaataaatttgacagcttaggtgaaatggacaaattccttaagaaacatacattaccaaaaacaaaaacaaataaatgcgtgagtgaaagaaagaagcaaaatataaattagccctatatatactaaggaagttgaattatcaacccttccaacttagaattcctgttccagaagagtttactgatgaattctatgaaacatttttgcaagtgacagtgtcaatcttgcataaatttattcagaaaatagagggatattgaatgccctccaattaattttgtgaagcaagcaaagccctgataccaaaaccaagcaacgacaaaattacagaaacagaaaacgacagactagtatccctcatgagcatagatacagaaattattaaaattttagcaaatcaaatccaacaacatataaagtggatgattggttgtgaccaagtgggatctatgccaggaatccatgtttggtttaacatttgaaaatcaaaaattgtgactcactatattaaagaccaaaacaaaatttagagcataaatatataaacccccaataattatcttaatcgataacaaagaatgcatttaatgacattcaatatccatttctaataaaaattactcttagtaaactaggagtagaagagatttcctcaaccttaaagggcatatgccaaatccctaaagctaaaattgtactcaatggagaaagactgagttcctttctcctaacttcaggaacatctgctctcaccatttctattcaacattgccagtacagtaagacaagaaaaagaaaagaaaaagtatccgtattgaaaaggaagaaataattttttttgtttttttgatgatgacatgatttttcaatgtagaaaatgttatgacatatgctaaaatactcttaaaacttataagtgagtttagaaagatcacagaataaacaaaaccaacaaactaagatcagtaaataaaaatcggttgtatgagcaatggggaaataattccctgttcaataaatggtgctgtgataactgactagccatatgtagaagaatgaaatcagacccctgcctttcaccatatacaaaaattaactcaagatggattaaagacttacgtgtaagacctcaaactataaaaatcctagaagaaaacataggaaataccattctagacattggccttgggaaataatttatgactaagttcccaaaagcaatttcaacaaaaacaaaaattgacaagtgtgacctaattaaactaaagagcttctgtatagcaaaagaaactatcaacagagtaaaccagcagcctacagaatgtgcaaaaatatttgcaaactatgcatccaacaaagatctaatatccagaatctataaggaacttaaacaattcagcaagaaaataaataaataaataaataaccccattcaaaaatgggcaaaggacatgaacacatacgcctcaaaagaagacatacatatgggcaacaaatatgtgaaaaaattctcaatgtcactaatcatcagagaaatgcaaattaaagtcataatgagataccattgtctccgttaaaatggctattattaaaaagttagaatggctattattaaaaagttaaaaacagatgttggtgaggttgcagagaaaagagaattcttacacattgttggtgtaaatttaaattagttcacccactgtagaaatcagtttggagattctttaatcagttcagccactgtagaaagcagtttggagattttttaaagaacttaaaacagaattcccattcaacccagcaatctcagtactaggtgtatacgcaaagtaaaagcaatcattctactgaagagacacgtgcactcatatgttcatcacagcactattcacaatagcaaagatggaatcaacctagatgcccatcagtggtggactaaagaaaatgtgctacatatacaccatgaaatactatgcagccataaaaaagaatgaaatcatgtcctttgcagcagcatggatgcaactggaagccattatccttagctaattaacacaggaacagaaaaccaaataccacatgttctcactaataagtgggagctaaatattgagtacacatggaaataaatatggcagcaatagacactggggactactagtgggggaagatgttggggagactgttgaaaaactgcctatcagtacgacactcactacctgggtgatgggatcctttgtactccaaacctcagtgacatgcaatttacccatgtaacaaacctgcacctgtacccccgaacctaaaagtaggtaaaaaaaaaatgttatacaaatggaatcataaagtatgtaactttttaagactgacttttgtcactctgcataattcctttgagaagcatccaagttgctgcatgtatcaatagttatttcctttttattgcttagtattccatggtatggatccaccaaagtttgtttaaccattcacccattaaaagacatctgcttttgtttttcttttccaatttgggaatattatgaataaagttgttatgaacatttgaaaaaaaatcagtcatatgtccataatctaacaatgaaaagtagtaaattggaattataatagtgccatttaaaataacaacaaaaatttgagatacttaggaataaatcagacaaaaatgtgcaagtctcataccctgaaaactacaaaaaatattgcggtgagaaataaaagaagacctgaataaatggagatatatatcatattcatgaattggaagactcaatattgttaagttgacaattggccccaatttatctatagattcagtgcaactccaatcaaaattcttgtggttttctggggctacaaatttaacaagctgatcctaagagttagatggaaatacaaatacagcttttataaaaaacaatgttggaggatttacagtacacaattccaagacttagtataaaaccacagtaaacaagatagtgtgctattagccaaatgatagacatatagatgaatgggacataatagagactcacaggtaaatagtgaatctgttttttgacaaaaatgcaaaggtagtggagaaagtcttttcaataaatagtcctggaagggttgcatatgcgtatgcacaaaaatggctcacactttatataaaagttaactcaaaatgcatcatagacctagatgtaaaatctaaaccttaaagtctttaaggaggaaacaaaggggaaaatccttgtgactttgggttaggcagatatttcctagatctgatatcaaaaacacgatccaccaaagaaaatactgttaagttgtatttcctcaaaagtaataacttgttctcctctaaaagtattgttaaaagaataaaaagataatccacagtgcaggaaaaataatatttgcaaattacatatctgatagaagacttgtatccagaatatataaagaactctaaaaatttaataataaaacatacagctccacataaaatttaattataaacaaattggaagaatattttgacacttaaataaaagcagatatatagatggcaaatagatacacgaaaagatcctcaacattattaattagggaaatgcaagagaaaaccacaatgagatgccaccataaacctgttagaatatctaataaaaacttttagccaaagcaagtatagatgagaatgtggaagcaactggaacaattatagattattggtataagtggaaaatgatctacacagtttggcaatttcataaaatgttaaacacctattaaatgaccctgttgattcctaggcatttacccatgagacatcaaagcgtatgcctataaaaacttgtacttgaaaattcatagtagctttatttgtaatagccagaaactggaaacaactcaacttcccatcaacaggtaaatgaatcaacacattgcagtatacctctacaatggaatactactcaacaataaaaagtaatgaactattgatattcaccataacaagtttgaatctctaagtaattatgctgactgaaaagttagacaaaaagagtacattctttataattccatttatataaaattctagaaaatgcaaattaatctacagtgacagaaagcagatctctaatagcctggggtgggtaggagtagggagatggatataggcataaggaagatatgggcacaaagaagcttttgtaatggattggctatgctcattattttgattgtggtgatgatttctgtattagtccatctttgcactgctataaagaaatactcaagactgggtaatttataaacaatggaagtttaattgactcacagctccgcatggctgtgcgacctcaggaaacttacagtcatggcagaaggcttaggggaagcgggcaccttcttcacaaggcagcgggaaagagaagagtgaggagcaaagagggaagagccccttataaaaccatcagatcttgtgagaacccactcactatcaggagaacagtgtgggggaaactggccccatgatccagtcatctcacaccaggttcctccctcaacacttggggattatgtggtatacaactcgagatgagatttgggtgaggacccagagccaaatccgtttcactggtgtatatatgtgtcaaaacttttggccaggcatggtggctcacaactgtaatcccagcactttgagaggctgaggcaggtggatcgcttgagcccaggagtttgatatcaacctgggcaacatggtgaaaccctgtctctacaaaaaatataaaaattggctgggcatggtggcacacacttgtagttccagctactcagggaggctgagctggcaggatcacctgagcccaggaggtataggctgcagtgagctgtgtttgtgccacagcactccagcctgtgcaacaaggtgagatcctgtctcaaataaccaccccccaaaacaaacaaaaaaccccaaacttttaaaatagtatactctacgcatgtatgatttattctatgttaattatacttcagtaaaactgcttttaaaacatatgtttttaacatagaaataaaacatctagatttccctaaaagaaatgtgtccaagtgcatattaataaacaaagaaaacttgctagacccctgatgagatcaagttaaccagttgacaatgtaaaatctgtgacacaatcaaacattaactaaacaaagtgtgcctctgtcagtggcatcagcatttactgggcgctggttagaaatgctaaatctcaagctttgcagctgacctactcaatctaactctggtgtcagggccaggtaatgtgtgttttaataaggtctccaagtggttctaatgcaagctaaagttttatatctgacttagagtatctccattttgacagtcgccaaaggtctattttcttgttctaccaattgtaatacatcaaatatttctagttctacataactacaaaaacaaaataggtattatgcaaaaaagagaaccgaattgcctataattgcattacctaattaaattatcattttcatttattcattaagggtcttgccttctccacatgtttatataaatatgttcatataatgtctgcatttttacaatattataatctgaagtaattttaatctcaattattattacagcagtttgtcctattttgtatttttcctatcctcagaattctaatattttcctgtttaatttttcttccttgagaaactattcttaaaatgcttttttattttaaagtggcatgattatacaactgtcttattgtcattataaagtgcgcttcctgaagatggtaacacttttatggatgcctttaactcacaaactagtctacttctcagtacattagatttttattcttcttaataaatgatatataaaccactaaaagttatcctttgtataatttcccctagccctaaatcttacatgtttttaacttttgacaaaagtgtatgccatatattttatttaatccattaaggaagtttattcattgaatgagaatttactgagtatttgttctgttgggcactaagaatacaaagttgaagaagatataattgattaatgaagtagtaattcgaggggagttaaagttattacaaatttctggctggggtagttgggttgtgctatttcctggaatggagaagacagtagaacatgaattcagtgttgtttatatcaagtttgttcttaggaaaattacaaaatttttccttgtcctgattcttcatatataaaatggaaataataatgtctacctcatattatcattgagagtattaaataagataaaacatggaaagagtttagagtaattatttggtatatagaaaacactaaatacatgttagctattattattgtcattgagttttaggtgcctgtatgcattcaagtgaagatgtttcagacagttgcctatgagagcctagttttttagtaaaaagagttgatattttagattcccgggtaaagagagagaagatcaaaaaaggaatccagtgtaataccagtatttaaaggataggcagagagagagaaatattattgcacaaaggaaaatacgaatgatatttttatgcaaatatgggcaggcagcataaaccggttttttttaagtttgacctttagaaatagccattttctgtttgtgagtgttagcaaattacaggaaaatctacagtagttgtaaggattaaacgagtgcctaacaacaggcagcaaagagtaggcaacaacaaacgtcaaccttccctaccatatgtattaggaattaggtggaggatcccatccccaccacatcctcgctcaaggcttctataatttctacttagtaaccttagtacctttcaaaggctgtggtattgatctttgaattccttttgctactgtctggtagttgcccttctctcttctttactataatattgctcactctgctagataggaccatgatattatttgactgtagtgcaaggagatttcaggatatatcatttataggtatatggttttattaatatcaacaaaattaagctttttagcacctccacttaaaatttttagcttattcctctcttatctgtaggcgagatagcagttttgcttctgagaaaatatggctttcttcaagtattatcctccagttttggcagagatatgctgtaaataccagctgagatcccaaaatgtacctgttttcccctcatgaaaatctactgtaactagattttttttcctttgtgctttctttctgactgaaacttgtgatcagatttctactactagctctgccagtaataatttgagggaatctagctctaaaaattttaaaacttttaatttcttcctcttgttttatttcctcaaaaacaattgtgttgaggttgatgaatactaaattatcataatttaaacactaattaaaacaacaaggggatatatgtctagaaaataagaagtgtagtaatatgtcagtaataattattgtcaaaactacaggaatgttgccatctatcattaattgactaaaattagcttcattaactttgaaatgaaaagtggaaactgaccagtagtcttttcaaagtacttatatttattataggatgtttgttgaattattcagcataaaatcatctaagctttttagactaaacttagtacttacaaaacacacacacacacacactttcagagtagaaataaaagtgtgctgtaccttaacctctagagatatgtgtcttcaatggccccttagtcagccacctagtagatatggatgctttctctttctcacgtgctgtccaggctgtcactgtgggtaggatctgttaagagggttcccagaatgaggtctgaccagaggcagccttcgagccttagaaaagtggaggaactacttgtaaccctgtagttgggagcacgtgccatgaagctgtccttcggggttcttttatatatatatatattttgtactttaagttctagggtacatgtgcacaactgcaggtttgttacatatgtatacatgtgccatgttggtgtgctgcacccattaactcatcatttacattaggtatatctcctaatgctatccctcccccctccccccaccccacaacaggccccggtgtgtgatgttccccttcctgtgtccaagtgttctcattgttcaattcccacctatgagtgagaacatgcggtgtttggttttttaaagttggaaaccatcattctgagccttcggggttcttaaacttcatagtgatgaattatctttgtgtaactggatcccctagttttggagtttacacccttactaggattggctatatgcagattaactaaccctaatatgttaatccaaatagcattagtacacatgctggctctgcttccccacctttctgactgtacagatattcacatcaggcaaccctactgtaaaggtgctgataagatatgatgggtcctcactggtagataggcagtcttcctgtcctggtgatgataaaggctgcggttagaactgagacctgagtcacaattcaagtaattattctgagtaaaggaattaatggtggtattttctttatacttttgttttctacattgaatatgtattcatttttagtattaattttacaattagaaaaagtaataaaagttttgatgttttgaaggtttttttctggttaatttcaagtctgggagcttctctgatggtttccttttacccttccctgctccatacttatttaatgtaacccttacagatctggtttcctggatttattgctatcttccctattaaactcttgatgtcagtatgtttaaatctcatttcatctctgatatgctttttacttttacaagaaagaaagagattaccacatatgatataacttccagacggtttgtgttttctccccccacatcttaacaggttttcccatgttagtagatactgtgaatttacataattaaattaagttagttttgtctagatagtcatgtgatctttttgaatctcaaccatgcctgtgcttgaaaattcacaaatgaccttacctttcattctcatttaattgcagggagagagagggtttccaggtttggaaggacacccaggattgcctggatttccaggtccagaagggcctccggggcctcggggacaaaaggtatgtatcatgttgccaaccagtaatgccagatgaattaagtcatcttaaatgtgggactaggtgtcacatcaactaaaaagttactgaattatagcaagaaactaatatgtaaatgaaacaatggaatgacggggagtctgtactttattgtattttgttaaaaaactaaatattactgccatattcagatgcttttggaagatgctgttgattgtttgtagttattggctgccttcacaaaaattaagttctgtcaagagcttagctgagctggagagagctgaattaccagttgttagagtagctgattaagagaagaagccaaaatgaaagtaacagtcaaacctttactcacttactgcaatattataagcagaaagttaaactggagaaagtgctgactcccccactgttctatttgtccccatggtgcagcatcagcaaaggtcagatggatcagcacagatgttggaaatcatttgactgctgagggagctcagaacgaaaagctcctgcagttgtatggacccaggggcagggtgggagaaggagaagagctaggatggaaacgtactgaatcagagtgcagaaaaagtatttttatggtttctttctcctctcataagaaggtctccaccaaaagaggcctttaaatgcagaaatgcagttgagcacagccagccatggtagcctgaatctttgactgatacttcagagattgcagtgcattagctgtgcaccaagtttgctgtgtggagggtagctgtcccttatgaggcctaccaagaggactttggttggacccgaacagtcataggtgtttagacaagagccatattctcaattccataccttgatttttcaggacctgagtgagaaacataagctgccccatcatggacctgaatgggttggactttaaagggctctgtcaaaaaacaggataatatctgaggccacagtagattatggtcatgatcaatcatgttctaagcaggatgaacaggcctgcttggagaactgaatgtaagcatgagccccagctattgccaagccagtaatagatgtcccatagcccacttgatctacgttagagagccaggaggcttttttcttaagtcttatgatggattgttctactttgccagttttcattgatctaggtgcaatatgaggtgctggcaattccagagacccctcacagttggccagcaggcagctaagggctatatggttagctaacactatgtgggccaaggagttgaggctagtctgttttgtttccaaagctgaagtaatgtcattaatgacctcagcaagggtcaaagacaggttgcggacaaccttttctaattgagcgatgctcacagtgagaaaagttgtctggagtattcccatgagtagacagtaggtaatgccagctggcaattctcctgaataaccggagtctatctagttttggagttctcattttgttttatgtaatgttatatgcttaatgggagggactgttttgaatatttgagtatctcttatcaatgtcctattatgtatgttacattggtaggaatgttgaaagcctgatttttataaaagaaataataccccaagaagagtgcacacagttctgggaatgtaagagtcattggttaccatggagatcaaccagccagaagtccctcctggtgagcagagtacttgagtggaattgaaaaatttgtgtaaggtggaggcagaaatagagaaataaattgccaccaccatcgaggccaaaatggctccaatggcagatcatatgtcccttttcccagataattcaattgcttccatatgggacaggagtgagctgacatcccaggaggtattttcttcctgtggtatcagagtcaattgttgcaatctgtcagatccagtgtaataaagttagggtacatgaagtactaaaatggtccatgtttagagaaacgtccattcgtaatattcagcagcacagcaatcagatgtttatctgcagggttcagcgataggtgacatatccattagtttgtcaaaatcagaatcttgtgaactacccgggacaggcaatcaatgaatttagtaaggtggaagtcacaaggttagtctgtaggagaaagggaagagaggttagatccctaccttccagccccatggatcagccccatggatcagctcatggatctggaggtagtctcaacctatcagttgtggggactctgtcttttgactgccatgtgggcagtctgtcctataccatgagcaagaatagcatctcaatgtgcatattaagatatagaattggaagagataatagtgaacttaagactcagagaattttctgggtttttttttttaatgactcttttggcttagtgcctttttccatctgtattaggtagactgatgaattgatatatgaaagggctacttctcctcatttgcctggaaaggaaaactggcttaaaaccctttttcttaattttattattttatatgatggtggtacatcatgttgttacaatattaaggaaatcaaatggatactcaccaggtagtcttccagtaaagggagaaaattaatttaaatgcatgaatattttttaacacttaactataatcagagcttagatttggggagaatgttggtcatgatctctgggaaaataggattacatcaggtagttttgttagattcaagagcagaagggacctgtgctaaatttcccaagtagaactttagtacttagaaaacagcaggaccctgaatgtgtgcatacaattttggtggatgaactactcagctgaatttcctgtgtctaatggcacatcaagagcaagagcaacagaatgattcttgtgcacccaggagtagcacagaagtatcagagatatctgaaagagtcaagtggatggaattgagcagtaacttggcagcaatctatgcatactattggcatggaacaactcaatgaataccagcttggactacactgtcacactcctcaacatattggagctagttaagttctccaaaacttagacacgatcttgtgaaaatgaggtggcaactccaatggactgagattaaacttcagccatgttatagaaataggtgttttggaagagaaattaagttaagctacaggaaaagttacatttcttgtatctgagtttacttgggattagggactgagtttcttgcaccccatgcttgctgagagatggtagttttaataaagatttgtattaaattaaaataagttacctaaattagaattcctttgaaataatttagtattaactaggactattctacaataacatgatcatttataaaggtgtgcttgtatgcaggttaagtttagaaagcagtccaatctttttttgtgatttcatttcagttatctaaaaagagagaaggtaaactgctttctaaactttcaggattctgaatttgaagcattgtgtacttctgcatccagtatgactccatgtttccccaaatggctgaatttataccttttatgtgattgggtattctggtacatgtgtatgttaacatatatactaagtcaaaaaacttgtaggagtattctttaatatgcacactcgcaattttccaaaggttttttattctaaaaaatcaaatttagttaattttgataggcagtacgttcatgtcactcaagttaagagggtatacaatgaaagatctccttctcacctgtgtccattagtccctgagttacccacacacactttaaccacctttgtttgtaaaatagtagcacattaaacacactgtttgacctttgtttttaatttaatatacattgtagacatcctattatcaatatatacagaacctcctcattttgtataactgcattgtatttcattgtatatatgaaccataacttagcattgtatgtataaaccataaattattaagccagtcccctattgatgattatttaggtaggtttcaattttttgctattaaaagttcctttttcttggagcagaattaggttttttaattctatttttttaaagaaaatagttaacgaaaactcagtgaggtaagactaaattctcagcaatgcggttgtgactagaaatgggtacatatgttaacatacacacatgggtaggttcttttgcatggaactgacagctaggaaggaaagtttatggttctttttaaatcgttcttacgctctgccaatacaaagtgcattataaaacaaagcagaggtttgaaaacagcaaattcaagaacagcacatatttaggctcagagatgatgctcattataccagcatggcaagcagattaacataatatgggaactgcccagattttcagctcctattttgtttacgaataaattatttggggaatgactatatcaatattttatctttgttttcttgtatgattcataattaactgtacaggtatagagtttgattcatatgtcagcgatttccttctcaggaaataaaggcctttcttattttgggtcatacaatttacctcagtgctttcagtctcaataataaatgcttcttccttgggtgtataagtttttcactaactttcacagatgtttacagtagtttaaatctcctattttataattgaaaatgagttatttgaggacttttttgacggacaaaaacctaaaaatattgcatttttcagggtgatgatggaattccagggccaccaggaccaaaaggaatcagagtaagtagtattttctctatatcaaatactttgttggtggaaacagatagagaacaaatgaagtattatgagacaattggaaaagacccatattaaaagccaagaagataaatacagtcttcaaaaagttaaatttaagagttggtatatgtctataactagcacttctttagtattttgatagctattacatatatttttatatatatgtctatttaatataaaaggattttaaagtagcttatggttgagaattatgaaagtcctaaattctaaagtttgtcatttaattaaaaatctatatcatatagttggtttaaaccagaacttcctaaccagtgtgattatctcagcctaggtccagaaggctggttacctcaggctgtgtatcctcctagtgtaccatgtataaacattatcatttttttgtgtatctagaagagaataagtttagtttaaaccactgtattaaagaataactatttttggaatactgcatttcttcaaatctaacgtgcatgacttttcaagtcttgaggctctgaaaaataaggatgcatctcaaaattgaaatgtacatttagtataattttttctcaaaagcttttaagttgacatatgtcttacagtgtattttacaactgagaggaaactgtagtttaaaaaatagtactggcttttaaaaaatcacatttagctttctgaccctcagtttcttcatttgttaacttaagagagctaaagagaacaatctccaaggtcccttttagctctgaaatactgtgttcatagattgatgaagctctctaatttgaaaataaaatatatagttggtgacatagcatgtttacgtgtgtgacaaagataaccatttgatcatcagaaatttagtagatgcataattttacaaacattaaaaacattctgtttgctatatacttcttaacatcatgtagcttgccttatgtgcatcttgtgactgatacggatagggtactggagaagcagggaagaaacttaaaacccttagtttatttcagcagacataattctttatttttctgttaaaaattgatatcaatatactattaaagctctttataataataaaaataatttttaatatccctatagttaacattaactatattctatattctaagcactattgagactaaaaagaattggctattttctcagtttccattgcaggtgtttgagattgcttggatactccatgtccctcaactagaactccaagagtgcttgggaataggtggcctgatagtttctgcatcctcaggtgtcagctcacaggcaattcttgacacgcagaattttgaagacattattgtggaaactgataaatgtatacaaatgtacagagcatatagtataatgaacccccatgaacccatcacccagcttcaaaaatgaacaacattttgatagttttgtttaacatataccttaccactttattttttgaagtattttaaagtaaatccctcacatcattcattctaccaatgaaaacttcagcatgtccctctaacaaccacgtaacaactaaaccatcatcatacctttaaacattaggaatagtttttcagtactctgacgttcagtccacattgagttttcctcagttgtctgaaagatgtccttttacaatggtttattcaatttacaacccaagcaagttccacgtattgctttgggttgctgtttattaagcttgttttactatgccatcagaaaaactgggtcattgtactgcattccacattctgaatttggctgatttgtttcctcatgatgtcatttaaattgttcctctgtcccccatatttcttgcaaatttcacgttgccttggaagaggcactaaagaactttctgggggtacagaactgtacgcttaagattagtatattttgctgtgcataaatcatactgcaataacattaaagaaaataggaaaaagtatactttataggtagtgttgtgaacttaactattgaataacattatgcagcatgaatatcaggctattcttcttttttttttttttttttgatgttaggtttgatcagtagtctcagataacattagcctgattctgccatcaaaaatttccctgtcaactttgactaatgatttggcacccatggatggtcattattttgctcagacttgcaagatgctgatttttaaaattctattaatcattcatttattagctggaattctaataggacaatgagttgctacaccagaaacttcaagtggtcatcaaggaaaattcttcaactttttttttttttcattatatgcacatggaatttgtgtgtttcaatcaattttagtcatttttttgaaggccaatttgtcccatcttttgcctgtgaaagccttttaaagttgactcctgtcctgtgctcttttcagaaaactccattgatctttcataacttctccctttttgacacaacaagctctttcatgctcatccttggcatttcccctttagatctgaaatgggacatatctctgattccaggttctttttagtgaaaaatgtgatttagataccacagcctgaatgttagggttttttttttttctttctttcttttttggagacggagtctcgctctgtcgcccaggctggagagcagtggcgcgatcttggctcactgcaagctccgcctcccgggttcacgccattctcctgcctcagcctcccgagtagctggggctacaggcgtccaccacaacgcccggctaattttttgtgatttttattagagacggggtttcactgtgttaaccatgatggtctggatctcctgacctcgtgatccacccgcctcggcctcccaaagtgagcggtttttattgctactcgatttgtcactgtttcaatgtcttctcagtggaaatatgtatttttaagagaaaaattaacatgagttcatattattgcttccaattgcaatttaaaattaagaaaggttttgtatacttattatctcttcccctcatctctctctctattgaggtgaaaatgttcattcctaatatcataaatgtaatttcttatttgctttttcctacaatatgcctatttcctacaatatgctttaaaataacaatgtataacttaacaaaataaaaatttaaattttaatagtgatgataggataataggattcttgaaaaccattaattatttctttgttgagttttccccctttgaattgaccagttttgctaaagaattagagttaagataccatgtttgatgaaaggcacttgaagtaattcttttctctgtatggttttgtcaacaacttgaaacagacgtacactggatccaatttatttttcatttttaatgatttcctttttaccttttttaaaattttaaattatttaaaacatctacgtggttttataagacaaggtgtagtcagagatgcttctctttcattcttgccatttccctagtgttttaatcttcctctgagaggtaatcattagtttttacatagtaatcatagttttacattatgtgaatgtgccataatttatttagtcatgttcctattggtggtcatttgagttgtgtattagtctgttctcacactgcttataaagacatacccaagactaggtaatttataaaggaaagaggtttaatggagtcacagttccacatggctccggaggcctcacaatcatggcagaagatgaaggaagagcaaagggacatcatacatggcagcagacaagagaaaatgagagccaagcgaaaggggaaacaccttataaaaccatcagatttcgtgagacttactatcacaagaacagtatgggggaaaccacccccatgattcaattatctcccaccgggtccctcccacaacacgtgggaattatgggagctacaattcaagataagatttgggtgaggacacagcaaaaccatatcaagttgtttctaattttaactataactggttacatggttgtttctaaactttagctataataatgctgcaattgttaactttgtttctcatattttgtttcataatttctagggtatcttcaggacagattcttagaagtgaaatgctaggtcaaagggcaaatgcatgggtaattttgctagatattttcaaatttctctccatagagtttgaatcttcattagcagtatatgagaatactttttcaccatagtctcacctacagagaatattgtcaaacttgtatttttgccaatcatgacagagaaatttaagaattttgggggtgatcactattaatgtcttcagtggaaatatatttgccactcccccatcccctgctgaattaatttttcatcacaaacctgggagatccttatccattagaagagacatttcatccacgaatttgcctgctcctaataagtgcaatgaagacaatgctccctcaaattgaagtttcttttatagttttcaataaaagagacttttaaacacatgtaagagatttttctctaatgtttcaaagaacaatgagtagtaataaatagtgagacacaatttttccaaatctattctaaaataattttcataatatccttaggtaggatattattttatttttatgggttgtcatttagtttaaggattttatttcttcttatagggtcctcctggacttcctggatttccagggacaccaggtcttcctgtaagtagcatttcactttttactttgaaatctcttgaaaagtaatctaagacatattatacatgtgttatgtcgcttttcaaagggaatgccaggccacgatggggccccaggacctcaaggtattcccggatgcaatggaaccaaggtgagatccatccatttaatcttgggtagtatacttgacaataattaacttaaaaacctaaagaaatcaatatgaagaatgtagaagaagggatatagtgtcttcaggtcttggctattacataaagtatgctctgactataattttctatatattgaactatcaataatttcattaaacatgtataattagctgggatattgcattgggttaaagattacttaccaaacccttttttgactttagcataaagtaggatgagaattaaaacgaaattaggatatatatgtttcaaatattatatcaattgttgaaagtaatacttctgaatgtcattcatttgctttgccattattaaaaaactaggtacaatttatgttttcaaatatttcatgtttttaagattttttaacacgccgaataacttccttaagaaaaatcttaaaaaattatatgtaatacagcacatccgtttttactataaactgtcagtatgaaacctgaaacttcttcatcagcaaagatgatacatttaacaattttaaataaccctaactttagatatagcaaacatttttttttctgatccaatgtttcttctctttagtcaactgttggattgaatataaagtaatagataataagaaaaaatgaggaaaatttgctctgcttgtaagcttacaatattatagccaattcttattccctcccctttctccttttcctttaggttaatgcaatatattgttattctctgtattttcttttggtattttctgtttttcacataatattctgtaaaactattcataaaataccttaggtccttctttctttctttctttgtttttgtttgttttttgttttttgttttttgagacagagtcttgctctgttgcccatgctggagtgcaatgtcacgatctcggctcactgcaacctctgcctcccgggttcaagtgattctcctgcctcagcctcctgagcagctgggattacaggcacgcaccacaatgcccagctaattgttttgtatttttagtagagatggggtttcaccatgttggtcaggctggtctcgaattcctgacctcttgatccgcctgcctcagcctctcaaagtgctgggattacaggtgcgagccaccgcgcccggccagatctttctaactaatggcatatgtcagattttatatagggcatatttttaaaataacttgaacaactattttgcattacagtggccatattttgtgataattactgtactctatacttgaggcagtacagttcttttcatctccagtatttcttcaggtcaatgtaacccttgtcaataataataatttttaaaaaaaattttggattcatgaggactaatcgtgttcttcattttagctagggcaaccttaaagtgataagaccaatgtggagttggtttgcctgatacatttcatgttaaattggactaaatttttgtgcctcttctggttatttgtttatttttatttacttatttatttttgccagtgtgctttaagaaacaaacagaccactaaccaaagtttcaaatttgaagggccaatgtatctataatcagtacagtgtgctatatgattaaagggagcattgattaacttgtgtttcaggcttccaattatgtgagtaacaaattttaaacaaattaaattgatttattatgcatatttttaaagtctgaatgcttttcttatatttcttactatgtaagtaaaagaatgaactttaaagttggagccacaatgtataggtttttttctttttctgtcttttaaacttgatgtctaggccacttcctttctctcgggacctactttttccatgtgtaacaaggtggagagaagggtattggactcacaaagacacacaacagtagtaattttattctttcaaaccttctgatgaagttgtttctaggattaccgtggcatacaggtatttgaaaggaggttgctttggtgttcttctacagcaatttcagcttttgttttctaaaccaagtgtccatattagtactttacagtagtgagtgagaaaagctgggtgcctagaaaacataatgacctgcaattgctagaactattgctattattgtcctcttggtgatattaatggccttctttcttaccatcttttcccctttacaaaaataatttgaaatagtttacaataaaagaaaaatgcaacagagcagttaaaataagaatctatataacacatgggcaggaaatggggcagatcattaactattaaatgtgatgatagaatttatggcgtgatcgtctcaaaatgtctttgttggaagaaaagaactgaggtagataattttttttctttacttctaattgggatagatgaattgggataaaagttgaattgatatggatagttgatattgaagtaattggaaagtgaaggctaatgaactttttggcaatctggcatgtttcaaaatggcttttatagaaatcttttcaagaagtcatatcttgatggtatagttattctttgtttcttgttcctccatgctctttatttttaactccttctagggagaacgtggatttccaggcagtcccggttttcctggtttacagggtcctccagtaagttataaaatttgggattatgatgaacacaggaattaacaaaagaagcagaaatgtagtgagagagcccaatgcattcatgtggaacaaagtaatacattttaaagtaataaactagaggaaaatgtttcaaaaagaagttggtaatatagctttctcctgggcaaaagcaaggattttgtatgtatataaatgtcacctctaagtatcctaaggtatatcctattcagaaatgacgctacagcagtctactcattttatactctatttagaaagcattctgtaattggcgtgtttctctctcatacatataaaataatcccttttctttttaataatagggaccccctgggatcccaggtatgaaggtaagcatctcattctggggaacaaatgttttgaataaaatattaggaaagctggcaacttcaataggataatgactcaaacttctgtcttaaaatcgatgtttctagaagttgtgcaggtgtaaacttacaagctctccttaagtagtctcctgtgttcccatggctttaagtaccttgtatgtgctgatacacttgaaaatgtgtatatcagacttgagtttctttgctgacactttaagtcttcatcttcttacactttgatacagttaaccacttactctctgtagaattacttttttccctggcctctgtgacactatcctttcctgatttttcttctacacctctggttaatttgcagtcttctatgtaaggtcattattttatgtccatcaagcatcaggtcacagtctgtactccttccctgcaatgcccagaaatattactaatgcccatattattgattactatctagttactaaataccaaatgagacttttcttctgagttagctatgtgtattcatcagcctctctgacatctccacatgttccaagttaatccacccacaaaataaacccgctcctccctgtggctcctcatatctcaaatttgcatctttatatgttatgtacacttttacacgatctcaaaacctgggagttaatatttatatcttccattccttcacccaccacctcattcaattccatcactaaacactaagtgtgcctgtaaaaggcaccttaaattcatccacttttcttcattcccactgttaccacgttaatcataatgtctcatctggattactgcaataacctcttacgtagtctctagtctctttttttcaccactactccgcccttacctcccatcctgttttattctttacaaagcaaccaagaatgacattttaaaagtgttcattgataatttaatatgcttataaaccttcaagggctttctactgtgtatctaaggtaaagtccatagtttgtttgtaagaactgcatgctctggtccttgcctacattgacagccttatcttaaaccactaaacttatcccttagctcactgaccacatcagtctgcatttagttattgggatgtgccaaacgttttgcttttagggtcttttgtatatatggtttactttgcctaatattcttcctcctatctttgcctggatgactccttattatccttcaggtcttaacctgaatgttaccttcacagattgcccttctttgactacccaagctaattttctccactagtttttttttttcaattattgtaccatgttatttttcttcatagcccttaatattcacagcccttgatattgtcatcttatatttttacatattagggtctgtattttcccattatattgttagctttatgagaacagaggccttgtttatcttctccattactgattacccagaacctaccacaattgttggcaaatacttaatatttactacatattttttaatgagtaactgaaggtactacactcttaataaatctactgttcttcagtgtactctggccacttcctcattttcctttaaaaggtaaacttatcatttttattactgagatggcctaatcttttagtacatctctgttacaaattgaatcttcagatcatttttctggttttgctggttttcatgtataataactgtgtcttagaacttccattgatggcttcttttagggtgaaccaggtagtataattatgtcatcactgccaggaccaaagggtaatccaggatatccaggtcctcctggaatacaagtaagtatccagtgattttctttttttgctatattgattaaaccagaagattacaacaatccctcaacctttagtactctctgtttttgtcataaaaattatcatcagatgtttactagacattacatgtactttctacctgaaaataaaagcaatctggaccagggagaattttaacaacatcggcttcattcttttgcctttctatccagtgttttggggattggcagcagaaatagggttctatattcttattcttgtactgtggagagcagtagggtcttttgtacatttacaaaagacctaattaaaaataaaaattatggaagtcccattgaatatattaagatatatcatttgtaacactatcagttatgcataatatatgaacatattttgaaggctgaaggaatacagtttatgcatggtgaacatcaaatgtaatcttaagaaaaaaattttagcctacagaaaacatgcatagagagagcagtaacttttgagtatagattaggaggtcaatttcttagggtttatatttcatgataatcgaatcctttgccaaaaatgaaaaatcaaaacttcctggtagtttatcactaagatacaagattggggacttttttcattagctaccttgtcattccttacttgatatcacccatccatagtttttaaaattcactcaatcttgccctttatattttataaattgttatgaagtaatatttgaaaatacaacagaatacatgcaaaatatatgtatgttatgaagcataactataaagtgaacaacatttaagagctagaaaattacaaataattttgaatcaacctgtgtcccccttggtaatcaaatccttctgcattcccccaagacatagctaccatctgtgccttaaaaatagctttattatatatgcatatatttctaagcaatagaatatttagctttgctttataaaataatgtaatatttatgtagttttctgcaacttactttttctacttgatatgctaagattcatccatattattggatatggctttagttcactctgtttcactttcatataactttccatttgtggacatactaccatttggtgttttttgttttatgtggtgtttgttgttgttgttgttgttttgagatagcatcttgcactcttgcccagaccggagtgcagtggcatgatcatggctcactgcagtcttaacctcctgggcttaagcaatcctcccacctcagcttcctgagtagctgggaccataggtgcacatcaccacacctggctactttttgaaaattttcgtggagacaagttctcaccatgttgccaaggctggtctcaaacatctgagctcaagtgatcctcctgcttaggcctccaaaagtatgaggattacaggtgtaagcctctgtgcccagcctacaattttttcattacaaaaaaaaatccatgatttatatctaagtatagaattgctagattgtaggccaaattttcagtttttaacatgccaaattattccataacacttgtatcattctcttataatttatcccagttcctctcatttccctctgtctttaatcttatctattttaaaattagagaagctatcttgaaagtagtagcctttcccttctcattggtagcataaaagccctaactaaatgcatacctttatcactttgttttgtaaattttccttattatttgtcttatgtttatttaccactttaaaccacaagttttcttataattacttaatccttttatccctttgcattttaaaatttcacttataatattgctgaatgataaaattgtagagcagaattccaatgacgactgaagtttaaatgaagtctaaatttcatccatttagttctttgtaagatacaattagggggccgggcacagtggctcacgcctgtaatcctggcactttgggaggccaagtcatgagatcaagaccagcctggccaacatggtgaaaccccgtctctactaaaaatacgataattagccggacctggtggcaggtgcctgtaatctcagctactcaggaggctgaggcaggagaattgcttgaacccaggaggcggaggtcgcagtgagttgagatcatgccattgcactccagcctgggcgacacaagtgagactttgtgtaaaaaaagaaaaaatacaataaggggcttgtttttcttttttttcatcattttctttactcactttataacagggcctacctggtcccactggtataccagggccaattggtcccccaggaccaccaggtttgatggtaagctctcttctttaatttaatttccccccctttcctttctgacttctttcaggaatattaatattatttataatacttgaaaacataatgcattctcaacattcataatttataattttcttatgtaaaggtgactttacaatgatatggtgaataatatgcattctaagtaatggctccattttatagatggaaaaatgaggtatataaaaggaaagatttacaatgaaatattttgttggttgctcttgatgtatcagtgttgaagtcaattctggccatttcagaaagtcttttaaggcagttttctaatcacttgatgaaacatgtttcttcaaactgcaattgtttgtttaagaagagcaaaagcagggcttcataaaaaatattggctctcatttcctaggcgcctgggacaaaacagtagaattggtgaggggagtgatcactatgcaattggtcacaggtttttgtaccccaaaaacttctacagatcctgaatgtgcaaccggttctcttactttactagctctgtagtcactcttattttctatcctagtaaattctaagtatttttacttctgcaatacttagatttcattcaagtcatgttttggacttacagctttgctgttgccctcttaaaagggcaagaaaattgtatttcagtagaagtaatttctcatgtgccactctatctctcatctaccatatatttaagtgacagttttcattatacctttataggttgtacatttttgtttgtgacaattggtcctgcacttttgagtgaaggaaataatgtttgataactgctagaagaatctaccagaaaagattgtgatttctgctttcctgtaactttttgggggaagatgagaaaacccttttgtttgttttagttgtagacttcatgcaaagcatgaaactatggactttcgcactttttcctaattctgctgttggaacattggtgccccttgagtatattgttacaccttgaatttcctcaaccattgtggccacttaaccgattcactttacgtttctggatattccttgaattaacgctaattcaacaggtgaagccaaatcttagaaatgccaccaagaggccaggtgctgtggctcatgcctgtaatcccggcactttgggaggctaaggtgggtggatcacctgaggttgggagtttgagatcagcctgaccaatatggagaaaccccatctctactaaaaatacaaaaaattagccaggcatgatggcacatgcctgtaatcccagctactcgggaggctgagacaggaaaatcgcttgaacccaggaggcggaggttgtggtgagccgagatcgttccattgcactccagcctgggcaacaagagggaaactccttctcaaaaaaaaaaaaaaaaaaaagaaagaaagaaagaaagaaatgccaccaagatacaatatataaataaataggcccattgaggttaagaggcaacatacttgagcagaaaggtgcctatttaattttttaaaccttgaaacattctcagatacacaaagtcatattgtataaaaatcaaactggattttaaaaaataaacacatgctttttagaacttgagagttaattagagttaattgctttatggtacctaagtttacctataattctgatgtgaaaaatttgatgggtctgttgagattaacttttgaattgatttttgacaatggggctacctctctacctctgcccatcccagcttttttctcttgcccatttctattttgtcatcagaggtactcacattcatctagctcattttaatcaattaaaatgtgtgtctctgactaaaatgaaaacaaacaagaaaatactattttgatgggctttttcacaccttactctttctgaaactaaataacttttaaaattaacttattaatataacattttattttctcttttgtcttctcttcttagggccctcctggtccaccaggacttccaggacctaaggtaattttctttttctttatatcttttatttggtgtggattccttttcttactgtcagtgagatttttaaatggaaacttctctctccaggggaatatgggcttaaatttccagggacccaaaggtgaaaaagtgagtaaagaaagagagctggttattcagccctcagctttctctttttgtagtcatttgaactgtctttttctttctcttgcttcttgaagttatcttatcttacatgttatattactgtctgtggagattatgaagtatcaccactgtcttattttatcttgcaaacagggtgagcaaggtcttcagggcccacctgggccacctgggcagatcagtgaacagaaaagaccaattgatgtagagtttcagaaaggagatcaggtgagtaagtagggaggaagtcaatgaaaatcttgctatggatatgttaattagtttgatggtggtaatcacatcacaatgtatatgtatatcaaaacatcacattgtttacaccttagatatatacagtttttaatttgtcagttatacctcaataaagctgaaaaaaataaaatgataaaaagttaaaaataatatttctatgtaagtggaattccattaaaatgcattataagctgaaatgtggttatatataagggtatttttttttaaataacaaggatttgagattattaattttttttttttttttgagactaagtcttgctcttgtcacccaggctggagtgcaatggcatgatcttggctcactgcaacctccgcctcccaggttcaagcgattctcctgcctcagcttcccaagtagctgggattacaggtgcccaccaccacaccctgctaattattgtatttttagtagagacggggtttcaccatgttggccagactggtctcgaactcctgacctcgtgatctgcccgcctcggcctcccaaagtgttgggatttcaggcataagccaccatgcctggccaagatcattaaattttcaaaataactttatcaagatacagtctacatacatataatccacccatttaaagtgtacaattcaattttttttttagtgcattcacagggtagtgaaactatcagtgcaatctaactttagaaaattctgaggcttcctcaaaaaaatctccatacctatgttagttgtactccttatttctccccaaattgaccagccctaggtaatcactaatctacttcttggctctgtaaatttttctattctgaatatttcatataaatggaatcatacaatatgtggtcttctgtgtctggcttcttttacttagcatagtgttttcatgttaaatcactttgcagcacatatcagtgcttcattcctttttatggctgaataatatttcattgtgtaaatagtctacattttgtttatccatttattcatcagttgatgggcatttgggttatttccatttttggctatttgaagaatccattcatgtataaaattaggttatggtaagtcagaatgatgacagtgttccctacatttcactgatatgcaaggagaaagataatgttactctataaacctttgttgtgtttagaaataattatctgataccctgcttttgctagagtagatgagggaaattagatatatttttaaagcatactggcccacactttaacaaacagaatgtgtgcatttttgtttcacttaaatgtgaataagaaagttaagaataaaggaaaagttgtattgaaactctatcatcaatatgaatttggccatttaattatctcccaaaatatatgtatgccgtgtgaccccaaaatctctttgttttaggtattcttgctttttataaaatattttataagaataaaaaattgtcattattttcattttaagtgttgccttgttatttacctcaaatcttggcttgtatatagacaaaaaattaactgaaatgagcaaagatagctctagttaattttgcctagaagatttcaactttaagttagaaacaccctattatctttggttgtactacatgagtattcagttcagtttaatttttttagggggagatttatttttattttattttattatttaaaaaagtcaacctttattttagatacagggggtacatgtacaggtttgtcacataggtatattgtgtgatgctgaggtttggggtacagatcccatcagccaggtagtgaacatagtactcagaagttagttttacaagtattacctgcctccctctactcttagtagtccccagtgtctattgttgccatctttatgtccttgtgtccccaatgtttagttctcagttataagtgagaacatgtggtatttgattttttgttcatgcattaattcacttaggattatagcctccagctctaaccatgttgctccaacatagatgtagctgtggttcagtttattaaaaatgctcctagctagctctagtgcttagaatgaaaatgcatgttccagtattaacattgatttcctttcccctactactgcatagggacttcctggtgaccgagggcctcctggacctccagggatacgtggtcctccagtaagtacctaaagtgctttagcatcatttaatgtaaattggtattggtacacagtatcccatgaaccattgtgaaactatttttatgtgtacagggtcccccaggtggtgagaaaggtgagaagggtgagcaaggagagccaggcaaaagagtaagtgatgtaactgctaatattctttgcaaaaaaattctaaatgtgtgtgtgtgtgattttattctttcttcctacatcttccattgtttcaaaatatcactactgacattataatgttgatgtctaaaaagtctacttaatatagtccaagccaggaataaagcttgttatattctttaactttatgcttcctaactaacaaatgtatgttgttgccctatcatttctttgtatcctatagggtaaaccaggcaaagatggagaaaatggccaaccaggaattcctgtaagtagctaaggttctttccccctgcaaaactggagacatttatgtgttggtataacataaggtggcagagaagcagtatgacaaaaattgtggggtctggaaatagtttaaatgaattgaaattatccagtctttgtcttttgaatataattttcaatttttaaaaaattttgtgagtacatagtaggtgtatatatttatttatgaggtacatgagatgttttgatacatgtatgtaatgtgaaataaggacatcacagagaatggggtattcatcccctcaagcatttatcctttgcattacaaacaatccagttacaccaaatataaatttgaggttcctctattttttaaagtcagatttattgagatataatttacataaagtaaaaggaactatttttagtttacagttctgtgtttgacaaacacatacagttgtgtcaccaccaccataatcaagaacacttccatcaccttcaaaagttccctcatgctcttttttagttatcccctccctattcccctatcccaacccccttataacgactgatcttttgtcaatctctttaattttgcctattcccaaatgtcagatacattggatcatattgtatgtagcctttcgaatcaggatcctttcacataacataatacattgaattgtgtatcagttcatttttttattgctgagtagtatttgatagtttgaatataccatggtttgtttgtccatttacacattgaaggatattttggttatttctgtgttttggccattatgaataaaacttttatattcatataaaaatatttatatgaatataaatattcccatacagtttttttgtgtgtgtgtgaacatgttttttcagtaaaagttttgacaggtaattcttctacttactaccaaaaaggggcatgggaaataaaatatgtaagtccaagaacattatttcaagcagcttcagtatcaagagtatccgcagtaggcaagagtttttcaaagacagagagaatatttgatgaaatttgtaagttattctaagggaaaaggataattcttaacaagacaggttagaattactaaattcagataaattggtttcaggatattttactaaacaggcaatcctcaacttacaatctctagttcaaaaatattttatattataaaatatcaagaggtaaattcagggcctcagttcctggcttcttttggaacaattggtctttgtcttgattcaggcagctgtgatattcaacaattgcctcttagtgttttcaacaaattggggttgcggggtggggaggctgttctcttgttctctgtttgcactgggagaacccaagttgggtcaaataaaggcagccttgcaaatagccttcttttgaaccagcagacagatcaaataatgataattctctggatatggggctttgaaggagctccaaccctgttctttcctctccaattgctgctaggctgctggttttcaccttgattgtgaggagaggtggtgtgaatagagcaagttaaaatgccacaaagctctgagaggtggtgggaatagagcaagttaaaatgccataaatctctgagaggtggtaggaatagagcaagttaaaatgccacaaagctctgagttctcaccaagattcagctttttttttttttttttttctgagaaaacactccttgaattgctgcaagctttggttaagttctgaaagttaattctgactgaccatttttgccagtattctcattgcttctatggagaagacaatctttggagatttcctaacaccatcatttgtgctgatgtcaccctatcctctatgttttaaagggtttgcctggtgatcctggttaccctggtgaacccggaagggatggtgaaaaggtaagaattttaatactttgaagtgactggtttagtctagctaaaataatccttttcttctcccaggcttgagttataaatggaaaaagtctacataactagcttttatattcaaaatatgccttctttattcatcttttgctcatttttcttttataccacacttgctaaattttattccattgccataaatcacagtccatgttgcagaaatacattaagcattgtttaactttagcatttccactgtgaaaagtcattgcctttactttgagcatgtatcggcaaaacttctttttttccacaaagagaattcagcactattttagtgaggtcctcttactaaaaaggcttataactgtgaatgtagaacgtcgccactaaacatttccattctgtatgcaattattgtctgtaagtctgtggctaattctttgttgttttttcccccctactgggccaatgcagtctgactgaggtcatttatttagttacctatttttcaagtgactttgaaagattgtatgaagcatacaattaccagatttttagcagggcacaaaataaccagtcctccaatccctcttgtttttaattgcttcgtatcaaaaactgaaagctttttggtttttcaggcaaggaaggaaaggcgttacaaacttgaatgtacccagaaggcacatattttaatggtggtttatttttaaattaggtccaagttctagcatggcttaaaaggcacaattagaatagatggaggtaggaaatactccgataaaatgattttttgtcaaatagtatttgtatatagatggatggcttctatgaacaagtttagagtcagaatagaagtatgaaaaagaccatccttgtgtcttggccagtagtagagtaacacttgaatattgaatattgtggtttttttcatgctgttgtagctactaatcaaggataaaagttttatctgaacttgtctttcattagcttctaagagcaagctcatgaaagcaattcagatttactagctattattgatgatagttaagtccatcacatctaaaatgtctgtcactaatagaaatggcactacatttatgtccttgactagttttatgagaagaaacatggctaaatgtaaaaaaaaaaaaaaaaaaaaaagtaattttttcactgattctagtgctaccattttttttctattatcttctttatagagtatttgtagttggctagaaataggaatcttaaaaatcaaagaatattacaactagaaataccttaaaactctggtccaaaaatctttattctttctatataaaccagagaagttaattaacttggtgaagattacatagctagtaaatctgagacaccatcacaggttaggcttagctcagaattgtttcattacttcatgttgcatttctcatttgaggtattttatgattgatttctgggtctttttggaaagtttctcttatattcttgaggaaattgatgttttcatgtgaattttactaacctattttacaattgcattgaacagggccaaaaaggtgacactggcccacctggacctcctggacttgtaagttttttttttttagtcttcgtttatcaaatttattaatgcattatcatttttgtgccttaatcgcatactccctactttttcttgatagaacacaaaatttcaagtcattatcaatttctactggcttaaaagtctttacatctaaaatcttcagtaatgttgacctcaaggtctttgtattgttctgcctatgcattacttctgcatggtaaaggtctaaaattatggcattgggttgttttgcctcatgattgccagatcatttctcaagcaaccagcaggtggtgcaagtgttgcttacaaaggttcaatgaaaacaacaacaacaaaacaaaacttggggaagttggggtgggggtgggggattggtcctttcccctgcagagctcaggagaaagatagatttggtcttaataggttttctcaatttgtaattgtctgattcacacttctttctttcctgagtgtgtgctttctagggacttttaataacgcatgtaggaagctgctttatgaaagaataattgagggtggcggagctacagattttctgtcatgtttgtgttcactatgaaatttaagtcaaatatacttccagtcttattaggaataaaatatcattgctgaggtttaacatattggtttttctttggttgaaatttagtaagactcttgacttcaaactgcattgaagccgcaacagtgcgaatgttggaaaacttatgtgtccagacatgttagtaacattaacttaattcgtattatccataatgagtctcagttattaatacttaggactgtactaaatctaatgaggatatacttaaagaagatcttagatattttttattcactttcattttaaaatcagcttcagtcctctaggaaataatctctttataaaatgagaagataaaattttaataagtatcagaagaaatggaaattttgagagtacagtcctatttagcagcctagtttcccttttgaatcactattccaatcttaggtcccacaactttttgtcttcttttgtgtgaatatttcttatatccatccaatagagacaggatgaaatatcacactgctattaggtgttgatttgtacatcagactggcagtctcttaaatctgaagttcatttacctttataggtctataagaagaatttgttaatatttaatttatttaatattaagttttttaagaaaatacttaatgagttacaagaatacagagtaaaaagaaatgattagttagttgggtttaatcaataaagaacatgggttttatttttaaatttttttggtatatagtaggtatatatatttatgggggagttttcttttttaaaggaagaaataaatgtgggttaataaagagaaagattggggaaaggcattacacatgtttggaatgaaatatgcaaagacatagacaagaacgtgcaagttgaatgaaatggttagaatcagacagacttcactataataaaaatttattgtaagacgtagtaggagattaaataggtgagagaagtattggaagtgagaggtgacttacagttcaggattaaaagtagcagcacttatagtaaaaagtagtgagcaattttgagtccttaagcagaatagttaacacacacacacaaatggtttttgaggaagcatatcctaacaatagattggaattcaagggacaagatcagaggtgcttctattactctaagtgtgagttgataatatagctgtggcagcagaaatcaagggagcaaattggagagacgttttctgtaaagaattgtcaggcttaggagattggaatgaattgaatgtgaattataggagaagagacatcaaaaatacttttagttttatatgcttcgggctcaggaacatggtaatgttgttacttgtattggacattttctaatcagttggaggatgggagtgatacaaaatgtgactcataaactatgtgaaaatgatgacattgtaatcatatgtagctcccataatgttttcaggagaacaaggcttttcttctttgcatttctttattttttttttctttggtaataaaggtaattcctagacctgggactggtataactataggagaaaaaggaaacattgggttgcctgggttgcctggagaaaaaggagagcgaggatttcctggaatacagggtccacctggccttcctggacctccaggtaaatgagattgcatttatggccttgttcttatagcatccttactaatccatgtatactttttatcacattagttccatggtcagcatggaagtaggagacacaagtcctttttaattgacagatacttcccaactcttactataccttctctcaccatattactcacttgtactttaaaaaagcccaagtgaatagtgtcctttaatcctaagattcctatttctacattttattttttattgatacataattgtacatatttatgggatacatgtgatattttaatacatgagtccaatgtataatgattaaatcaaggtaactagaatatccattacctcaagtatttatcttttctttatgttgggaacattcaaaatcttctcttctagctgttttgaaatatacagtaagttgttgttaactgctgtgaatctactgtgctaccaaacactgaaacttattgcttctatctaactgtatgtttgtacccattaaccaacctttcttcatttcccccgacccttcccagcccctggtaaccatcattctactctccacctccatgagatcaactttttttttttaacctcctacgtaagaatgagaacatgcatttgtatttgcctttctgtgcctggtttatttcacttaacgtaatgtccttcaggctcatccatgttgctgcaaatgatagaactccgttcttttatggccaaataatattccattgtgtatttataccacatttcctttatctgttcatccactgatgaacattcaggttgatttcatatcttggctattgtgaatattgctacaataaacatggaagtgcagatatctctttgaattactaatttattttcttttgaatatatacccagacgtgagattgttggaacatatggtagttctatttttagttttttgaagaacctccatactttttttcataatggttgcattaatttacattcccaccaacagtgtgtgagagttccctcttctctgcatccttgcagcatctgttattttttgtctttttgatgatagccatattaactggggtatattttattattaataaattacaccaaacaattcttaatttagtaggcaaatcatcacacttttcatgctaatagggaaggatattctccccaagtaatgcctagttttgcaagatttcctgtataaaaatggcaagcagcgttatccacctaaaatttcagaaatacctaactagaaatccccatggtgattttgttatacaataaaatcttagagctcaatactgagttttatattattccctttgaaaacacacagtatagtggaacatttctaatttggccacaaattgagtactgcccttatctagaatgtttatttgaatgttctctgaaatagggtaataatagtgatttccgtaagatttctagatgcatgtggtacagtgcctggcacacatacatattcaataaattattattccttttccttcaaaaatacgtggctaatgaaatactaaaatgatgagatgagtgatattcagtgatctttcccaagagaaagaaaataaatataggttccattatgctctaaatgcaaacttcagattcctaaatgtgaacttcagattcctaacctcaagatagtgaattaaatacagactgtatctggaaaattgaaataaagaattatctcaggatgcagtaaaagagataaggagttgggaagtatgaatgaaaagttaagaggtatgaaagataaacctagaagctccaaaattatctcatgagggaggtcaaggaggagagaatgggacaagaggcagcatttgaaaaaaaataatggctgagaacttccatctattaaaaaacacatgcatcactatgaaaaagctcatgaagcactaagcaatagtaaaataatagtaatgcaaaggtccataactagacacattgtagggacatttcagaattcagggataaaaagaagctcttaaaaactatttgagaacaaaaggccaatcacctacaaagcagtgagtcagaggatgataatggagcacattttcaaagtgataaggacaaattactatgaattagggattctgtattacattaaactatcatcctaatgtgaagatgagatacataggaagtttaacaccttcagactgtctctgaaatagttactggaggttttactccaaaaagaaaaaagggaattctggataaaatgagaatagcggtaggatgcaagaaccaaagcttagaaaatatattagtaaagcatattaagtctaaatcagtactggttattttttaaaaaggtgttttaagtaacaacttggagctataattgtaaacattattaacgtgatgtgtagatgcagagagaataaggataagagtttttgtcttgttagggaaagataatataaatcttgttaactgtataaatttttagaaatgtatacatgtttaagtacataggttaaaatgttaatagtagccactagagaagaatagaaataaaatgtataacatacacaccaattgaagaaagaaaatgactaaaagtctcatatatagtataagttaagatgggggcaaaataaagacaaatctgggtaaatagaaaataaaatataaggtgacaagaagaaattaaaaataagtcagtaactccaacaaatttgaaaggactaaacactgattaaaagacagtgactaaaataaaattgaaattaaaaatacctatatatagtgcacagtagacatatctaaagcaaagtgacagatacaatctgaaaataatgcagtatatattgggcaaatgctatacataaaaaagctggtttagcaattctaatatagtatgaaatataattaaattcaaaacttgaaactataaaaattctagaagaaaatgcaggaaaaacttttctggacattgacctaggtaaagatttatgactaagacttcaaaagtaaatgtaaccaaaacaacaatagacaattgggacttaattaaactaaagagcttctgcacagcaaaagaaacaatcagtggagtaaatagcctacagaatgggtgaaaataattgtaaactgtgcatctggcaaaggactaatatccagaatctattaatataaggaacttagacaaatcaataagagaaaaaaataaccccattaaaaactgggcaaaagacatgaacagaacacttcttaaaataagacatatatgtggccaacaaacatgaaaaaatgcttaacatcactaatcagcaaataaatgcaaagtaaaaccacaatgagatactaacacattagaatggctattattaaaaagtcataaaataacagatttgggcaagaaataatttcagttattcagagaccatctgattatctaccagaaagctttaaaaaatccattgacaaattcccagaacttaaagagaatatgtgtgcaagatggccagatctgagtagcatacttaatttgccttcctcttcaccagcaaacgtacaagagaaaaaaatacacttcacaatagtaatagtattaaaattcacagtagaataaccccaacaatacatgtgtaagacttctttgcagaattttgtaaattattattaaataatataaaattactaaatagagaaataaatttaattattacttgatgtgaaaaaccaatataataaacagttgattctaccaaaaaataatctttaacttcaaattaatcccattcagaatcccaaccagtttttgaaaatgaaactgaaaaatttatttagaaaagtaaatttgtagatggttttaaaaatgaacaaagatgagcgtattttccttagcagttttgaaaacattataaagtcatagtaactaaaaagtgtgttaatggtgcatgaatcaccagtgtaacagaagaatgtccggaaacagagccatgtttatatggtaactttgaaatacctttttatcttgctaatgactttccggtatttttgagattataagaacagattgtcaaaggatggggttactagtaatttccaaaagtagtaaacctactttaaattattatttcctaccctcaaactgttacttacattctttgaaacttttcaacctttttttcagacttttgagtctcatagaaaaaaaataacataaccagaattatatgttaaaggaagatcttatcattatctaatgtctcaatgagaactaaagtaacatctctaagatgaaatcattttgatcacttttttgaatcttaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtaagctatatttttctcctattaagttctatttttgtttttgtttattttgtttataagtaactctagctaaaggttggcctcatttgttgcgtttctgatatctaagaaattctaccactgcttctgctttttgggttttggtagttcttggatgtttacatttgctcttcatatagtatttatcagcaatgttatattttccttttgcttataggtacttttatttcttcagagaataggtctttttctggcttgtcaggctttcttttgtttaatcttctggatatttcacaattagcttgctatcctttctttatcttactcaggtgatgagatatgtgaaccaggccctccaggccccccaggatctccaggtgataaaggactccaaggagaacaaggagtgaaaggtttgatctccaaacatattcattccttcattttcttcattctttcaaatcatcagcaaaatcccctgtatcctccatcacaccttagccactgactcccatggtcataccccaagaccatctcattaccaatagtgttatacttacatgaccttggtttcatgcatcccattttttggatcgctctcttctttctagcttactacctctagtaacctgactccagcaatactccaaccccactgagacctagcaactttgactaatgcttaactttttgatgtcctttcttccctcttaaccttgcttaagttccattatcaatcactgtaatcaattccattcataaatccatgattcctttgcccttctctcacttcattgcactcacttggaacaaaagcataatccaaattttcatgttttctgagcctacactttctcttctcttttcaagttttaacagttcctcccctattcttaccttgcttcctacttcactgaccaattaaagcaataacaagagaactttcactgattgctaccaccatatttacttacctacttgcacctgtgcccatatagtctcccttcttgcatattactgttactgctcctatctaaagccagttcttctatttatacaatagattccatttcctcttatttccccaaggattttttttccagcaatttttgcctctccgacatcaccaatttttccctctctattcagtcattccaaggagcatacaaatatgcttttttcacctatctaaaaaaatgtaatcctacattccctgccagctgtttctctatttttctattctcatttgcaacaaaacttcctaagaattttctcctcattacctctagatactctcctcttgttttctcttaaacatactccaatcaagatttcatcccctcttcccccaactccccactgcctaccactccacaaatgctggtcagtcaccagcagtctatatcctactaatccaaatgtcaggtctgtcctttttttgcttgctttttgccttctttaaacatttgcatcccttagctttcagtacatttcctgttttttttttttcattcctctgtggtgtacatatatgtgtgtgtgtgtgtgtatgtgtatccatgtaattaccatctaaaccaaaatatagaacattttcaggaccctggaagactcttgtgctccctactcagtatcccccaaaggtaatcactattttatcctctggcatatattaatttgcctaatcttgaactttgtgtacatggaattatactgtatgagctcttttgtgcctggtttctttagctaaatatatgtgagatatatctatgttcttgtttgttgcagtatttttccaccattctttgttttccactgcacattacctcaatattctaatgttgatggacatttggtctggagctattgtgaataaagctgtcataaatattcttgtacgtgtattttttttgtaggacataaacactaatttttattggggatatatctggaaattgaattgctgggttataggttaggtgtaggttttgtttcatagatattaccaaaccatgttccaaagtgattttcatttgcgtttgcctaatgacttgattatgaactatttccttacagtttttatattctcttttgtaaagtgcctgtctttatctttaatttgattattggatatatgtattaaaactatcttctgttttgttaacttttgtttaacaaaagttgctaattaaatgaaatcaaattaattaatttcctattttatcgttagtactttttatgcactgttttagaaatctttacttatctcagaggcctgatgatattcctctgtgttttcttctagacactttattgttttacctttcacgttttgatctttcttcaattaatttttgtgtatagtttggagtagggatcaaagttcatttttcccatatggatgtccagttgactcagtactatagaacaaaagatcatcaattaccccaatgaattgcattagcactttttgtagatcacatgaccatatgtgtgtaggtctgtttctgactgctctattctgttctgttgtttcattagtctctctttgcaccaatacgatactatcttaattactgtggctttattgtaagtgttggatattctaggttctttgcattattttgtgtgcatcttagaattatctatccaacttttaagtttaaaatgctccaaggttgagtccttgttcttcttttctatataaactcatttattcagtcttgtgactgttaataccacctaattgcccatgacttccaaatttatgcctcctatccagatataactcttttcctctagatttgtgtatccatttgcctagtcaacattttgaacttgacatcctgatcaaattgaagtcttgatttctgccacctcctccccatagttgctgcactcacatcttcagcttcttacttaaaaagcaggccactttagccttctagttgctcatgctgaaaaccttggagtcatccttgattcccctcttcttttgtatttcatatatgatccatgagaacatctcattggctctactttcagatatgtctataatctaaccggttctgatcattttcattgcagtcactttgaaatgagctaccaccatctctctcctagatcattgcaacagtagccacttaagtggttaccctgtttccatcattgcctttagaggctattaacatagcagctagagtcatcccttaaaaacttaagttataacatgttgcttttctttttaaaattttctactagattctcatttcactcacagtaaaaaccacagcctttatatttcttatatgcctatatgccattcgttataaactgtcaactttctgaccttgttcccctccctcattctgctctagcaatctggtctgcttgctgttccttgtatataccaaacatggctattctttctgcttgggatgttctacactcttatgcacatgtcatgtcctttaagttttatcatataacaacttctcaatcaagtctatcctgactaccctatttaaaattgcaaccccccacccttccctggcatactcaataccacttatgtagttctattttttcctataaaaataatatattttaaagcatattaaatatttaatgtatatttaatttttttagacagggtcttgctctgttgcccaatctggagtgcagtggtgcaatcacagctcactgcagcctcaatctcctaaggctcaagcaatcctcccactttagcctcctgggtagctggcaagtacaggcatgcaccaccatgcctggctaatgtttttattttttctgtagagatggggtttcgccatgttggccaggctggtcttgaactcctcatctcaagctatctgcctgcctcgggctcccaaagtgctgggattacaggcatgagctactgcagtctgcctatacttaatattctattaaaatatttcatatatacattttgataattcatttcctttattgattattatccctttcccctggtagagtgtgaggcatgtagacatgaatttttatccatgacttttcttttgctcaccaatgtaacacaagcatctggaacagttcttggcacacagtaagcactcagtaatttatttgtcataaattgattcaggatataggcttctccaatcacaccattaagtggaaatgctgtcccttagtgctaacatttttagaacctatctatagaaggtatatgtacccctttcagtaaaatttgtttgttattatgatttcactaggtgacaaaggtgacacttgcttcaactgcattggaactggtatttcagggcctccaggtcaacctggtttgccaggtctcccaggtcctccaggtaaattatgcctcagggtaaccttctaaatattttttggctagattttgttgagcttatacttttagaatgttaccagtttctcattttataactagtcactcatatctataaagaattaagtatgaaatgcctccatttgttatcaaattaattatgctcttgtttctaatacctgaagctaccaatatattctattaaagcattttgacaatataatttcaggaaatatatcttccccattttccatatggagaagaaaatcacttatacagagtcagacttctttcttccagaatactgggagaaaagttcataatgcctagcccctgagtgtagtttccagtggcagagattccagtcactggggatgtatcacatgttgttgttcaggaataggggttctattggagtttggcaatcaactgccagtattcctctctctctatatataacacatctatccccctttccagtcaaaactatatgtgatatctgtcagaccctcaactgtttcatttaactgccccttaggtatcccagtattctcttgaaattacactttatgtttgagtcagggctgagaatagacaccagatctcttacctttctgtctagtgagtctactaaggacaccaattcatttggaggttgggaatactttcaacaaatcttgtagacattattggacattaataatctagccttgtacctctagtctcatggttctcaaacttgagagtgcatcacctggagggcttattgaagcccagaatgctgagcctcactctcaaagtttctgattcagtagacctggatgaaggctcaagaattagcatttctaattagtagccaggtggtgatgatgccactcatccagggatccatttggagaaccactgctttagtaatgtttcctctagtctttgggctgcaaatgtttctcataaaccaaatttcagggaatgacaaaccaaagaaaggactggtaaggatctaggaaaactgcataagtcagaacaaagatattcaaaccttttcattatcttttttctccctttggcaatgggaacatcataggaacccaggaaacgttgtgcatagtatttggcagttgcaaggtctgagaaagtctgctttggagttgaaagtttcttaggatacaatattgtatgtaacatgaaatgttaaatttattttttaaaaaggatgattacctcattttgtgaacataaaaggaaaatacaaatgtgacttaaatgggattgaatggggttcttattttaaaaacttgactttctgacttgatgatttctgtatgagctttgtcaggagttcaagctcaaagcttacgttattgtgtgtgtgtgtgtttgtttgtgtgtgtgtgtgttaggatctcttggtttccctggacagaaaggggaaaaaggacaagctggtgcaactggtcccaaaggattaccagtaagttttgagtatattataaaacaaaaagaagtagaaggaaggcattttacacattgattttcaattattcatatatatacacacatatacaatttaatttttccattaagttgtactttgtttgattccttgactcttcctgactcacatgcctcacttgattcagccctttgtacattaaatgttattggatgggttgaaggggtaaactggagagaagaaaatgttagaaaaaaagaaactgattttctttttctctttcttctttttccactcttttttctttttttccttactcatttcagggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctgtgagttggtttgatatttttggttttgtgatgttaaattttcacttagaaatgttttctaagttaattcaaaggatgggactgatgctgagataaacacccaatcaatgcttaaaacaatgtgaccatacagtaatggcacattgttactgactacgtagggtttctgcactactcttttctttcacttgttttgtaaacttatttttcttaacccattaatattgaatactattttctatgaataggtgggcaggaggttaagatgtttatgagacagtataaggttccccatctcttaacccccacatatctttccttgggtttacttaaacctcatgactgggcatggtggctcacacctgtaatcccagcactttgcgaggctgaggtgggcggatcacctgaggtcaggagttcgagaccagcctggccaacatggtgaaaccctgtctctactaaaaacacaaaaattagccgggcatggtggtgggcgcctgtaatcccagctactcgggaggctgaggcaggagaatcacttgaacccgggaggcggaggttgcagtgagccgagattgcaccactgcactccaccctgggcaacaagagcaaaactccatcacaataaattaaataaataaataaataaataaacctcataaccagcagtttaacttgtttctatatatatagtaagcttagagaatagtacaagtagatagccatgttcaatgtgccacagaactgaaagatttaacataaatgaacaatcttattttgtacataacacacagcccaggatatttaggtaggaagtgatattttataatgttatctagactataacctttctgacttacactaaaatgtaagctgcataaagtcagagatttttgtgtatttttgttttctgttgtatcaccagcacttgacacatagtaggagcccaaaaatatttgttggaggaatgagtaagtggaatgatcacacataccatctcataataccactcacttatatagcttttaagaagaactatttatggctatatcctttccccagttgtattcagtaccaacctacagatagttgttgtatctatatgtttctgtattaaacttttccctttttagggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtaagtttactgtgttttgttttaaacttggtgcttaaaaacagaaatttattatgttttggctactcatggcttcctttcccgagaggtgtgtttccctggccgtttatatttgaactcttcagagcatcttagcaagggatcacaatggtttttataagggggtttctttttaaatcttttctaactgtttcattgttactgttaattttgctctttttaagtacatgatacataatgcaaagtttaataaatagttataacagaagcacacaggtagctaccacacacatcaaaaaatagaatgttaccagcatcctagaaacccctaaccttttctccctgtcatttcctaatcacaatccccttcctcctgtctgctgtcttgacttttacatagttttcttccattacccctctgttttatgacctctgtatgcatttttaaacagagtattttaattttgtttctttttgaacttcatgttaaaggaatcatagggtaagtgttttttatattaacttttcgtgtggctatagtgtattcatttttattgctatatagtatttcattgtatgtatgtttatgtgtgtgtgtgtgtgtgtgttacagttgattgatccattctatggttaatggttaattgggttatttacagttcaggtctattatgaataatgcttctgtttacagtcatatagatagatagctaggtagatagatagatccctatatctccttgtgttcatgtgctcacacttctctagggcaagagttggcacactacagaactacagtccatggaccacatccagcctaccacctgttataaataaaagttttatgtgaacacttccacaaccattcacttttgtctgtggttgtttttgcactacaactgaagagttgagtagttgctacagagactggatggtccacaaagcctaaagtatttactctggtcctttacacaaaaggcttaccaatacctgggctagggtatgtatttaagattagcattttcaaagcataggataagtgcatcttccacttgactggataattacaaactctatccagaccaattgtaccaatttttactaccacaagcagtgttgaatattttatgttgatttacatccttggaaacaatttgtattgtcggacttttacacttttgccaatctgttgagtgtgatattttgcatttctctgattaaagtttagcaccttttcatgtgtttattggtcatttgaatttgcttttgtgaaatgcctaatcaagtactttgaccaattttatattggattatttctttttttattgatttagaggagttctttatatattctgtgcattagttcttagttacctatgtattttgcgaaaagaaatctttacctactgtggcttgccatttttactctttgtttggtgtcttcaatgagcagaaaacaactttcacatcatcaaaattatcaatcttttctctcatggttagtgctttttgtgtcatgtttaggaaatcttttttttcttgagccaatttcaagttcatgtttccattaataagaagtagatatacttgaactttgcacatgtaaaacctaaatgtacctattagccaaaaaaatattttccttgtttactacagtttgatttttaatgctcttttggcctacattttaaaaatacttatataggtaacaccctgttttaggggtttccagagaaacagaaccaataaaaaggatggacagatgggtagattagatagatagatagatagatagatagatagatagatagatagatagatgagaggtgatttattatgggaattgacttacatgattatggaggctgagaaatcccacagtaggccacctgtaagttgaagaactagggaagccagtagcttggctcagtcctagtctgaatgcctgagaacctgagtggctgcttagtacaagtcccagagtctgaaagccagagaacctggagttgtgatgtccaagggtaggagaggatgggtgtaccagtttcaaaagagagagagcagagaattcacctttttttctgcctttttgttgtatccggtccctcagctgattggatggtacccacacacattgggtgagggtggatcatccttattcgtttcactgattcaaatgtcagtttctttcggaaacagcctcacagacatatctagaaataatgctttaccagcgatctcagtatctcttaatctagtcatgttgaaacctaaaattaaccattatacatcttgaatcatggaagtccttaaggctgtcatatcctttttctttttgaaattctatccttctgttttatatatttcttgaatatatagtggaagattgtttttcttgtgaatttttgttagtttacattttcaaaagattgctgataattttcttttttgtttttaattaaaaagagacctttagttgagtaaatacttctcatttaccattgatttactcttgctttcaggtcctaaaggggatccaggtcagactataacccagccggggaagcctggcttgcctggtaacccaggcagagatggtgatgtaggtcttccaggtatgtgaggaatttatttcaaagtaacttcaacaccgatggcttttttttttttttttttgacagagtttcgctctgtcacccatgctggagtacagtggcgtgatgttggcttgctgcagcaacctcctacttctgggttcaagcagttctccctgcctcagcctcccaagtagctgggattacaggcgcccaccaccacgcccagttaatttttgtatttttagtagagacggagtttctccacgttggccaggctggtctcgaactcctgacctcaggtgacccattgcctcagcctcccaaagtgctgggattacaagagtgagccactgcacctggccctgatggcttctttctttgaacgttttcctttcaataactgctgtttctccataggtgaccctggacttccagggcaaccaggcttgccagggatacctggtagcaaaggagaaccaggtatccctggaattgggcttcctggaccacctggtcccaaaggtatgttggaatgggtagcaggcagagtaggttagaagtttagcatgatgttattctctcataaaattcattcaacaaataaaatatattaattgcaccttttttctctgtgctataaagaatgtaaataaaaaatcacagtgtattttcactgtaagttcattatctttatctaaaacagtccagacaagaaaatatctacattttagatatgcaaaagtgatatataagcttaaaaatcacaggaattattgtgttttgtgttcaccatagtattttcagggtttagaacagttcctaacacatagtgtgcacttgatgtttattgagttaaaggattttttaaacagaaaacagacttattgcagatgtgtagccaagtaatgttttatgctaaataatattttcttgatttattgaaatttttagggcttatgcttcagttctgctttattcctcacagaatttattctcacaaatggcaagagcacacagtggtctgaggacagttcttaaatatatctttactcatttatacaaaatgctttcaaaagtatcaggtttgattttatgtgtgtatgtatctataatatctgcagttatttttagatcatttccaaaattatatggtaggccctttgtcatactacatccagatataagcagaagaaaagttcttgggcatttttgtgtgggattcattccttacaatttagttctatcttattatataatagccctcattttcttcagaaaagcatatgttccacatacattagctctatgtgaaaataaaaggaatgtaagatgattgagaggattgtaaggcttaatcctaagtagtagaatgtcattgtgcttttgacatcttactgttgtcactaagcatgagtagaatgtgggtttgggaatttgaatatctttcttaaagtgcctttcctttggtggttaaaaaatgacttatcattttacaggctttcctggaattccaggacctccaggagcacctgggacacctggaagaattggtctagaaggccctcctgggccacccggctttccaggaccaaaggtctgggacatttttctttattccttctcattttcttatctttcccaccttccttatttctagctctctattttgactcagatatcatcccaagccccaagtctttactataaatatacagataacttattatatttccattaaaaaaatatttaaccccaaatcatctttaatagtccaaggtcacatttggagcaaaaaaaaaaaaaaaaaaaacctaatttctgtacctacttttgaatgcccagttctttgattagagaatacaggcataccttggagatattgcaggtttagttccagaccaccacaataaagtgaatatcaaaataaagtgaatcacacaactttttttgtttcccactacatataaaggttatgtttacactatactgtagtctttaaagtgtgcgatagcattaggtctaaaaaaaaccatatgcataccttaattaaaaatactttattgctaaaaaattttagcaatcatctaagcttgcagcaagttataatctttatgctgggggagggttttgactcaatattgatggctgcccactgatcagggtgatggttgctgaaggttgggtggctgtggccatttttttaaataagacaacaatgaagtttgccacatcaattgactcttcctttcagaaaagatttctctgcagcatgtggtgctgtttgatggtattttacccacagtagaacctctttcaaaattggagtgagtcttctcagaccctgctgctgctttatcaactaagtttatataatattctaagtcctttagtgtcatttcaacactgttcccagcatcttcaccagggtagattccatctctagaaatcacttttgctcataagaagcaactgctcatctgttctacttttattataagattgcagcaattcattcacatcttcattctctacttataattgttgttctcttgctacttccaccatatttgcagttacttactccattgaagtcttgaaaccctcaaagtcatctgtgagagttagaattaacttcttccaaactcctgttaatattgatgttttgacctcttctaatgaatcctgaattttcttcatgacatctagaatgaaacccttttcagaaggtttccaatttgttttgccagatccataagaagaatcactatttatgacagctatacattacacaatgtgtttcttaaataataagacttgaaaattaaaagcactctttgatccatgggctgcagaatgggtattgtgttagcagccatgaaaagaacattcatctctttgtacatcaccatcagagctcttgggtgactaggtgcattgtaaatgagcagtaaaattttgaaaggaatcttttcttctgaggagtaggtctcaacagtgggcttaaaatagccagtacactatgctttaaatacatctgctgtcatccaggctttattgttccacttatagagcacaggcagagtagatataccataattcgtaaggccctagaatttttagaatggtacataagcattggtttcaacttaaagtcagcagctgcattagtccctaaaaatagagtcagcctgccttttgaagctttgaaaccagtaatttacttatcttctctagctatgaaagtcctatgagcattttattccaatagaaggctgtttcatcaacatggaaaatctgttgtttagtgtagtcactttcatcaatgatcttagctagaacttgctgcagcttctatatcaaaacttgctgcttcaccttgcacttttatgatgtggagacagcttcttcccttaaacctcacgaaccagcttctgctagcttccaacttttcttctgcagcttcttcacctctcagtcttcagataattgaagttagggccttgctctggattaggtttttgcttaagggaatgttatggctggtttgatcttctgtccagatcactcaaactttctccatatcagcaatagggctgttttactttcttctcattcgtgtgttcactggagtagcacttttaatttccttaaataacttttccttcacattcacaacttggctaactgtttagtgcaagagacctagccttcaacctaccttagcttttgacatgccttcctcactaagtttaattatttccagcttttgattttaagtgagagacatgtgactctttctttcacttgaacacttagaggccattgttgtgttattaattggcctaatttcaatattgttatgtctcaaggaatagaaagacctgtggagagggagagagatgcggggaaaatggctgatcagtggagcagtcagacatttacaacatttttttattaagttcaccatcttatacaggcacagtttatggtaccccaaaacaattatgtggtaacatcagtgatcacatatcaccataacagatataataataattaaaaagtttggaatattgtgacaattaccaaaatgtgacacagagacaaaaagtgagcacatgctataggaaaaattgcgctgatagacctgctcaatgtagggttgccacataccttcaatttgtaaaaagtgcagtgtctgcacagcacaacaaaatgatgcacaataaaataaggtatgcctgtacgatggtctgctccctctgtgcatctctatagagtcatcatcccatgtcatctctgttcatgcctgtgtgatgattggttgaaatggtgttgaatatcatttccagaccttgtatactgttgttctctgtcccaattccattacagatacataatgcaaatcactgcaattgacttagtaatactaataataaataatactgtgtttgagttacttttcattccttttattatttcttatctaatgttaagctttcctgagtcaaccttcagcaaagagctgctgtggcatgtaattatcgtgactatttttatatattttatctctgcgtcattgatttaaacctcctgtgttttgtaattattacttatttttcatgggaaaaacagttaacccgtgacaccagttctcatgagaaaaccacttctctattggttgattctctttattatgaacattttcaaatgaaaataaaagtaaaatgaataatacaatgagctttcacatatccatcacccagattcaaaattattatgattttataacatttgcttcatctagtcctttttactttgcttaaatattttacccaaatctcaacacagtatcatttcacttataaatgcatcagcactcatctctaaataaattgacattttatacaaaaaccacaatgttgttatcatacttagtaaaattaaaaataattgtttagtattatctaatactcagcctataatcatatttccctacaagggtagtctgttctttaatctcatgctctctcagttttttttttttatcctgaaaccagtccaaatcatctaatttgttttactaaaccctgtttccaatccttccatatgttttctccaacataccaattactttttatttaattatcttctcctctccccccatggaaggaaaagtattgtcttgtattttcggcattaaattctctgtggcaaacaataaggacagaaaagtcatgggagtttttgttgtgttttgtcatgtgtatgctcaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtatggaggctgtcactgcatctcaacttgcttttaacttttatagaaattgacacctttgggaaagtttatgggtgataagcccaattaactggaaaccctatgctgccattctgttactgctacacatttttttcaatccttcattgattatttttgtcttttatttcattgaatagataataaaatcatggcccggcacggtggctcactcctgtaatcccagcactttgggaggccaaggtgggcggatcacctgaggtctggaattcaagaccatcctggccaacatggcgaaaccccgtctctaccaaaaatagaaaaattagccgggcatggtggcacatgtttgtaatcccagctacttgggaggctgaggcaggagaatcacttgaacttgggaggtgaaggttgcagtaagccactccagcctgggtgacagagtgagactttgtctcaaaaaaaaaaaaaaaaacaatcatatatgttataaaagtaacactgagaagtcttccttccaacccatcttcatccactttgttcctctccatcctcctgcttaactattttttattctcctttcttccccccaccctccccccataccccaagacagagtcttgctctgtctcccaggctggagtgcaatggcgtgatcttggctcactgcaacctccacctcccaggttcaagcaactctcctgcctcagcctcctcagtagctaggattacagatgcatgccaccaggcccagctaatttttgtatttttagtagagacagggtttcaccatgttggccaggctggtctcgaactcctaacttcgtgatccgcccgcctcggcctctcaaagtgttgggatccttctggtgtttcttatataaataccagccaagaatttgttttattttctctgttcttaaaggagaaggtattttcttttgactttatttgcactttatttttttactgaaatttgtatcctgaagatcactccatatcagtagatggagatcttaactttttgaaaataggtgcctagtgttaaattgcgtggatataccatagttcatcccagttgctagttgctagattggatttttgccaatcatttattacaaataatgccatagtgaataatctttcatgcatattatttcagatgtgttcaggtataatagtaaaataaagtgatgaaaaaggattttctgaattaaagggtaaatgcatctctggatattgtcagattcctctcaatttgcaccatttacactccacccacaatgtatgagtgtgtttccccacagccttgataagtgagtatgctgacaaactcttggatttttgctaacctgatgaagtaagtaggtttctaagtatatttttaaacattttattgttaaaaaattttaagtactgtgaaaaataatagtacagttaacagctgtatatctaccacccagattctacaatgaaccttttatctccctgccaacgttttgttttttaaaattttaaatataacaaagtagacagaactttattgggactactatatacccatcactgatattttactgtcaacattttactatatgttgacaaatactatatactatttgtcacatatctatccatccctgtctccatccattcatctatttttgatgcatatcaaaataaattacaacaacaatatacttctctctaaatacttcagcatgcataccataactaaaattccatagctgtatattacttttcttctgatatgtaattcacattaaatgagatacataaatcttaagggtacatttactggattttgacaaatgcatacacttgtataacacaaaatctttatcaagatattgttttagaaattttccttatgcccctttccagtcagtccctatcccatcatccacagtggcaactatactgttgattttttcatcataagttatttcgcctgttaactccttataaatggaactccttataaatggaaacatacggtatgtactttctttctgaggcttctttcactcaacataatgttttggagatccatccatgttgttgtgtttatcaatagttcttttctttcagtgaaatcattgagtattttattatgtgactgtatcatggatacctgggttgtgtcaagtttttggctactatgagtgaagctgttaaagacattttttacaattcttttttatggatatgtgatttcattttgcttcagtaaacaactaagagcagatttgttggatcataagtggatgcttagttgtactagaaactactagacctttttccaaaatggtgataccattttaaatttacaccaaagtggttcagaaatttgcattgttccacattttctcaaagtttggaatgttggtaggtgtgtggtagcatcatattgtgattttaatttacgtttccctgatgactaatgatgttgagttcttttttatgtacttgtgagctacttacatattcaaatattttgtctattttgaaagatggtttgtttctcactttattattaagttggaagtgttatttctatgtcctgcatactggccctttcctagatatatgtttattagcattttagccctggctggctgacctgttcatttccttactgtattttgatggataaaagttttaattttattgaagtttcatttatcaattttttcttatatgattataattttctgtgtcttgtctaagaaacatttgcctgccccaaagttgccaaggtattctatgttttattttataagctttatagttttagtttctatgtttaaaactattacacatgtcaaataatttttgttcagcatcatttgtttaaaataatcccctctctattggattactttgggatctgtgtcagatcaaataataatatatgtgttgatctacttctgtgctgtcaatcctgttttatttatttattttgctgtcattaagccagtaccacactgtttatattactgtagctttatagtaagactcgaagtcaggtaatgtaacccaccaactttattcttaaaaaaaaaaaaaacacatttctttggctatattaggtcctttgcctttactctcagagtggtttaaattgtatgtctcttactgtgagtgagattggccatccttttatgtgttaagggccatatttttttttcttgttaactgccaatatcctttacccacttctctgttgtttcttctactcccttgattttgagttatctaataatgagaaggaatagaattagtaaagctgacttgcattttttttcctttgatttggaaggaacccgacttccctcgtcaatgttttggctcctagtgagtaatctgaacagggccatgcttctggaacatgttggattgatttctattaaagcagtaagacagcccaatccaattttaaccaggctagattgtattctgccagcaaaagccccagactagctcaatacaaactcttcttagataagctcttaaaaaaatacctttctgtttttgactaaacaattcaggccagctgtaaactgtaacactcaaagttacaagttgtgtttcccaccagttatctcccctagctgtagacctgtagcaacaaaaattgcagataaagatatttgaaatatgtggcaaacagtcttcctgtggaagttacccacttactgtattttgtttgtatatattcttgagacacagtggtagtgaagaaatgcattgaaggctatttaaacatgaatttaacaggtatttgcctaatctttggaaggaaattaggatatggcattcccatatcctcacaggagtaattctcaattattaaaagccgagtacagttctttaggtgctagaaaaataagtgtttgggatattctgccatgtaactccttcattcttcaaacatttattatgttctatgccagctagtacctgaatcagtagaagctcaaatgcatagtttctgatcttgaagatctcaaggattgctctctactgtgagaaaatctaggtagcatcaccatgaaagtgattatctcaatgggaacttctatgaaaatgtatcactaatattttggatcagtagactacactcaaaactcagcaagcagatcacaataaaagttcacctaccaaacacacacaacacaccaatgaatgggtattagaactcagttactaaactgtaggaaaggttgatgcaacactttcaaaacaatgtagtgaccaataataaattaataaggctaatactcatcatgatatatctatatgaggaagaaaatgtgcttaaggttgaacgttagaatcagattatacaaaagagaaaaaaagatgattttggaagcattcagtttacctcatatattacttttgttcagggccttatctaaggtacctggagaggttttatatagatggtgacagttgaatttagacttaagggaaaggtgttccgggcagcaagaataacatccaaaggtattattgtgacaaatattgtgtgcttggaaatgttgaaagaaatacaaaagtatataatttatgctaacaacaaatctatatcaaacaaatatgacaaacaactgcatgcccatacatttgacaacttagattaaatggactaatttcttgaaagacataaattgttgaagctcactaaagaagaaataggcaatccaggaatctatttttttaaaaattgagttgtagttagaaacccaccaacaaagaaaactacaaatccagatggcatcactggtaaattctaacaaacatttaaagaagcagtaacaccaattctacacaatctcttcccaaaaacagaagtagagggatcactttccaaccattacatgaggccagcattattttgatatcaaagccaagcaaagacatatgagaaaagaaagctgtagaccaatatctctcatgaacatagacataaaaatcctcaagaaaatattggcaagtcaaatctagcaatatatgaaaaggataatacactacaatcaagtgaggcttatccttagaatacgggctggtttgacattttaaaatcaatgtaatttgccatatcaacagagtaaagaagaaaaactgtattataatctcagtaaatcctgaaaattatttgataagtttcaatattcattcctggaaaaatagtctcagaaaattaggaataaaagggaacttccttagcatgataaagacatttacaaaatcttgatccattatgtttagtggtgaaagactgaatacttttccccaaagttatgtaacacaaagatgttatttgttaccatatttgatggtatgaaaaggttcaatattgtattggaagtcctagccaatgttataagacaagcaaaataaatgaagggcatacagattggaaaggaagaaataaaactccctatattcatagatgacatggttttatacttagaaaaccctaataaatctacaaaaatttactagaactaaaaggtgaatttcgtaggatcataggacaaagcaaatatctaaaaataaattatgtttttatatactatcaatgaacaactagaaataaaaattaaacaaaaacagtataatttacaatagcatcaaatgacatgaagtgcttaggtatgcataggtccaacaaaaatgtgcaggctttgtatgtggaaaattacaaaacactgttgacagaaatcagatacctaaataaatggaatggtatattgtgttcatggatattgttaagatatcagttttctccaaatcaatccatagattgaaaatattctcaaggagaacacacaatttttcttctaaaatttatatggaaaaacaaatggcctagaatagccaaaacaattttgagaaagaagtacaaagttggacaattcatagtacttgatgttaagacttaaaataaagctacaatagttaaaatagtgtggtatgtgtgaaatacagactaatagatcattgtaacataatagagagtctagaaatacacccacatatttaatttttgacaaagttgctaaggcaatctcaacagaaaggtaagtcttttcaacaaatgttgctaaaatataaagcaattggacatccatatgcaaaaaaaaatataaacaaaccaacataacaaacctctacctgcacttcctaccttgcacaaaatttaactcccaatggatcacagacctaaatgtaaaacctaacattatcaaacttctggaacagaagcaggcaaactttttctgcaaagagctagagagtaaatattttagtctttatgggctacatatatggtctctgtcacatattcttttttaaacaaccctctaaaaatgtaaaaaccattcttagcatgtaggcagcacaaaaagaggcctataggccatatttagccatgggaagtactttgtcatcccttgttttagatgaagaagcataagagaaaactctgtgatcagatgttaggcaaaaacttgttagaataccaaaaagacaattcataaaagaaaaattggatatattggactttattaaaattaactgtattttcatatcatatatctgacaaaggacttataagcagaatatataatgaactctcaaaactcaataagaaaacaaacaaccaacttttaaaatatagttggaaaaatgagcaaacaatttgagtagataccttaccaaagaagacacccaaatgtctaataagcacatgtaaagatgctcagtataatttatcatctgggaaatgcaagttaaaaccacaatgggataccacttcataaatattagaattggccttttttcaaaaaggataactgacaataagtgctgctaaggatgcagagtaactcgaactctcatacattgctagttaatacacagaatggtgcagccactttgaaaaacagtttgacaatttcttatatagttaaacattgtctttgcacatgacacagcaattctactcccaagaaaaatgtgaagcttcacatagaaacccgtagaacagtgttcatagcagcttaattcataatcaccaataattgtaaacaccccaaatgtgcctcaaattgcaaaaagattaacaaaatgtacatattcatctgatagactaataaccagcagtaaaaagtaactactgatacacataacaacatgggtgaatctcaaatgcattgtattaagtgaaagaagacatattcaaaaggctacatactatatgattgcatttgtatgacattctgggaaagaaaaatctgtaagacataaaataaatcagtggttgccaggtaattgggatgtggggacgagttgactacagcgcacaggggcttttttgggtttatgaaaatgttctatgtcttgattttagtggtggttatatgactacatacctttgtcaaaactcatcaaagtgtacactaaaaagacagaattttagtacatgtaaaaattgtttaaagtgggagtgacagagggacagacagaagatggagagatggacagttaagtttctaatgtcaaagagatgttttactaatgaagggagaagcttgaacatgtttataagccatggccctgagttagtaaaaaggaaaatgttgaagttatctatcttaaaatataggtaacttgaaaatatattttaaacttatgaatatataactgtccacaatgagttacaagtagaaggaatatgtggtttgtaatcttttgtactttcttgtgaagttgatttaagtattgaagtagtgatcagcatatgttaaattataaggctgtaactattaatagattccctatcctttgctcttgatacttatgtgtacttttcttgctgaatgaatgcccagtttttcaagattcttgcttaatatgatatggttcccaaggactagtgactcaggtgttgcttttaatatttaaactgtatttatttcttaaaggtgatgttggaccaaatggacaacctggaccaatgggacctcctgggctgccaggaataggtgttcagggaccaccaggaccaccagggattcctgggccaataggtcaacctggtaagattagagtaaatgtgcattttgtagcactcataatatatacatttgttagctcatcaataaagtgaaacctacaaaacagtcttccagaagcagacttaaaaggcaatctatctatgtgtatgattttataaaagtggataagtacaagccacagcataaaagctactttaatccctgatatttcccttctgagttcatctaaaattgatgtatttccaataatacaattgcagtgtattattgatatgtaattgttgagttagacatggttttggaagcagaggcctagaaacttctagtgctgatcatttcagatctgagtagcggtacagcattcatagacctttgtggaacctcctaacatttcttagcacatgacaactagaattagggttcagcaaaactttctgtaaaagtgtattttaggcattcccattttctttttttttcagtgagttattttccctttttgcccctaaaatagcagtcattttgcaattcatcagcactccaaatctttacttttaatattttatattggatactcaaaaaggtcttttgtcaacacgtaacctaatgggtttgcctctatagataggaaatcatatggttcctctaaatttgtgtgaaagcatattgagtttctggattctgagctgtctggtgatgtgaattctcgttatgttaatctaggtaagtacagtaaaggccaccttggggccatcattatgttattgcaaaataccataataatttatgaaattaaaacaaatatgaaatatttaattgttccttaattcacatgaatacatctgaaggcttaaacacagagttcagatgtgcatacatttatctgaagcaatggctatatgtttcctgaccttaaatggcagtagatattttgttattattctaaaaatttagaaactcaggttaacaatataaaaagcttgtaaatgttattttcattatgtactatttacaattgattatatggcacattatacctttttatggtccctgacatgtcactactgatttaaaactaagaaaacttagagtgttgctttgaaccaggttgttacaaaatagctgctttatcacttatggaaaaaacattctgtccaactaacaaagcagagggatcttcaggaaaaagcacttatttttaggtttgacctgctgttttttttttgttgttgttgttgtttttgttttgttttgttttgagacagagtttcactcttgttgcccaggctggagtgcaatgctgcagtctcagctcactgcaacctcctgggctcaaacgattctcctgcctcagcctccggagtagccaggattacatgcatgcaccaccacgcccggctaatttttgtatttttagtagagacagggtttcaccatgttgaccaggctggtctcgaactcctgacctcaggtgattcgcccgcctcggcctcccagagtgctgggattacaagagtgagccactgcgcccggcccctgctgttttacagaggtggataaaatgaacttatcactcctatggtgttttgtcatttgtttcagttccaaaaagtgcatgagtctttagaagcattttgaattcttaagtcacagctgagtgcgaataaaaaaaggaacaccattaatatgaatctaaacaaaatacaaatatgttaacacgtgtcacgctttttcagatttacctgataccttgtaatgttttattaatctaatgttctctctttctttctccctctgttatatgatatatctgacaaaggacttataaccagatataaatataatatatagataaatatatagatataaatataatatagatatagagatattgatttataaagtataaataggatgggcaggaagaaaagtaataatgctgaattaaacttcatctatttcttttgtaaatatatgtatagccatagaattcaagatattaatatgattcaacaaataaatgaaattaacaggaactagcatgaaaatttattgaattcactcttaatatagaaatgttctcaaatcacagtacttttcattttactatgagatggaccacatttcatatttatacaaggcacagatactcactttctaagtaaattttacttacatcaccaaaatagaatattatcttagttcatttaaaaaacatcctgatttatgtccataaatctcaataataaggtaatcggaaagattcttatatcttgataaacctacttatgttgcatggctgaaactctatcaatgtttttgtaataagcttatttaatatacttgtatttcattttgcgataggaaaaatgcaaaatattctatactgttatctctctactgtagaatgtttacattatgctttttaggctttcctttgaactccagttttctattatttaattaagcttttactatttacctttctcttttctaaaccaggctatacagtttaacacggttataagataaggtcccattgaatatcagtttcccattccatagcagggaaataaaagaaaaattgccaaaggactagaaacaaaatatttttcatctcatgacctgctaacccaggcagaaatggaggttgttgattcttgttattttctttggccattacctgtacaattactgtcttactgaatttttttagagatcagttaaatatactctatttcatgttcacagatcatatcataaccagaaccaaacgtgttatagtgtgtgtccagtcttaggacaaagcatatggctaaatcagctaaagaggaaaaaaaaattcatcaccactaatgtgaatcaaaacaaacaaaacaacaacagcaaaaccctaggaattgtttatgaattattcatgtcattttcatagatgaaggagaaaatagttttctaacacttcaggaggctacaaaacccttgggtagggggagggtgtgtgtatgtgtgtgtatggaaagttctcacgaataatacatgtttttgaaattttcctttttttataaactggttccattcggctgccaataaatttagaacatcagtatatccctatatcacatctgtagacatatccatacaattcttgttattgtggggaaatttagcggaactttgggatttatattgacttcttcatcctggatcttaccaggatgtgtattcctgacagtattcatggaaaaaatctatgctatgggaggaagtatagtataatgtctgttattactactactaataataacgatgaagaaagaaatccttgcctagtgcatgcaagttgtttctccataatcatatgctaataatgattgatttatctatacccaacctgttgtagtataaaattaaattaatttttaaatttgaactaaactttaggagcttaaattccaaaaagattatttaaatcattaagtcagagataaacaattgaaaagctgacctttaccaaaaggtaatacttttgtgaatgtaaatattttattatgtcattattggcaaatacatttcatttatagaataagctatatgaacatctaagcaaatgcctaaaataagttttttcactcatttctaatatatgatagcagtgaatcgaggtctaataacttctatttgtagagttttatgttctaatttttaaatgcttagtttttttttccctaacctaatgaaactttttgcaacttacttctgcttgggtggcccaacttgctgctgaactgtaattccctgcctcttgaacatcaggtgtaccaggtactgtagttcttcctcaaaagccatatcttaaagtaaagctttaaacatggaaaacaaacatttctccagatttaagtctttggtttatttcccttattttatagaactgctctcttggagcacgtttcaaaagataaattatttatattgaaaacccaactattaaaaatctttgtgagctataatataacaatagatagtgatccatataaagctataatcatgttcactgttaggcatcatatcatctttcacaaatatgatataaaaatctctctctcctttttatagtcttttactgtaaaatggcagcattggaactatcgctactttgccaactgagtgtaattctctaatcttcaaagtggattttgtcagtttagggccatgctgaaatatgacataaaacagatcttaaaaccctagcatcttactctctacaaaaataatcaccactgagtcttcaacaataaatttagatcttattgttgaaaggagacttggaatgatcatctggctcaacccctagtttccaattggttatggcataatccccatttagcagatgaggatcaacattaagtgactcacgtaagtcgcacagctggtaggctttggagtgggaagttacatagtatttttagtgtaattcttttcccataaacatactcttttttaaccaccttgcttttgggggaaaatcagccttacagaaacttactaaggttaaatattttttgctgtgtcattttttttctgtaaaatcttggttggagaaacaaaagatgacaaaaaatactaatagtaacatattattaatgtattattaaaacaatgtgcaaaacaaaggtaaaatacaatttaagaagtccacttaagtgacttattcagtaatcaataattttgggagctcatagagatgtgtactaataatttataatacattagaacaatgcaaatgtaagtgtgttcaatagaccagtgtcaaataatctatcagtctgcaataggattaatacaaatgttgagaataagcatttagaaacttttatagcaatttgatagtgtaattgtatctgttgaatataataaccaaaaaggtaggcttttattttgcatctttggctttttattcagttttagtaattttcattgtattttataaaaaatattagtctgtgattaactaggaattaagaaaagattggccttttgccagaaataatttgagaagcactgtcttagagcaatctgcttgaaaatcctaaagcttgattgttcagttattttgtgtgcatgatgtcaaaagtatctctaactcactcttaggtctgttatctacagggttctatcacttgtttactagaaatataaccagatacatcttttaaaactgcttcagtacttattaatattgatattgtattaactaggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaatttgtttaaagttttctctgatttggattaaggaaattaaaactaatacgactctggtagataattcccatgttacacttttctagattgacgtgatcccttaaggatgagcattaaatatctatgactgcaggaagctcactttgctattttcactgcacatttttctctgtgagagttccagttatatattactgtataacaaacaaccccaaaacttaatgattttaaccaaccttttaattttgctgaagattttgcagctctagaattaagggatgacttgactggttcatttatctctaacccacgttgccccagctggagtgtttgggactgaaaggtctacttctaagatggcacttctctgacatctgggtgttcattagctcacatgtcatctcatcgtccatggtacctcttcgcatggcttaggctcctcacattatggtagtataaggctggttgctccccttccatggcagctggcttccaacagagagaatcccacaagagaaaagtgagtgtttcaggaactacaggtagaagcggcaagatttcttttctttcgctctctctctccctttttttctttctttttccctttctttctctttctttctcttttctttctttcttttctttctttctctcttctctctttctttctttccttttcttctttctttctttcctctctttctttctctctctccttccttccttctttttttttttttgagacagggtctcactctgtcacccagactggagtgcagtgggacatgatcacagcccactgcagcctcaaacccctgggctcaagccatcttcctgcctcagcctcctcccaagtagctgggactacaagcacataccaccacacacagctattttttttttctttttttctttgtagtgatggagtctcactatgttgcccaggctgctctcaaattcctgtcctcgagcaatcctcccacctcaacctcccaaagtgctaggattataggcatgagccactgtgactggcctgtaagacttcttttgatctaggcttgggagtcacacaatgtcatttagtcaagtgtgaggtacagaatcaaccctagttccaggtgagggttttatagtagattgtacatactgggacatatggttcactggggggccatctttagagattagctaccagactgagtctccttattcatgggtatcagcagtagtgggcactatggtcaaaaagtctaaaacttaacagtgccttacgtccaaccctcaatagttttctggttgacatcttaaaacttactttttatgttccctaagtcaaagaaaggcaaacattacttattgatattcttcaaaggtaccaaaggtgaaatgggtatgatgggacctccaggcccaccaggacctttgggaattcctggcaggagtggtgtacctggtcttaaaggtaataatcaaggtttgctgccagacgtatgtgagagggaaaattaaatatagctttatgtcagtacagaatatttttgttgactgttttaaaatgagcaatggttacttgtgtttctatgtaacatggcatttaaataggtcttgttttcaatttggttacgtgcttagtttggataccatgatacatggtaaatgcttagctcaaaataacaaaatataaggattaagcattaatttttttgtttgtcttttgagacggagtctcgctctgttgcccaggctggagtgcaatggtgcgatctcagctcactccaaattccatctcctgggttcacactattctcctgcctcagcctcccaagtagctgggagtacaggcgcctgccaccacgcccggctaatatttttttgtatttttaatagagaaggattttcaccatgttagcaaggatggtctcgatctcctgacctcgtgatctgcccacctcagcctcccaaagtgctgggattacaggcttgagccaccgtgcccgtctggattaagcattaatttttttatagtcggcctctatcgttgtcaaggaattccagatggagggattgttatctgagtataaaaatgtgtatgcactcaagtaattcatagagtacatccaaggtgcataaatgttttgagtggccagtggcctactcaactatgaaacatatcaataatctttatatgcattaatctttgatggataaaattgatatattgtgttttcacacacattgattttaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtgagtgaatgaatttatttatgaatatttttcctgatatatctgaagtttaatttttaaatagcatgaaaagtgacttataatacagaattcaccaacaaaggcacttaaatgcatcaaattttggtaacaaatattaattttcacttcattcatactgtttcaccagtcaacttttgtttgagtattttctttatagtttacctatcacgagctttacctaaccactagtgaggttttaaaatagacttaggcagtcaactactagctttctaaaaagtaatacaggaaaaggatatatagccacaattacttgaaaaacaaatttcagtgtttaggaaatttgctagtcctttcatttttttctccttgataccagataaggacgaatggtacattgctgtactgcagtgttttgatatccatatcatacttggctttcaaatacagttcaccgttattctactttggcagaataaacaagtattggactatgaacagccaagttcagcccgaggggaagtcactgaaagtagatctagggaacaattgtgtccatatagttattttattagaaacaaatacagcgtaaaatattacgtggggttttcaataaaaaaaaaaccttttttatagaagtataacatgttcataacaaaacatcataaaatatggataagcataaatcattatataaagcacttggcacccaatctatatagaatagcctttcaagcaatatggaatgttaaaactagctatatctgtgtatctgcagcttatagtaaagtttgtggctctttgtacgttctatccatcaatattgtcagttcatgtgtatgtgtatgtgtatgtgagtgtacacagatgttaacagtttccctatgagcaggatttggtgggatttttcctcaaaaaagaattaaaaatattaatgcagtgttgtatatagtcaagaaagaggcagggtcacctaattttttatggaatgactttcttggcttaccccttgcaaggcttcttttctgtttcaattatgcttcctgtataataggggcagtaaactatacttgacctctactataggcttattaaatatagtcagaatctaagagataacctagagattatctgtccttattccttatttcttcatttccattgtaagaaaatgaggcccaaaataggaaagtgatttcactactgagtgctctgaatttcttgatggtaggtaactaaaaagtgaaggattttcgtgtgagtccagtgctaatagctcatactatatcagaatatcaccagttcctctaattcacttatagtttaacacttgagtagcttgctttgccaaagttatttcatggatgaataatatcatcctaacttgcctcttctactcattcttggaaggtatacctggagtttcagggccaaaaggttatcagggtttgcctggagacccagggcaacctggactgagtggacaacctggattaccaggaccaccaggtaagtgtgataggccatttgtagcaattgcttagctgacactgaattctggataaataattatgtgtttgtcatgtttgaagatgctgtggatttgatcatggtaataagcttgggtagctactgaaatatggagctcactttcggcaaaaatattgccctttggctctagttttagcagtccagattttataggatattttgccttgattattcagtttcttctttttgtggcagcagggtatacacagaatcagaaatgtgatccaaataaggtgttgtgttttgttacatacattgcaaaatatataaatgagacaattatctcatgaaggcctgaagaattcatcttgtcctgcttttttttctttctgcctttagacaagtcagtcattaaaccatgtaaaacagatggctattgattctatttttttaaatttctaggcatgaaaatttcacaaattctcttggtagtcagttacagcattaatcactcttagagtcgacatttttttaaatcctactaaaactctttcttgtttcttcttcagccactttcttttagtttgtttcctaaggaaataaagagcagcagtccccattcttacaaagtcccttaagttcagttatttgcgctagactccatactacatggccttgatatagttgggaagagaaactcccttcctatctctccctcacatcttctgcattctcttttccaagttagaagtcattgtaaaggaaaaaaataaaataaaaaaagtttaaggcaatactgtggtcctaggaaaaaacccagatgacatcacagagctcaagcacctatgtgctaggaaaaatgtacaaacagagcagccatgcctgttcaggtcactgcccagtatctgtccaccacctctaatctctccctggcctaatgtactaaactatatcataacaggttaccaccttttctctttctgatctcatataatcacgctctacatgagaagcccatctctgaatcttttaaaaaacagacttattatattggatttatctgtgaaaatacattaagggtagttgtacacatacagcaaatagcacttcaggtgattggaattgttttagggaaagaaacaaggtgttctggtaactttttaatttttttttaaagttatattaggagacctctattactatggttatattgtaatatgttcccaaggagatgttttatgttgggttctatctgtggaccttaatcatatattcagatttaatccatctaatcccatgtttgcattttaatgactatccattcccatgaaaccagacaaccccaatattgctacattgtcttaattttaccaatttgacctttctaggtcccaaaggtaaccctggtctccctggacagccaggtcttataggacctcctggacttaaaggaaccatcggtgatatgggttttccaggtgagtgatgaaaatcttccaaatatttagtcccattaatgaaaggtggttcaatatctctttttttgtcagaaaagaggctggtgttgatagaatcagactgaaacgatatctgaggtaatcagtgggtagtgttctcttgttacacaaatatttaaaatgggaattaagggacaaaattgtagaaaccttaaaagttataattcacaaacatcttttctccagctatacccccttttatttaaacttcctttaaaagtaggcttttatataattgtgtttgtgaggctcattattatctaactcagagtttgcggagctttttaaaaatctttttgctttgtcatatgcatcttagataatccacaagtaaagcatattttgtaaaatattatatatcacatattttcaacagggcctcagggtgtggaagggcctcctggaccttctggagttcctggacaacctggctccccaggattacctggacagaaaggcgacaaaggtgatcctggtatttcaagcattggtcttccaggtcttcctggtccaaaggtaatctttggcatatagttttaggcacatacttgagcagatatgaaattttttaatactatgctcattcctaagttttcattaaacaaactatagaatgacatagtatattctggataagagatttattccttttcttttctcttagatgataagaagatatgttttagggtttgtggccagtccaaaataaaaagggaaaactttctggtttctttgtttttcttctatcttaatttctggatatacttcaataatctcaatgcctagatttttctggtcttgttagtccatccctttttagtgatggagttgttggcctttgtcctaatgttattattaactaatttgaaaagacttataaacaaagtgacagttaatgctaatgtagtagtattcttaactgcgtgtctgagatagtcctctgaatacagttttacaattccctctacttctctcttcaatgtgaaaactttggtggtgtttctcaagtaatcaaatttagaatttgtttcagaatcattggactcaacaggaatttatttgacaattgtttagttccatgtcaaaaagtagtaactccttaatcatgtagtcagaccacagacctaaaaagtattagaaaaggaattttggtactcagttttcatggaaatagtgaaagttcccagtgatataagaatttattgaattgtatgtaaggataatttttcttttaatattatataaaaatactttattttgatcatctaattgatcaatgtcttataaagagataatcaagagaagtttctgtatgttcattccagtttaacaatgtaaagtttcttgaagtgaattttaattttctctgttatatttatattttaccagtgacattgaatatatgattttattaaaaaataatatagacatattaagggtaagagtgaaaatcttcttcatgccccatcctctttttaccattcctttcctcatagaggcccactgtcaatagttgatatataaatttgaattccttgttctatacatttatatatatgcatatagagtttggggttttttctacacattgtgtatatgtagaatcatggtatgcatgctactctgtaccttgctttatcacttacccctttttatttcttttttcaatatatcttagacaattttctttgtcgtcatacattatatctgtggacatatatgtagttatttatactgtatagtttcataaaagtgtaattgttggatcaaaggataagtgcatttaattttttggctttttaaaacacttataataatgtaacatatgaacttgattttaaaatacaaccagtatgaaaagatgtaaaataaaaagtctcctttttacatgtttgcaaaccccaaatccccagttcttcttctccagggtaaccacttttagtagtttctctcatattcttcaagaaaggttttctaaatgcatttatatgcatgcatatatggtatttcatcaattttaatactcattttttacatccaaaatatctaatattggaatgcatcttattatgatggaaagcatattacaattaaaattgtaaatatttttccccaattattgatacatgaaatgatgctggaccttccaaatgtagatgttttctcatattttaattaatatatacaaaattatactatacatctgctctgtacctagctgtcatcacatagtaaatcttgacaaactttctttatcagcctataaatgtatgccttattattttttataattatatagtatttttatgggggttcactataaataatttaacctattatgaatatgaaaattatttctaggttcatgattacaaacatattttgcactgaagattcttatccatattcttacatacatatcttaagaatctttggtaaatatcaccatagaataaattctgagcagttgctagaacccagcatatatgtgcctttttaatatctatatttactgccaaattttccaattaagtaactctacacctttatactttcatgattagtataagtgattttctcctcattctacagatattgggtgttatcaatttaaaaaattttaccaatctaatgggtgaaaagtagtgtatcattattgtttatatttgaattttcctgattacaagtggggtttcagatgtttttaactctttcgtaaattgtctatttatactctttgcctcactgttttacgagaggacttggttatgtatttcatactgatttgtaaaagtacattataaatgtgaagatgcatccactgtctgttatatttgttgcaaatattttctcccagtcagttgtttgtcttatagcatgtttactgtgcatttcgttatgtagatgtttgaaatttttacataggcaaattatgtactcatttatttattcattcacaaaatatctgttgagtatgtatgatttaccaggtactgttttaggtgctggagatacagcctgaacaaaacagacaaacttttactgccttcaaggagcttatatttagtcaaggagtcatacaataaacaaaataaataagtctgtattatgttagaatgtgataaatctcatgatgaaaagtaaagcaagacttgatgataggaatttctggaaattgttatattttgaaataggttactaagggaaagtctctctgataagatagagcagtgaccacactgcagtaagagagtaagtcatacaaaaaccctgaggtgtgagcatacctgacatgtttgagaaacataaatgagtccagtgtgttaaacagaatgagtgagttgaaacaaagtaggagatgagattagattggtaatgggggaaagattatatagtgccttataggtcatcatagtaggggcttttactcctgagtgaatcggggagcaaatggaaagagttaacatgattgtacattaattttaagaactatcacagcacctgttttggaaacagatcatagaggagcaaggatggaaagcagggaaaccagttatggtgatatttaaataatgcaggctaatgatgttgatggcttggatcaagatagtggcaggggaagtgataagaaatgggcagattttgaatatataatatatgtcaagccaggaagatttgtgtatggaatatgagagagaggaatcaagaatgactccagtttttatcctgagcaaatagagtggagttgctatatgctgaaatacaaaaactttgaaaaaagcaggtttagtgagaaagatcaggagcatagttttttattttatttatttatttatttgttttattatactttaagttccagggtacatgtgcacaacgtgcaggtttgttacatatgtatacatgtgccgtattggtttgttgcacccattaactcatcatttacattaggtatttctcctaatgctatccctcccccattcccccaccccatgacagggtgtgtgatgtcccccgccctgtgtccaagtgttctcattgttcaattcccacctatgagtgagaacatgcggtgttcggttttctctccttgcgatagtttcctcagaatgatggtttccagcttcatccatgtccctacaaaggacatgagctcatcttttttatggctgcatagtattccatggtgtatatgtgccacattttctcaatccagtgtatcatggatggacatttgggttggttccaagtctttgctactgtgaatagtgccacaataaatatacatgtgcatgtgtctttatagcagcatgatttataatcctttgggtatatacccagtaatgggatggctgggtctaatggtatttctagttctagatccttgaggaatcaccacactgtcttccacaatggttgaactagtttacactcccaccaacagtgtaaaagcattcctatttatccacatcctctccagcacctgttgtttcctgacttcttaatgatcaccattctaactggtgtgagatggtatctcattgtggttttgatttgcatttctctgatggccagtgatgatgagcattttttcatgtatgtgttggctgcataaatgtcttttgagaagtgtctgttcatatcctttgcccacattttgatggggttgtttgattttttcttgtaaatttgtttaagttctttgtagattctggatattagccctttgtcagatgagtagattgcaaaaattttctcccattctgtgggttgcctgttcactctgatggtagtttcttttgctgtgcagaagctctttagtttaattagatcccatttgtctattttggcttttgttgccattgcttttggtgttttagtcatgaagcccttgcccatgcctatgtcctgaatggtattgcctaagttttcttctagggtttttatggttttatgttcaacatttaagtcttaatccatcttgaattaatttttgtataaggtgtgaggaagggatccagtttcagctttctacttatgactagccagttctcccagcatcatttattaaataggaaatactttctccatttcttgttttggtcaggtttgtcaaagatcagatggttgtagatgtgtggtgttatctctgaggcctctgttctgttccattggtctacatctctgttttggtacgagtaccatgctgttttggttactgtagccttgtagtagagtttgaagtcaggtagcatgatgcctccagctttgttcttttggcttaggattatcttgacaatgtgggctcttttttggttccatgtgaactttaaaatagttttttccaattctgtgaagaaagtcattggtagcttgatggggatggcattgaatctataaattaccttgggcagaatggccattttcacgatattgattcttcctatccatgagcatggaatgttcttctatttgtttgtgtcctctttcatttcgttgagcagtggtttgtagttctccttgaagaagtccttcacatcccttataagttgtattcctaggtattttattctttttgaagcaattgtgaatgggagttcactcattatttggctctctgcttgtctgttattggtgtataagaatgcttatgatacatctctagaactcttcaccccaatcaacagaatatacattcctctcagcaccacattgcacttattccaaaattgaacacatagttggaagtaaagcactcctcagcaaatgtaaaagaacagaaatcataacaaactgtctctcacaccacagtgcaatcaaattagaatttaggattaagaaactcactcaaaaccgcatgactacatggaaactgaacaacctgctcctaaatgactactgggtacataatgaaattaaggcagaaataaagattttctttgaaatcaatgaaaagaaagacaacattccagaatctctgggacacatttaaagcagtgtgtagagggaaatttatagcactaaatgcccacaagagaaagcaagaaagatctaaaatcgacaccctaacatcaattaaaagaaccagagaagcaagagcaaacaaattcaaaagctagcagaaggcaggaaataactaagatcagagcagaactgaagaaaatagagacacaaaaaacccttcaaaacatcaatgaatccaggagctggctttttgaaaacatcaacaacattgatagaccgctagcaagactagtaaagaagaaaagagagaagaatcaaatcgacaaaataaaaaatgataaaaggaatatcatcaccgatcccacagaaatacaaactaccatcagagaatactataaacacctctatgcaaataaactagaaaatctaggaagaaatggataaattcctcgacacatagactccccccaagactaaaccaggaagaagttgaatctctgaataggccaataacaggctctgaaattgaggcaataattaatagcctaccacccaaaagaagtccaggaccagatggattcacagccgaattctaccagagatacaaagaggagctggtaccattccttctgaaactattccaatccatagaaaaagagggaatcctccctaactcattttatgaggccggcatcatcctgatatcaaagcctggcagagacacaacaaaaaaaagagaattttagaccaatatccctgatgaacatcgatgcaaaaatcctcaataaaatactggcaaactgaatccagcagcagatcaaaaagcttatccaccaagatcaagttggcttcatccctgggatgcaaggctggttcaacatatgcaaataaataaacgtaatccatcacataaacaaaaccaaagacaaaaaccacatgattatctcaatagatggagaaaacaccttcgacaaaattcaacagcccttcatgctaaaaactcaataaactaggtattgatggaacgtatctcaaaataataagagctatttatgacaaacccacagccagtatcatactgaatgggcaaaaactggaagcattccctttgaaaactggcacaagacaggaatgccctctctcactactcctgttcaacatagtgttggaagttctggccagggcaatcaggcaggcgaaagaaataaagggtattcagttaggaaaagaggaagtcaaattgtccctgtttgcagatgacatgattgtatatttagaaaaccccaccgtctcagccccaaatctccttaagctgataagtaacttcagcaaagtctcaggagcatagttttttgattgtcaatattttgttgctgaaataggaaattcatcaattgagggggagagagaggaagaggtaaggaaggcttgaggcctgtcacatagattttaggattttttggaaaaaaagtcttctacttatgaagacttctatatcctgagattataaaaatagatttatatatttcttacaggattttcatggtttttttctgtacatttgcattttaatgcacctgagtatttctgtatgttgtatgaggtgagaaactaactttattttttttcccaaataaatatccagttgactgagcctcatttgttacaaactcaattctttattcactgatataaaattgtatttaaattttttttccaaatttgttcatgaatttttttttctggaatgagtgaattttaacattttactaatggaatcaaaattaccataataaattgtctctacatttttaatgggtgatagcagaaaaatatgttttaattggtaaatgtccaaagtatattcaactctacaagcaagaggttagcttttagttcttctgtgtgacctacaagtatatttcagtaagcaaattttacactaaatttagaaacttaacaaagatgatattgtggaaataatgtaaagtagtctgttgtttctttcagatggcattattataccttaaaatagtgacatgttgaaaaaataaaagtttttttagctcagttctattaggtacaggtgatctttgcttttgcacaaatttcagttatcattacttaacaccgatccacaacaacattgtttaaattttagttgctatgatatattaactcttccatttataaatcatcatctaaataagagatgtgcattacaatcagtggacagtaatttcacttctttcaaattctgtcactaattagtaaccatgcatctgttcagttcctgcactgacagcaaagcatttagttgtgtcacctccttgtctcccagtgataaagcaatgtgacattttacaaaaatggataatcaaaagagaaaattagccaacaaagaagaaagtgcaacaaaaaaaaaaaaaaaggaaagtgatagcactggaagtaaggtttgaatctaaagtaaatggggttatagaattaatagccaaccatagaattgtagacactgccaccatttgagagactctagatatgcagctaaggaacttagtgaaggcaaacttatcaacattaatgaggaaaggagcactgatgaaaaggatgaagatgtcacagaggaagtgttgccatcacaaatttcacattaaaggaactcttggagatattttacaagtttgaaagtataaaggttaacatgctggaagctgatctcagtttagaaacagtgagacaatttctgtgccaaggcatagaaaagatgtgtgctctgtattgtaagttatacgagaagaagggagacactgttcaaattactcttggtaacttttttacaatgaaataaatcactttatttttcaatgtttctaatgtttaaattagcatttaccaaataaatattggatttactattttttatttctttatacatgtgtatctgacattaaaacatattttaatgttttgataacatttttaaaggtcatagaataattacattttcccccattgattattaagatcactttacatgattttggtttgcagtttcatttttccagttccacactaccacgtgaaacaaagagtacccatattataaaggaagagaagaagaacagttttaggaaatataatggtatgattgagggaaaacaagcataagacaaatttctgtaattactgagttgttaagaaataggaatagtggtaaaatatcagataggtagtttgttttatggatgtcactgtttatgaaacagcagctctgttagtcaaaaagcatgattaataaagtatactgaaaaccccagacaaggagtcagtaggcagaaatttgagtcctgggtttgtgtacatgaccttgataagtcacttaattcttcagtgtcttcagtaccttgtccataaaaagtgggagaaaaaaaatcctactttttgtagttattgtgaggtttcaatgagattaaaacatgcttcataaaaaagaaaaaaaaggaaaaggaatgaaacactttgtaaattataaagcattctatacatagtatttctttttatctaaaatgaaagggctggagtagagggtgtctaagatatctggaattctcaaatataatgactctatggaactatatgaatctgtaatgctcttttaatatagtgtaattgttctaaccttcataactcctttttaaaatctaatcatactacagattcatccctttcataatcccagatggcttttatgctgaaattgacaagtgtatcctaaaattcatatggaagtgcaaggaacccagaatagtcaaagaaatcttgagaagaacagatttggaggactcactcttctggatttcaaaacttactacaactatgataccagcactgggtagacatagagactgatggaatagatagagtccagaaatacccatacatttttggtcaactgattttcaacgtaggtaccaaaacaatttaaagggagttaaggatagtcttttcaacaaatgatgctggaacatggatgcagctggaggctactatctatcctaagcaaattaatgcagaagcagaaaaccaaatagcacatgttctcacttaaagtttggaggtaagtattgggtatacacagatgcaaagatgggacaataaattctgggtattcccaaaaggggtaaggagtgggggaagtgttgacaaacctatggagtactatgttcactacttgggcaatgggaacattagaagcccaaacatcaacatcacataatatacccatgtaacacacctgcatacataacccctggatctaaaataaaaaacaaaacaaaaatcaaatcatgctgggaaaagaggatacctgtctgcaaaagaatgaatctggacccctatctcatactgtatacaaatattaactccaactggattactgacctaaatataagaactaaaccataaacatattaggataaaagatgactaaattcttgtgaccttgcattaggtaatggtttcttagctatgacactaaaagcacaaacaactaaaggaaaaataaattgggctatattaaaattcattaggtaatggtttcttagctatgacactaaaagcacaaacaactaaagaaaaaataaatggggctttattaaaatttaatgtgttttctgttgcaaatgataccatcaagaaagtgaaaagacagctcacgagatgaaagaaaatatttgcaaatcatatatgagataaaggatttgtatacagaatatataaagaattcttataattcaacggaaagcaaataactcagtttttaaaagtgcacaaagtgaattggacctaacaaacatatacaaaatattctatccaagaaaaatgcagaatatacatttttgcaactgcacatggaacattctccagaatagacaatatattagagcacaaagtaagtcttcatacacttaaaaagattaaaaccacacagcatatattttttaatcatgatggagtgaaattagaaatcaatggcagaaagtaaactggaaaatctactaatgcatgtaaattaaacaagacgctcttaaccaatgaggcaaagaagaaatcacgagggtagttagaaaatgtaatgtctttttttttttttttttttttttgacagagtcttattctgttacccaggttggagtgcagtggcgtgattgtggctcactgcaacctctgccttccaggctcaagcaattctcatgcctcagcctcctgagtagctgggattacagatacgcaccaccatgcttagctaattttttgtagagatggggttttgccatgttggacagttggtcttgaactcctgacctcaagcaatccaccctccttggcctcccgaagtgctgggattacaggcatgagccaccatgtctggcagaaaatataatgagacaaatgaaaatgaaaccacaacataccaaaacgtacaggatgtagtgaaagcaatgctaaatgggaaattaatagctgtaaatacttacattagagaagaaacatctcaaatcaaaaacctaactttacatcttaaagaactagaaaaagaaaaactaaatccaaaactagcagaaagaaagaaataataaagattagagcagagataaataaaatacagaactaaaaaaatcatagatgaagtcaacaaaactaaaagttgtttcttcaaaaagataacaaaatagaaaaagttttagctagcttgactacaagaaaaagagagaagactcaactaaaatcagaaataaaagaggagacattactaccaatcttacagaactaaaaatatatgagactgctatgaacaggtgtttgctaacaaattagataacctggatgaaatgggcaaattcctagaaagacacaatctaccaagactgaatcatagaagtagattatatgaatagacctaaagtgagtaagaagattgactcagtaatcaaaaaccttccaataaagaaaagctcaggaccagatggctacactggtgaattctaccaatctttttttttttttttgagacagggtctcgctatgttgcccatgctggatggagtgcagtggtgcagttacggctcactgcagccttgtccttgtgggctcaagtgatcttcagcctcccaaatattttccaaacaattaaagaaggattaacagcatttgttttcaaggtcttccaaaaaaattgaagaggagggaacacttccaaactcattatattatacctggattaccctgataccaaatccagacaaagacactacaataaaagaaagctacagaccaaaatcccttatgaatattgatgcaaaaaatccttaacaaaatactagcatactgaattcaacagcatattaaaaggattatatgccatggtcaagtgagattttttcctgggatgcaaggatagttcagcatacaaaaatcattagtgtaatacaccatcacactaacagaatgaaggagaaatcccacatgatcacttaattaatgcaaaaaaaagcatttgacaaaattcaacactgtttcatgattaaaaaaacacaccacaagctaggaatagaagcgaactatctacttattataaaggtcatatatgaaaaaacccacagctaacaatggtaaaagtctgaatgcttttcctctaagaccaagaagaagttaaggattcttaattttactacttcctttcaacatagtactggaattcctagccagaccaattaggcaagaaaaagaaataaaagtcatcttaattggaatggaagaagtaaaattatctttgttcagagatgatataatgctatgtagaaaactctacaaagataccatatatgcggaaaataggtagaactaataaacaaattcagcaaagattcaggataaaaaatcaacacacagcagtcagttttgaatgttttgatgcatcaacaatgaacattccaaaaaggaaattaagaaaattaaatttacagttgcatcaaaaagaataaaatacttaagaataaacctaaccaagaaggtggaagacttgtgctctgaagactacaaaatattgctaaaaggaattaaagaagacagaaataaatggaagatttaatactgttaaaatgtccatactacccaaagcaatacacagattcaatgcaacgcctatcaaaactccaatggcatttttttttccagaaacgaaaaacttagtctaattcacaaggaaatctcaagggaccccaactagccaaaacaattctaaaaaagaaccaggttggaggactcataataattttttattagaaaacatattacaaagttatagtaatcaaagcggtgtggtgctgacataaagacagcaaatagaccaatgtaatagatagaccagagataaaatctctggtctgtagttgaatgatctttgacaagggtgctcaatggggaaaggcgttcaacaaatgcatgctgggtaaaatgaatgtccatatgcagaagaatggagttgaaccattttcttacatcatatataaaattaattcaaaaaagaatgaagacctaaatgtaagacctaaaactataaaactcttagaagaaaacatgggacaacatgcctcatgacattagatttttttcaatgatttcttggatatgacaccgaaatcacaggcaacaaaagaaaaaatagattaattggacaacatcaaaatgttaagcttttgtgcatccaagaacactactaatagagtgaaaaggcaactcatgggatggaagaaaatatttgtaaattgtatatctggtaaaagattaatttccagaattttaaaaagaactcctacaagtcaataacaaaagccatcaaacaacccaattcagaaataagcaaatgacttgaatagacctttcttcaaagatgatatacaaatggcaaattagtacatgaaaagatggtcaacatcactaatcattagggaaatgcagtcaattctacagtgagataacacttcatacccattaagaaggctattatataaaaaacagtaaataacaagtgttggtgaggatgtggagaagttggaactctcctgtattgctagtaggaatgtaaaattgtgcagccactatggaaaacattatggcagttcttcaaaagtaaacacagaattatcatatgatctagcaatttcacttctggagacacatctaacataattgaaaacaaaaatgggacctcaaagagatgtttttgtagccatgcttctagcaacattattcacaagtcacaaggtggaagcatcccaaatgtccattgatagaggaatgtgtaataaaatgtggtatgcacacacaatagatattttttgaccttaaaatggaataatattctgatacatactacaatatggattaactttgaagccgttatgctaagtgaaataagccagttataaaaagacaaatattacatgaccccagttacataaggtacctagaacagtcaatttcatagagacagaaggtagaatggtaattgctcagggttgggggaggggaaaataaggagatattggccaaagggtacaaacatttagttagttataagatgaataaactctagggatcaaatgtacagcatgggcactatagtttaaaatattgtgttgtatacttgaaatttgttgagagtagatcttaattgctttcaccacacactgaaaaaaaaattgtaactcggtgaagtgctagatgtgttaactaatttcattgtggatatgagtataaggtttccgtttgggttgataaaaaaaattctggagatatatggtggtgatggttgcaaaaagtgtgaatgttgtttatgccacaggactatacccttaaaaataattaaaatggtaagatttatgttttgtatattttgatactctaaaaagccacataaaatgaaaatattaattagcttgatttaatcatttcacaatgtatacatgtatcataacatcacatcatactctataaatgtatatagtttttatcagttaaaaataaaatatttttaagtgaaaaaatgaacaaaggaattgaatagctatttctctaagaaagatgtacaaatggccagtatgtacatgaaaaggtgtttaacctcattagtcattatgaaaatgcaaatcaaaaccacattgagataccacttcacacttacttgagtaggcataataaagagagaaaataacaaatgttggcaaggatgtgaagaaattagaacccttttgcattgccagtgggaatgtaaaatgatgcagctgctgtgaaaaaatatttgacagtgcctcaaaaagttaaataaagagttatcatatggctcagcaattccactcctaggtattttcccaagagaaatgaagctgtatttctgcacagaaacttgtacttgaatactcacagcagccaaaagtgaagaaaacccaaatcacaagaatggctaaacaaaatgtgctatcccagagaaaattgaggagagtgaggatcatcatggtggacgggagacaggactggattacagctccaactcggacagacagagcagcatacagaggtacgcattgtgaatttagttccagatcaactgcaacaacaaaccagtaatcacaagaggatgcacagaccctctgaaggaagtggacttctcttgcaggacccaggagacaccccaaatactgtgagtgccccaaatatagaagtggaaagtggagatccttctctcccaaatacacaccgccactggagaaactggaggtctgtttgtgggagaagtttctgaccttacctggagctgagtccatttagagagccaagtgaaatacaggggtagaggaagcagcaggaaaggccctgggggcttgctgggtcaccaagcaggccattcctgcctggcaccacagggatccatcgggagggcagccagaggagtggaggaaagcaccacagggagaaggaagcctccagctgaactttgtaacaatttgaaccaggcgagaagcctcctggccagaactcgggggagggcatgaatccagtgtgcagactccacagatgggggaagaaccaagcccttttcttttgcagcttggtggcaggtagcctgcggcaagttctcaagccctgctcacccaccacctggaaacagacttggggctgttaataggggcacagtgggagtaagatcggccctttgatttgtgtgggagttgggtgaggcctgtgactgctggttttcccccacttctctgacaatctgcatgactcagcagaggcacccataatcctcctaggtacacaaccccattgatctgggaacctcacctccatcccccacagcagccacaataagacctgcccaaggagggtctgagctcagaggtccctagccctgcccccacctgatgagcctttcctatccaccctagtagctgaaaacaaagggcatataatcttgagatttctagggccccacctaccactggttcctctccatactaccacagctgatgctttctggaaagtgccacctcctggcaggaagccaaccagccccaaaatagagcattaaaccaccaaagataagaaccctcacagagtacatttcaccccctgccacctccactggaagaggtgctcgtacccatggctgagagaccatagacagttcacatcacaggactttgtgcagacaattctcagtagcagctgagagctgggtagactttctgggtggctaaaccaagaagagagacaataatcactgcagtgcccctcacaggaagccacatccataggaaaagggggagagtactacatcaagggaacatcccatgggacaaagggatcagaaaaacagacttcagccctagacctaccctgtgacaaagcctacccaaatgagaaggaaccagaaaaccaactctggtaatatgaaaaaacaaggctctttaacactccccctctccaaaaaaaaaaaaaaaaaaaaagtcacactagttcaccagcaatggatccaaaccaagaagaaatccctgatttacctgaaaaagaattcaggaggttacttattaagctaatcaaggaggcaccagagaaaggtgaagcccaatgtaaggaaatccaaaatatgatacaacaattggatggagaaatattaaaggaaatagatagcataaataaaaacaatcaaaacttcaggaaacaatgaacacacttatagaaatgcaaaatgctctggaaagtctcagcaatagaattgaacaagtagaagaaagaaattcagagctcaaagaataagaaaatataaacaaagcctccaagaagtctaagattatgttaaacaaccaaacctaagaataatcggtgtttctgaggaagaagagaaatctaaaagtttggaaaacatatttggggaataattaaggaaaacttccccagccttgctagagacctagacatccaaatacaagaagcacaaagaacacctgggaaattcatcacaaatcgatcattgcctagggacatcgtcatcaggttatctaaagataagatgaaggaaagaatcttaagagctgtgaggcaaaagcaccaggtaacctataaaggaaaacctgtcagatcaacagcagaattctcagcagaaaccctacaagcttgaagggattggggccctatcttcagcctcctcaaacaaaacaattatcagccaagaattttgtatccagtgaaactaagcatcatatattaaggaaagatacagttgttttcgcacaaacaaatgctgagagaattcgccactaccaagccaccacaacaagaactgaggaaaggagctctaaaacttgaaacaaatcctggaaacacataaaaacagaacctctttaaagcataaatcacataggacctacaaaacaaaactacaagttaaaaggcaaaaataaaaaccccaaaataccaaggtacgcaggcaacaaatagcatgatgaatgcaatggtacctcacatctgaatgctaacattgagtgtaaatggcctaaatgctccacttaaaagatatagaactacagaatggataagaactcaccaaccaatgatctgctgccttcaggagactcacctaacacataaggactcacataaacttaaaggagtggaaaaaagcctttcatgcaaatagacaccaaaagcgagcaagagtagctattgttctatcagacaaaataaactttaaagcaacaacagttaaaagagacaaagagggacattctataatgctaaagggccttgtccaacaggaaaatatcacaatcctaaatatatatgcacctaacactggagttcccaaatttataaaacaattactaatagacctaagaaatgagatagacagcaacacaataatactgaggaacttcaatcctctactgacagcactagacaggtcatcaaaacagaaagtcaacaaagaaacaatagatttaaactataccttggaacaaatggacttaacagatatatacagaacattccatccaacaaccacagaatacacattctattcaaaagcccacgaactttctccaagatagaccatatgataggccataaaagaagcctcaataaatttaagaacattgaaatcatgtcaagcactctcagaccacagtggaataaaactggaaatcaaatccaaaaggaatctgcaaatacatggaatttaaacaacttcctctcgggccgggcatggtggctcacgcctgtaatcccagcactttgagaggccagtttgggcagatcacctgaggtcaggagtttgagactagcctggccaacatggtgaaaccttatgtctactaaaattacaaaaaatagctggggatggtggcaggcacctgtaatcccagctactcaggaggccaaggcaggagaatcacttgaacccgggaggcggaggttgcagtgagccgagattatgccactgcactccagcctgggtgacagaacaagactccgtctccaaacaacaacaacaacaacaaaaaaaaaaaaaaaaaagaaagcaaagaaaagaaacatgctcctaaatgagcattgggtcaaaaatgaaatcaagatgaaaattaaaaaattgtttgaactgaacgataataatgatataacctatcaaagcctttgggatacagcaaaggtggtgcaaagaggaaagttcttagccctaaatgcctacatcaaaaagacgaaaagagcacaaactgacattccaaggtcacacctcaaggaactagagaatcaagaacaaatcaaacccaaacccagcagaagaaaggaagtcaccaagatcagggcagaactaaatgaaattgaaacaaaaaagaattgcaaaagataaatgaaacaaatagctgcttcttcaaaaacataaataaaattggtagaccattaccaagattaagaaaagaagagagaaaatccaaagaacatcattaagaaatgacacaggagatattacaactgacaccactgaaataaaaaagattattcaaggctactatgaacacctttatgtacataaactagaaaacctagaagagatggctaaattcctggaaaaataaaaccctcccatctttttttttttttacaattagtattaaaatgggaagcatatctagctcccagatcttggttacttttttttaaaattattattattatactttaagctttagggtacatgtgcacaatgtgcaggtttgttacatatgtatacatgtgccatgttggtgtgctgcacccattaactcgtcatttagcattaggtatatctcctaatgctctccttcccccctcccccgaccccacaacagtccctgatgtgtgatgttccccttcctgtgtccatgtgttctcactgttcaactcccacccatgaatgagaacatgcggtgtttggttttttgtccttgcgatagtttgctgagaatggtagtctccagcttcatccatgtccctacaaaggacatgaactcatcatttttaatggctgcatagtattccatggtgtatatgtgccacattttcttaatccagtctatcattgttggacatttgagttggttccaagtctttgctattgtgaatagtgccacaataaatatacatgtgcatgtgtctttatagcagcatgatttataatcctttggtatatacccagtaatgggatggctgggtctaatggtatttctagttctagaaccctgaggaattgccacactgacttccacaatggttgaactagtttacagtcccacctacagtgtaaaagtgttcgtatttctccacatcctctccagcacctgttgtttcctgattttttaatgatcgccattctaactggtgtgagatggtatctcattgtggttttgatttgcatttctctgatggccagtgaggataagcattttttcatgtgttttttggctgcataaatgtcttcttttgagaagtgtctgttcatatactttgcccactttttgatggggttgtttgtttttttcttgtaaatttgtttgagttcattgtagattctggatattagccctttgtcagatgagtagattgcaaaaattttctcccattctgtaggttgcctgttcactctgatagtagtttcttttgctgtgcagaagctctgtagtttaattagatcccatttgtcaattttggcttttgttgtcattgcttttggtgttttagacatgaagtccttgcccatgcctgtgtcctgaacagtattgcctaggttttcttctagggtttttatggttttacgtctaacatttaagtctttaatccatcttgaattaatttttgtataacgtgtaaggaaggtatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgttttggtgactgtagccttgtagtatagtttgaagtcaggtagcgtgatgcctccatctttgttcttttggcttaggactgacttggtgatgcaggctcttttttggttccatatgaactttaaagtagttttttcccattctgtgaagaaagtcattggtagcttgatggggatggcattgaatctataaattaccttgggcagtatggccattttcacaatattgattcttcctacccatgagcatggaatgttcttccatttgtttgtatgctcttttatttcattgagcagtggtttgtagttctccttgaagaggtccttcacatcccttgtaagttggattcctaggtattttattctctttgaagcaattgtgaatgggtcttcactcatgatttggctctctgtttgtctgttattggtgtataagaatgcttgtgatttttgcacatcgattttgtatcctgagactttgctgaagttgcttatcagcttaaggagatttggggctgagacgatggggttttctagatatacaatcctgtcatctgcaaatagggacaatttgacttcctcttgtcctaattgaataccctttattttcttctcctgcctgattgccctggacagaacttccaacactaagttgaataggagtggtgagagagggcatccctgtcttgtgccagttttcaaagggaatgcttccagtttttgcccattaagtatgatattggctgtgagtttgtcatagatagctcttattattttgagatacatcccatcaatacctaatttattgagagtttttagcatgaaggttgttgaattttgtcaaaggccttttctgcatctattgagataatcatgtggtttttgtctttggttctgtttatatgctggattacgtttattgatttgcgaatgttgaaccagccttgcatcccagggatgaagcccacttgatcatggtggataagctttttgatgtgttgctggatttggtttgccagtattttattgaggatttttgcatcaatgttcatcaaggatattggtctaaaattctctttttttgttgtgtctctaccaggctttggtatcaggatgatgctggcctcataaaatgagttagggaggattccctctttttctattgattggaataatttcagaaggaatggtgccagctcctccttgtacctctgaaaaccctcccatcttaaatcaggaagaattagataccctgaacagaccaacaacaagcagcaagcttgaaatggtaattaaaaaattaccaacaaaaaaaagtctaggaccagatgaattcacaacagaattctgccagacattcaaagaagaattggcaccagtacttttgacactattccacaagacagagaaagaaggagccctccctaattcattttaggaggccagcatcagcctaataccgagaccaaaaaagaaaactgcagactgatatccttgattaacatcgatgctaagatccttgacaaaataccagttaactgaatccaacagcgtatcaaaaagataatccaccatgatcaggtgggtttcataccaaggatgcagtgatggtttaacataggtaagtcaacaaatgtgatacaccacataaacagaattaaaaacaaaagtcacacgatcatttctatagatgcagaaaaaaaacattcaacaaaatccagcatcactttacaattaaaactctcagcgaagtcagcatacaagggacatacctcaatgtaataaaagctatctatgacaaacccacagccaacatagtactgaatggggaaaagttgaaagctttccctctgagaactggaacaagacaaggatgcccactctcaccactcctcttcaacatagtactggaagtcctagctagaacaatcagacaagagaaagaaaaaaagaacatccaaatcggtaaagaggaagtcaaactgtcactgtttgctgacaatatgatcgtttacctcaaaaaccctaaatactcctccagaaagctgctagaactgataaaagaattcaacaaagtttctggatacaagattaatgtacacaaatcagtagctcttctttacaccaacagtgaccaagcagagaatcaaatcaagaactcaaccccttttacaatagctgcaaaaaataaaataaaataaaataaaatacttgggaatagacctaaccaaggagacgaaagacctctctacaaggaagactacaaaacactgctgaaagaaatcatagacgacacaaacaaatggaaacacatcccatgctcatggatgggtagaatcaatattgtgaaaatgaccatactgccaaaagcagtctacaaatttgacacaatccccatcaacataccaccgtcattcttcacagaattagaaaagacaattctaaacttcatttggaaccaaaaaagtgcctgcatagccaaagcaagactaaacaaaaagaacaaatctggaggcatcacactacctgagttcaaactatactgttaaggccatagtcaccaaaacagcatggtactggtataaaaataggcacatagaccgatggaacagaatagataacccagaaatgaacccaaatgcttacagccaacggatcttagataaagcaaacaaaaacataaaatggggaaatgacacccttttcaacaaatggtgctcagttaattggctagtcacatgtaggagaatgaaactggattctcatctctcaccttatacaaaaatcaactcaagacggattaaggacttaaatctaagacctgaaactataaaaaatctagaagatatcattggaaaaatccttccagacattggcttaggcagagattttatgaccaagagcccaaacacaaatgcaataaaaacaagataaataattgggacttaattaaactaacgagcttttgcacagcaaaaggagcagtcagcagagtaaacagacaatccacagactgggagaaaatcttcacaatctgtacatctgacgaaggacgaatatccagactctacaacgaactcaaacaaatcagtaagaaaaaaaaacaaaaaacaaagaaacaatcccatctaaaagtaggctaaggacatgaatagacaattctcaaaagaagatatacaaatggccaaaaaacatatgaaaaaaaatgctcaacatcactaatgatcagggaactgcaaatcaaaaccgcaatgcaataccactttactcctgcaataatggccataatcaaaagatcaaaaaataggagatcttggtgtggatgcggtgatcagggaacacttctacactgctggtgggaatgtaaactagtacagctactctcgaaaagagtgtggagattccttaaagaactaaaagtagaactaccatttgatccagcaatcccactactgggtatctactcagaggaaaataagtcattatacaaaaaaaagataattgcacacgcatgtttatagcaacacaatttgcagttgcaaaattatggaaccaacccaaatgcccatcaatcaaagaactgataagctgtggtatatatacatatatacaatggaattctactcggccattaaaaggaataaattaatggcatttgcagcgacccggatgacattggagactattattctaagtgaagtaactcaggaatggaaaaccgaacattgtatgctctccctgatatgtgggagctaagctatgaggacgcaaaggcataagaatgatacaagggactttggggacttgtggggaagggtgggagtggggcaagggataaaagactgcaaatacggcacagtgtatactgcttgggtgatgggtgcaccaaaatctcacaaatcaccactaaagaacttactcatgtaaccaactaccacctgtaccccaataacttatggaaaaattaaaaaaaacaagcaaacaaaaaccaaagtgtgctatcccatacactggaatatcatttgacaattttaaaaaatgatgtactgatacatggtgtaaaatggatgaaccttgaaaacattatgctaagtgaaataagcaaggcacaaaatagccacatatcatatgatttcatttatatgaaatgtccagaataggcaaatctgtacaaagagaaggcagattaggttttgctacggcttggagggagtgagaatgagaaatgactgctaatgtgtacagtttcttttagggggaaatggaaaattttctaaaattagattgtgatgatggttgtacaatcctatgaagatactgaaaacattgaattgtacactttaagtggatgaattgtacggtatataaattatatctcaataaagttattttaaaacaatgcacattatagaaaatctacaaagtttctgctaataacatgtaatgtttttagttgtctttaaattactatctttattttaggatgtttttagttctagaatcctgagatttgatgaacaaatgggtgtgattttccccacaattaactttgggcacattttaagtaattgtatgtgctgtgattactagaactacacatgctgtgctagtatggaatagcatgatttatgaatcatattttttctttaatatttctttagtattttgagccacctgtaggctcattgagctgatgtttggagcaatttgctattatgcctatcttgcatggtaaagggtagtatagagctcattatcttttaagtttagttcatattctttttctctaagttcatcattaccttagacatactactattgaatttcatgtggcagctttggcctgctcaggcagccttgagccattatttatcagtttgttactgttagcttaacatttcactactgggaagagctaaataacatgcaaatttgaaggtcttattgtataattccttttctagataattaaaatgttaatggttgctcaatggatataaagcttcagttatgcaagatgagtaagttttacagatctgttatacaatatggtgcctacagttgacagtacagtattgttcaccttaaaatatgttaagaggatagatttcatgttaagtgctcttaccacaaccccccgacacaagaacatgaagaaatttttggaggtgatggatatgtgtagtactttgattgtgcttatggtatcatgggtatatgcatatatccaaactcataagtatgtatgcattatgtgcagttttatatataaattaataaagctttaaaaaagtatctctgcatgcacttttaaatttccctctgttaatattctgggtctaaaatagaacctatttatggttttgttcatggtctttaatctccaaatacagataaggttgtaaaaacattaacaattatgtgggaaccacaacttccaactgatggtctactcttgtaatattcttcttgcataaagcaagatatgatgtttactctttctcctcaaatattttccttttgttgtctttgtttcccccagtggcaatgcttctctagttttacagtggaatgcaagaacaaaagtgattagcttttttaccaatagatgtcttctgttctgtaaaatggggcaagcctgtaagtttattctgaattttgggttatagtatggaatggaggagaagatgctattactaggacatagtagagattggctatgatccaaataccattacattacaatttgaatcttaacaacaaagaagatatcaaattgactcctttttctacgtgatacaacacagtgaccttgaaagcagttctaatttcaggcttgtctttcagtgttactatagtcattagatagtttcacaatggtaaatgtgacttattaggtatgagatatttcattttcagaattatatcaaagcttgacattagaacagatgtagatatttgcagctgtgtgtccgagtcattcaaatcgcttctacctagaagtgcaaatagatttgaattttcctttctcagagtgatttgtgtccagtttgtagattttctgagcactgtcttctttatctcttcttgctttccttttttgaaattcattgttttcaatgagtttgtgtgtgaataataaaaggctagataaagcttaagctagcaaatttcagtgtttttttcagaagccctaataaaatatttactttatttttaaaaggtacttggtttgaaggagtagggccataagagtgattacagaaacggtattgagggcaagtgctggctgaacttagagactgggcttacagtagtccccccttaccaagggggatacattccaagaccccccgttggatgcctgaacctgtggataatacctaaccttttatatactgtgtggttttttttttccatctggtaacagagacagctactaagtgactcatagacaggtagtgtttatagcatggatatgctggggaaaggagtagttcaggtttcgagagggatggaatgggacaacatgacattttatcatgctacacaaaatggcgtgcaattaaaaacataaattatttatttctggaattttcaatattttcagaacacaggtgactgaaaccatggatagcaaaaccatggataaggaagaatttctgtacttttagaatttaatgtcctttagtatcataaataatccagagtttgccttctgcctttcagatttaccactagcagaatagtggaatttttttcttgttttttattttggtatatacatttaattttttcatgaataacaaaaagaatcatgatagtttattcaaaggtttcccatgtaaacacctaagatgggaccaattcaatccaaaatttaattgtatacctattatgtgcctcaaaatgaactagatatttgatttacaaggttcagaaaaaatgtatatattcccagcccaagattcttaatttttttaaataataggatgtaaggaaaaagagactttagtttaaagagctattaccataatgcagaaacatgagtcaaaaatagatcttactcacctgcaagtgtatgtactaagtgaggaaggaagtattcagtaggtgatgttgaacactagcaccttattgtaaaggtcctgatcttcatgcgcagagcagcaagccctgcagtagagatttagtgttaaggtatatgttgccattgttattgggaaaaacttgttttaattgtgaaagtgggtatgaattcttctaaggctctattggaaaaaaccttaatgcaaatattcattgagcaaaaacggttatacatatgtgaattatctcttacccaaaataaactttcaatgtaattaaggagttaagactgcatatatgaagccattgtagacatgacagagtaagaacctaccctaacctcttggggtaaactctctttgcccaggaatgcttcatggaagaagtaggatttttcttttcttgttaagaggcagggctccctctgtcatccaggctggcctgtagtggcatgatcacggctcaatatagccttgacctcataggctgaagccatcctcccacctcagcctcctgagtagctgggactacaggcatgcaccactacgcccagctgatcttttttattttttgtagagacagagtctccctttgttgcccaggctggtcttaaactcctgggctcaagcaatcctccagccttggcttcccaaagtgctacagccacaacactcagccagaagtgggattttagatgcccactgaagaattgatagacttccttatgttacagtgaaaatcacctttttcagtagaacgtactatagcttttggttgacatgtgtactggaagcaatgaattgcattatggcacagtaggaatgataaacacaggttctgaagtcagactgtttgaatccaaattcggatttcatcacttactagctccatcactataacatgggaataataacagtatctttctaatagggttgttaaggattaatgagaataatacatctacatactgtgagaatagtatgggctatgtagtctgattggctacatagctgattgtagtctggttcaaatcccagttctgccacttacaaaaaccttaggcacttggcttctcaagattcagttttctcatttataaatggagataatgaagcctaactcacagaactgttgtgatgattaaatgaagcaatttacatcaagtacttactggagtgcctgacatataataaaagctctataaataatgttatgttcttatacaatctaagtcgtgtagagacttcagtattatctttttattcgtgttttcagggtgagcctggtctgcctggatacccagggaaccctggtatcaaaggttctgtgggagatcctggtttgcccggattaccaggaacccctggagcaaaaggacaaccaggccttcctggattcccaggtaaaatttcttctcttaaatgcttccttctttccttccttatctactccaaccagtatcacagagcagcttcttatttggcagacttatattttatttcccaatcagatactgactagcaacataatctcaaactatctctttaccttttctttgcccaaatttatttctgtataaaatgagaatgaatattactgactcagcaggacaatatcctgtggacagagagactgtttggtggagcatttttcaatctttgactgctagccacaaatcacttaagaagccttgctatttttgtaggtaataatatatacttccaagcctctgcctgcagctgattatcttagaaaggtatgcccaggcacaccgctggtagcggttggtagaacaatcatacagttccttcaaatggcaaggattgagccattcaagtaagagattagcactatagtcaattatgtagcctgaactagattattatagtacctacttgtttagggttgaatttattttttgcttgttttgaattacacagtggcatggatgaatgaacctttcctttttattgaagtgaagcatacatgtagtaaagtacacttaagactatagatgagtttttacctaagtacatatatgtctttgaattgaccatatgtatcaagatataaaatagtttcttcatcccacgaagtttacccatgcccctacgccccccaaccccgaggtgaccactactatgacttccattaccatcagttaattttgcatgttattgaaattcatataaatgaaatcatacagtgatccttgtatctggcttttttcagtcatcattatgtgtaaaagattcatttattttgttacacgtgtcagtagtttgttctttatcattgctatgcaatattacattgaagaatgtaccacagtcaattacacattcccctgttgatggacttttgggttgtttccagtttgggactattatttttaaaaatgctattaacattcttttacatatcttttgataaacatatacattgatttctcttagacaaaaacttagtagtagaaatactgaatcacagggtaggtgtacattgaactttagtagatgctgccaaacagttttccaacatggtttgtaaattagtttcaacagccatgtatgaaatatccagttctccaattgcccatgtcctcaccatcactgggcagtgtcggtcttaattttatctgttttgatgagtatgtagaagcatctaattgaggtttgaatttacatattcctaatgaataatagtattaatcatctttttattatactattggccatttggatagcatctttttgaagtttcttcttaagtacttttgttcattttttattgaattgtctgtcctttttcaaatagattcagagtagttctttatatactcaagatatgagtcctttgtcagatacatatattgcaaatctattctctgtgcctcagatttgcctttcctaatgctgttgtgtaatgaacaaaagttgttaattttaataaaatccagtgtatcaatctttcctttcatgaatagtgatttttttatccaattcaataaatatttgtctatttgaggttatggaaataatcttctaatttttataacatgtttcatgtttaaactttcatatttggcttatgagctatctcaaataaaaatatttttacagtgtgaggtaggggtcaaggttcattttttttccagcacagttatccaattgctccctacactattttttttttaaagaacctaaacgcatccaataaattacagtcacacctttgtaagaaagccaaatgactgtacatgtggtgggctatttccagactctgtgtactgttccaatggtttattttctattgctgctttaacacaacactgaattactgtaaatttatattaagccttgaaaaatggtgggtaagtactagaaatttgtttcagttttttaaagcttgtcttggctattctaatttttttgcaggggaaatcagtttatcaatttccatttaaagtatctgtagggatttttaagtttgcaataactctctaggtaaggtagaggagaattgatattttgacagtattcaaccttccaatgaaatgaacatgttatctctccatttatgtaggtattgagtttgatttaacaatatgctgcactttttgttttgtaaatcttgaacatattttattaaatttatctctggaaatttgatgctttctggtgacatttaaatcatattgcttttcccagttcatcttccagttgtttcttggaagtatatggaaataattgacctaggaatattgaaataatatatgagaaaattgccaatttcactttttaaaattctgagtttgtataattttttgttttataaaatatcaccttagatatttttatttcttctttttcatttctttataccttttatttctttttcatgcttaattgcaccagttaggacctgtagtgcagtgtttaatagaagtggttatagtcaacatcattatcttttttctaaactcagagggacaatgattgctatttttccattaaatgtaatgttagtgccagggttttggcacatatattttactaaattaaggaaatccctttctagtcatactataatgggaatttttataaagaatggatgcgagttttatcaaattctttttctgaatctacagagatgataattgttttttctcctttactcttgatataatgaattacactgattgatattttatgtaaaaataaccctgtattcttgggataaactccaagatggtcatactgtacacattatctttaagtattgttggactggatttgctgttttttaaaaaattatacatggccatgagagagattggcctacgattttcttttctcatagtgtccttgtcaatgttttagtatagggatttgctggccttatgagctgggaagtattccctccttctctattttttctttaaatgtttcatagaattcaccagttaaggaatctggatctgtagttttctttgtagaaacctttttaaattacagattaaaagtctttaacagttatattactattcagatgatttatttttatgtcagtttaaatacattgtgtttttcaaggaaattgaccatttcatctaaattgtcaaattcattggcagaaagttgttgataatatccttgttttgtccctttaatttctgcagaatgtgtactgaagtctgcattttaataatgttttgatataagtaattttatttctttattttgatcaagcctctgaggcattcattaagctttattaattgttaaaaattaactttcgtaagtgattttctctaccatttgttttctattccattgatttctgcttatatctgtattatttcctaccttctaccttctatggatttaatcttgctgttctttttctagcttctttacctggaagcttaaatcatagatttttcagctttgtcttttctaatagatgtatttaaaaacttaaatttccatctaaggagtgctcaaaccatatcccagaaattttgttcttttgcgtttttcctttgatcattcggtttaagatattttctaattttcctgttgatttctgtttttctccatagattatttagaattgtgttgctcaacttacaaatatttgggggcttcccagatatctttatgttattgatttttaatttgattctattgtggccagaatacatattttgtatgatttaactattaatacttattgagacttatcatatggccaaatttagggtttatctgggtgaattttccttgtacccttgaaaataatttgtattctgcaatttgtgtattgcattataaatgtccattaggtcaggtttgttggtagagttgttaaaatcttgtgtattcttaccaacttcttgcctaattgttttatcaattactgagaggtaggtgttaaaatttccattatgattgtagagttttctatttctccttttctctctgtcaattttttgctgtatgtcttttgagatatttttattaggtatatataaattcaggaaacgtatgtcttcttgaagagttgacctttttatcattatgtaaagaccctctttattttcataatactcttttctttggatttttctttgtctgatatcagtatagatacatcagattctttatacttagtacagtataactttttctatataatttttatttttacctgtctgtacatttaaaatatgttttttaggaataaaatgcattcatatcttgcttcttttcgagtccaacaatctttcccgtttatttggagtgtttagttgatttatatttaatgtatattgttatgtttggattttagtcttccacattgctatttgttttatgctcctcctttgtccctggtttcctgttctgtttgggttcatcagatatgctgtggtattccattctatctcctctattggcttttaagctctccctctttctactatttttaaatgattgctccaaagatttcagtgtgcactcataatttaccacattctgcattaaattaatattatgtgacttcacatataatgtaagattcttacaacagtgtaattttatttacatataatgttcttttgtgtgattgtgtttatatatttcagatgattattatataggtaataaattttacaattaattgctattactattgctttaaacagcttcttctaaataatttagcatgagaaacaaaaccaattttcatatttaccaacatatttacatttctactcttctaccctcctgtgcagcagacttctagttggtatcattccctaaagcctgacgttcttccaccgtcatttattgtaaaatgattttgctggtgacaaattctctcaccgttaatttatctgcaaatgtctttgttttagttccattttaaataaatttttcactggatatagaaatccctttttgatatttgttgctttcagcactttaaatatttcttccactgtcttttcgtctccatttttcctgataataacacatcaattatttttaatattttgctcctttatattatgtctggtttttctctggatgtatttgagattttctctctgtaattggttttcaatagtttctttttgttgtggttagttatggttgtatttattttgccctctattcattaatattcctggatctgtagggttgttattttttaataactttggaaaatctcagctatcttttcctcatatatagtcgtgtgtcacataacaacattttggtcaacaacaaaccacgtatatggtggtggtctcatatgattatcatggaactgaaaatttcctatcaccacgtgatgtcatagctgtagtaacattgtatcacatttataatgtatttttactgtaccttttctaggtttagttatacaaatacttaccattgtgctataattgcctacaggatgcagtacagttacatgctatgtaggtttgtagcttgggagcaataggctctgctatacggcctaaatgtataataggccataccatctaagtttgtgtaaatacactttatatgttcacacgatgacaaaatcgcccaacaactcatttcttaaaacatacccagttgttaagtgacacataactgtatttcttctgtcgtattttctcctcttcttttggagtgcatattagatcacttgatactgtatcacaggtcactgagggtctaggtatgttttcaatttttattctctctgagtttaatttggatggtttttattcactgccttcaaatttactgattttttgatgtgttcaatattctgttaatcgccacaaaaattttaatttccatttggttcttttaagagttatcatatttttccagaaattccctattttttactcattatatacatgtttgcctatagattctttaacatatttattatagctattttaaagatcttttcagcttattccaaattttcagataaccatgtgtctatttctattggtagttttgtttttcttgaataagcaccacatattcaagtttcttccaatctgctaatttttattgtatactaaatgatatggatagtatggtataaagattctggattctattaaatttcttgaagaatgctgaatattgttctacctggcagttcaattcctggtatcaacttgatcctgcagtgatggagttttagattttgttatagcagggctatttccaatgccctttgtcttacgtgtatcccttggacttggcatacgggctttattgttaatgtgtgggttttctggggtaattttatttaaaaaatttcatttagtatttcttttttttaagtttattattattatactttaagttttagggtacatgtgcacaatgtgcaggtttgttacatatgtatacatgtgccatgttggtgtgctgcacccattaactggtcagttagcgttaggtatatctcctaacgctatccctcccccctccccccaccccacaacagtccccagtgtgtgatgttccccttcctgtgtccatgtgttctcattgttcaattcccaccgatagactagattaagaaaatgtggcacatattcaccatggaatactatgcagccataaaaaatgatgagttcatgtcctttgtagggacatggatgaaactggaaaccatcattctcagcaaactatcgcaaggacaaaaaatcaacaccgcatgttctcatttagtgtttcttatagtgaagtctgttggcaacaaattgtcttagctgtcattcattagaaaacatttccattgtgctttcacttgttattgagttacatagtagacagaattctaccatctccaccccaagatttctggcccctggttatttagtaaaaaaccaatctccttaaagctggtaagcaacttcagcaaagtctcaggatacaaaatcagtgtgcaaaaatcacaagcattcctatacaccaataatagacaaacagagagccaaattatgagtgaactcccattcacaattgctacaaagagaataaaatacctaggaatacaacttacaagggatgtcaaggacttcttcaaagggaactacaaaccattcctcaaggaaataaggacacaaacaaatggaaaacattccatgctcatggatagaaagaatcaatatcatgaaaatggccatactgcccaaagtaatttatagattcaatggtattcccatcaagctaccactgactttcttcgcagaattagaaaaaaactgctttaaatttcatatggaaccaataaagagcccgcattgccaagacaatcctaagcaaaaagaacaaagctggttgcatcacgctacctaacttcaaactatactacaaggcttttatcacctagtgatatcatagccatagtaacattgctaaggagagaatccagctcagctgtgcccagaatattacctacagaaatggtgagataataaatgggtattgttttaagtcattaactttgtggtaatttgttacatagcaagagaaaactaatgcactatccttttgttcattatttaagtttttacttccctcctaaatatgcttgttagtatttattttagggtctttgaatagttgctttttgtattctgtcaagttttaaattataatcagtgagaaaaaaaggctgtagtgggcttattctatcttggcttgcctcagaagtgtttaggggtaaatttaagaaaatatttgcatggtatattcactgaaaactataaaacctgctatgttagacttttaaataccaaaataaatgaagagatagatcatacttatggaatggaagatcaaaattgtttggaagccattatccttagtaaactaattcaggaacagaaaaccaaacactgcatgttctcactgacatgtgggagctgaacaatgagaatacatggacacaggaaggggaacaacacacactgtggcctgtggagcagggtgtttgggtcagggggatggagagcatcaggaaaaatagctaaggcatgctgggcttaattcttaggtgatggtttgataggtacagcaaaccaccatgacacacgtttacctgtgtaacaaacctgcacatcctgcatacgtaccccagaacttaaaataaaaaaaaaaaagatgccagttgcctctaaagtcattcatagattcaaagtgattccagtttaacccaacaacctttatttggtaacagttgacaaatggattctaaaatgtgtatggaaatgaaagggacatagaatatccaaaacaatattgaaaacgaggccgggcgcagtggctcacccctgtaatcccagcactttgtgaggctgaggcgggcagatcacgaggtcaggagtttgagactggcctggccaatatggtgaaaccctgtctctactaaaattacagaaattagccgggcatggtggcatgcacctgtattcctagctactcgggaggctgaggcaagagaattgcttgaacccgggaggtggaggttgcagtgagccgtgatcgcgccaccgcaatccagcctgggcaacagagtgagactccattacaaaaagaaaaaaaatgtgtggtacttgataaggattgagaaatagatcaatgaaacagaatttggaggataaaaaagactaatatacaataaattgacttttgataaaggtatcaaataaattttttagagaaagcaaattcttttcaacaaatggccctgaaacatctagatattcgtatggggaaaaaacaaaacttaattcatacattacatcatacagaaaaaaaaatgtttttaattagatcttagtctgaacataaaagctaaaaccataatgcttttagaggaaaacatagatagatatttccgtgacttggcataggcagattttcttaggatacaaaaagcagtaactgtaaaagaaaaaaattgatagattagatttaaatttttaaactacttttatcagaaaacaccgctaggaaaatgaataggaaagccacagacaaggagaaaatatttgcaaaacataactgacaaattactgatatctaggatatgtaaaaaacttcaataactcaataataacaagatgtattatccaattttgaaaaatggagaaaactttgaatagatacttcacgaaagaagatatacaagtggccgataatcacatgaaaaggtgatcgatgtcgttagccatcagagaaatgcaaattaaaaccacaatgaggtagctccatatacccaccagaatgtctgttattacagcaactgatatcatcacaaaggttgtgcaaggatctggaacaattggaatttccacacattgttctgagtgtgaaatggtttggcagtttttaaataaaacacaacatatacctactttttgacccagcaattccacttcttgttatatacctaagataaattaaggcagtggtctacaaaaagacctgtgcagaaatactcatagcagctttatttataatagataaaagctggaaataaaacaggtttttataaataggaaagtggatatttgtaataactaaaacctgtcaataaaccaaaagtccagcaagaggaatggattttttaagttatggtatattcatataatggagtcctacaaatcctaccagtataatatggtggtagttatttttatgtttatgaatatataataatgccaacttcaggataaatggttaaaaacataaaattattattaaaaatagccaacaaacaccagcatcttttgggtttctttttgttcttcactgtttctatgctagcactataaattgtaagtttgaattgtagctcttaaagcaatgcagtttttctttcatttttaaattgagctctttactctaggaaccccaggccctcctggaccaaaaggtattagtggccctcctgggaaccccggccttccaggagaacctggtcctgtaggtaagcatgaaaaataacagtttgctgttttataaaactaatgtttatcatattaagtttgggaaagtcaaatcatgttcagctgtgaacattttcaacacaaggaaatatagtgttcattcacttaacactgcatgtgaggtacagaatgaataacttttaataaaaagtgcttaaaattggctgggcacagtggctcacgcctgtaatcccaacattttgggaggccgaggtgggaggatcacttgaggtcaggagctcgagactagcttggtcaacatggtgatacgccatttctattaaaaatacaaaatattagctgagcatggggatgggctcctgtaatcccagctacttcggaggttaaggcacgagaagtgcttgaacccaaggggtggaggttgcagtgagccaagatcgtgccactgcactccagcctgggtgacaaagcaagaccctcgaaaaaaaaaaaaggacttaaaatgatcatatgtgaccttattttctaggcccactttttccagggagagttaattcaagtgtcctagaatagaagctttgatttttttagaatggcaggctgtagtaagtaagtttgtttattgatttctaaagtaaataacttctcttggccccatatgaggcctataattctccccaccacccttcgcaccttactctcttagatattctgaaactatattaaaatgaagaactgaaaggttttagatgctgaatgactattccttattttcattatcctccttcatatttttataacattttgtgatccaaaggagtgtctcaaaagcaccttgtttcttttggataaagaagggagcatatggaagtaaaagggagttggaaattggaaaactgggtgtaacctgctgtactcaattttttaggtggtggaggtcatcctgggcaaccagggcctccaggcgaaaaaggcaaacccggtcaagatggtattcctggaccagctggacagaagggtgaaccaggtgctgtagtttttcatttttcctatttttctaattttctctgtgttgaatttaacttgcctttttattacccacagtgaaattgtatcttctttcttactaagctaccacacactttccccttttcctagttaccgtcttcctcttcatcctgagactattagctcatgtatcttgatcaagttgcctcttacaaaaaaccccatatcttttcttgtctaattttttatatcaaaaagaagttacctagcctttgcaaatttctctgtggtttactatgcaatctatatttcatttatatttttttcttataagcatatagatatatttaacattcatcggaaatagaatatatgtttagatcattttctcatgttagaattgcagttctgtgttggaaataaatcttctgcatgtttcatataatatacattgctgcacctaatgaaaacctcaatgatctaaaaataatttggccttgtttcagtttgtattatccacttgagtttttgttttgttttgttttgtactctgacaggtcaaccaggctttggaaacccaggaccccctggacttccaggactttctggtaaaccttaataaaacatgctaaatcaatctataataaaatgagattatttccaaatacatctatttttccatctccaccttttactatcataaaatgcatgtaagaacccagaaaactcaaacctagtgttaacgttaaaacatttattatttagcaacttagtttaaggagttgtgttaaataaaaatgtatccttacggaaatttacatgtagagatctcttcactaaattcataaataagtgctgaggaaataagaaagaaggcaaaattgcaggaagataagaaaagtctgtagaaataagaaaagtctgtagaaatatacgccaataataaaaatgtttctggaaatttcagtcttaatatatgttttgcatatttgggtagatgtgtgtgtgcacacacacatctaccctccctcttttgtgcttactcttactgtgagcaccaaatagtagaaggactgaatgtacatacagacatgtatgtttatgttctgaaatgacgactggccattttatggagacttttctcaaaccatacacatatctcctgtaaagtcaaatagatatccttcccatgataccaacatggaaattattactttaatgtgccactgttacattgctcttaaaagtgtcagaggtagagaaaaaatgttgagaacaattttgctagacggtgattataaatattgggtagaatggtcttcggggacacatgacaaccattgaagagccatatctttcattagtctcaaaattagactcaaaatatttgttttagaaatttcctccagccatcttgaaactatttttgaagatactttatactttttttcctcacagctattggtgatgtatcattgctctgtcttaacacaaaggataccttttaggatgaaagctattattatttctacatttctatatatactctaataaatacttctgctaacaaatgcatatatttaataggaaggatggttttctgggtagatttgggatttggtaggagatagaaatgactcttgtgaattccattaattgccctaatgtatgtgaatagctaaccttataagcaagcttgtaactcggtattatttatcttctaattatactttactttcataggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggtatgtccgtgagtggtaggagaatggtctatttattagtccatgtatttcgttttgctggcaggttattcagtctttaagactttagaatttttccggtgcattggaggatgttaaaaaaaagactttaaaatttgtgatataacttcttacaagtaaatagcttggttcatagctaactccatctatttccatggttctaataatttgctttagtaatgcattttatcatttatatagaggaagtaaaacaatttggaggaataaaggaaatggtagttttattagtcttgttactaaaaggtaaaactatactgttaacctgtcagcaaaatgccatctgcatttttaaatgtgagcttctcagcatgtcatcacagaaatcattttagtgatcacccaatagatgcttgtggtccataccagaagtattgctttggttctgtcatatgatcagcaaatctcaccaggcacaattaaaaaaattatcttctataggaactgggcaatcaaatttatctccaacatcacagcatgatcaaattgactagtgatctcttcataccaacctcatgtctatacctcatttgtcttgtgttcactgctctagtagtctcagttttgcatccaatgttcaccttttcattttgtatctgtgctgtgtcatttcattttactaattttggaaatgctcgttttcatccttgattaatgtcactgagcctagtcactggtgataggttatgaacagattttgagacttgatattcaaattttatatttctggtcactgaaaacttggaagtaaatgtccttttattctttgaaagtctctgacattatataagtgcatttcaaaatgaaaaatgttatttatattacagtaaaatctaaagtgattggaattcattttaataagatgttctaaacacatgaattaaatgggatcacatactgtgttcagaggatcattttcaaaaccaaattttatctgatctgacataatctgatggaaagtattgtttaaggttttatgtttgtatactactgaagaaaaccagtgaaaatctcctcagccatgttaactctcttgcatgtaatgtaaagaactgaagcaagtatcttgcttggttttgcatgcagtaattcaaataaaccaaactattatcttttttatattttaatcatcactgtggttattcgttcttactagtaatgaatgagtaatgagctcactgttgaaccttactttgaaatttgtcggtatgaagccattagtcacaaagatgtcctaaaaattacatttttaaagaaataataacaaaagtagttagaagaatgcacacctgatgagtgtttgtgacttctcaaattatttcataaactataaattaaaactgagttgtaaaccccattgctcttagaattgattgttcttagtctgagctcatagtaatgattatgatagcaatgacttttggcctttaaaaatacgccacagtgtgctgttttcattttagttttgtcactaagtggtgataatttggtttatatacagatgcatggatatgaactttcagagtattcttttattgaaatgaattttaacttgaaagtatttagtgtaatgctttttagtttcttgatatttctaacagttttgatatttttcctttttgttaatgatgacattgggccttggtgaactttgatccctatccaggtcctacaggttagctccttaactccaaagtagtaactgcatgaagtttgaaacttatatacctgtaccaaatgttttcaagtgtttgaatgtattttaagagcatatgtgccaattcaattcttacatagtggcttatctctttaagtttttaggaacttgtagaacccagtgtttctgtctattggaaagacccaaaattacctaactaggaaaactaatttaacatttaaaaattcatatatttgtgtcattttcagttgaaaatctgtagtaccgaaaacagccttacatattctacctttctttggagtctgtttcttatgtttaatttatatctgttaatgcaaacgaattgaactatccttcaaaaggacattctttttttaaacaataatatgtattatcagatcttgaaaatatgtaattcttaacttgccatatcttttgcaggttttcaaactatcccaccttcacattttgggttgtcacaaagttctcaattctactgctgttaaaaatggactaatagggccgggcaccatggctcatgactgtaatcccagcactttgggaggccaaggcgggtggatcacctgagatcaggagttcaagactcgcctgaccaatatagtgaaaccccatctctactaaaaatataaaaattatccaggcgtgttggtgtgcgcctgtagtcccagctactagggaggctgagaaaggagaattgcttgaacctgggaggtggaggttgcagtgagctgagattgcaccactgcaccgcagccagggcgagactaataggcacagagaaaaaaaaaatcaatgcaaccagcacagattacgaggttcttaatcttattttcattatacatgtgtaaacagtacacaccaaagaacaattaccaagagctacctaatggaaaattgctgattcttagtgaaagatgtttgtttacctaattagcagtaaaaaaagccacaaatatttgaatgtatttattgttattcaaaataaatagtccttttcaaattgttaagaaagaatcaaaagaggtaatagtataccccatgatatctggctgttgagaatggcaggacattttttcatcttataaaattaaaaaaaataatttttcaagattatttttagggagccatttgtttctacctgaattgattctctagtttcttactccactgcaaactcattatttcatagaaccatagaatgtcagatctagaagggacctaagttttacctatgtcgaggagaaattatccacaagacagattttattcaggactattgcagtagagtagaaactattgcagtaggagagagactgagctcaacttcaaatacaacaaagaaaagtgattatttacagccaaggagcagagtgagagggccagtaatggaaaattactaagaggagacatcaagggtagagaggggtgggttcttgttaaactggcccaacaggatttttgccagaaacaggccaaggatttagacatcaaaggtgggagatcaggaacttgatcagatatcggggtgaagggactctctctaaaccgatttagcaggattattgatgtaaatggatttggaaggccaaaaagtaggcccaaggatgaggcctaattgagaggagggctcagaggagcctgtctaaagtttgatcaaggaatctttgtcacatatgaaaaaatggaggcccaaagaggttaagaaacttgctcagggtaatactgttagttagtggcataactgggactctgacttaaggctccccagtgatcaattaggtgtctattctacagggagcagactgttcgctgcatccactttcttgttttctgttacctcaaaagctccgtcaacacctccatcaaccagattgcttcttgtgttcttcttaaatgatgtcatcaaaaagattaagacagtgcatactatttaactatcactaagataaagcaaagactagggggttactttgaagtaatgttgagtcccaccttatctgacctacatagaattttgccactttgattactgctaaactctactgttagctaggagatttctatcttctgagttactataatatattcaaagaagaaaaagaaaagtagccacattcctttaaaagaaatttaacaatttattatttacaaaatgtgctctaaattgcatagttgttggaacttggtctctgtgatgttttcttctttgcaagactacaaccttaagtggaaactgaatttaaaatataccagtcaattcatcagtatacctttagtaattactacttatggacaatattttaggtttttgttttgttttctttttcagtttaactttgttacacagttgaaaaataatggattgtggacctcatacaaaaaaaaattgacttggcatatagctcattaaaatgttgctttttaaaatagagtcttagaagttttgctatgatatgatccacagttttccttgctaattactcaggctgaaatgtcatatttcaatgaaatattttgctgagagttcttgttattggtccctctatatcaaacacatatataaaatgtctttactcaaaccttgagttgtcttagttgggaattctaatttatttaactaattttgtggccagactctgctctaagtattgtcttgagttaatttgctgtctgtgatttagaaacaatttaaataaacagaagccaatatttagctttctgaatttcaaagtatcaaatgctttgaaagttttattaggagataatgataatgttttctatttatatgacatgccacaatttacatcatataatgtacttttattgtaagcatcttaagggcagagtttgagtcttgctcatctttgtgtttcctgtagcaccttgcacatggcagacattaggccagtattttacaacttgaatttgatctttaaaacattcctgtgagggaggttagggcagataccagtattcccattttacaggtaaaaaaccatactcagaaagattgaattgcccaaagtcatatagttattaagtagcagagtcaaaaatagatcctaggtcttccaactcctaggattcattgctctagcacaatttattctctctgctaacatttggtgcttataaatcatagcaaaacttgtaagaaaagaaaattgtgtttttagtcaattaacactaaccaaggggtgctctatttgtaggcttttaatctttttatttaatgatccttcttttaatagtgaatagcctgtcttaatatgtgcattgaataataatagagtaaatatgatattttctgtggttcggggtgggatattgcatgccaaaacattttcaagtaccctttcactgataggcttcatatcttggaaaagttgaatctttatttttgtgttcaatgttgtacaaatatatattggctttttctccttaagtaacttattgcaagtactataataataatataataataataataataataataggccaggcatggtggctcacgcctgtaatcccagcactttgggaggccgaggtgggtggatcacctgaggtcaggaattcaagaccagcctggccaacatggtaacaccccgtttctactaaaaatatgaaaattagccaggcgtggtggtgggtgcctgtaatcacagctgctcgggaggctgagccaggagaatccctagaacccagaaggtggaggttgcagtgagctgagatcacaccattgcactccagcctgggcgacagagtgagactctgtccaaataataataataataataattcaataaatagtaataggaaagcctcctggtgaattatgaaaaaaatcagaatgtggcttcatgaaatgcttttcaaatacaagcaaaagtacagttggtaatggccatcgtatattcatgttttgatttttctattctgtcacccatgatctttatatttattgccaatgaggcctttaaagtcaactgtatcttcttgaagcagtctgagcatatcaagaaattggcacctggtgtttttattaaaagataacacaagccaagataaacttcagcattaatccaaaaatacccctttactaaaggaatttgaaggctgttggtgaaatggtactatctagccaactttaatgttttgagaagctaatttttggaaagccacagtagcagtgttaacatgatgtcttcagtagagttttctattttctggattaacgaagaccaacagcttatcctttagaataagctctatttgaaaaagtttggctctctatacttctgtatggttctgtttgcatactgattatgctgtaagtataagaaatgctggcaaagaacattattgttttaacttgtactataatgtgaaccacttctaactcataatcttattttgtactgtgtgatgtctgatactgctaacatcgatctttgggctttggtgaactctgatcttcccaggttttcaaggttagactcttcactggtcaattcttttttttttttttttttaatgctttgtgtgtgtgataagagaaatgcaattttttgctataattcagaagtcattggagagtgctgttatcctcaagctggggttttaacattttgatgaaggtaatgtgacttgattataattaagtttcaaatgacgttagggtctttgtgtttgcaattgtttataataagtaatcaatacataaagacatgttgaattttaaacggaaatacacttatttttaccttcaagactgcattaaaatatttaggcaagcatatgacctatttgtaatctctgaatgttgattttattttctcaaaattttgttttctcagattgccctgatctgtgtatttatggctattttcagtgatggcagagatatactattgaatactgttaaaaataaaacttatatgttctttatgtaattaataactcataatttgaaggactctaaacatcaggtctgaattaacatgcaagtttcccatttttttttaatttcgaaaagtgcagtgccttaggttatttcagatgatacagtgttctgataacttttaaaatggagtagagggtcataaaaggtttctttttttcccatcttactttgttattgttatcaggttgattcacagtttatttatttttcataattagctgatttgctacttaatttctagtgcaaatcatacattgtggattaaattgacaagtttgcttagaacactgaagttctgtttttttattcaaatgtacaatgtactaaaccttttcgttatgattgagaagggaatttctgtgttgactggttgccagcctagggtgactatatgagttaaattgtttaaatgtaaaacaattgttgtactattgtaaatctccttcctctttctcatatgccagatagagtcatgttatattatgaaattacatagaaatacctgaaagattaaaaagatgctcatattttaagatttgtttttatcttcaattttactaataaagaaaataataataattttaaaaagtccttccatagcttctactatataccaggcactgtgctaagtaatttttacattgtatctcatttaatccttggaacaacctgctaaagtaggtgctattcttaattccattttatagaagaagaaattgaagccaaggagattaataatcttactgaagtcaaacagctaataactaatggagctgtatttgtaacccagcattctagctccaaagtcctgtgttcttaatcacagtgtcattctgccttgttagtattttgccattgattctgaatcttaagagtattggaaagggaactaaagtctgaattttattttaggttaaaaagacaaccctttgtccataagaatgaactctattctaaattcataacaagtgcctattatagttcctcaaaaaataatccctacatatcttcattttttgttgaaatcaataaaatttgaaatgaccagaggagagaaggtgtaaatgctaactattggctgttcattatttagggttttgtaattattttcttaaggcaggattacttagtctcagcctcagccactgaacactctgcaagcaagtaacacctatttgccacctggtgacaaaagacttggccaatgataagatctccctggttgcttaatggacctcatacctttattcagaaaaagaaattaaaaacacagcaaaagtaaaaatgctaagcaaaatccagttttaaattattttgtttattcacaagatacatacagaattctttatttttcttgaaaaatatttaaaatgtaaagaatatgaaaacattttaaaaatgaattttaaagtactttattgattcaataaatttctaacatttaaaaaaattcctatgtatcaagcatatcactaaaatgaaattagtttgcttaaattgctatctgtattgcatagtaataaaagctgaataaatgtaactacttacaaataaagcaatttgatcttaatcacaatgagacatggcttgaatttctgattgccctacagcagtgatgcttaaagtgtggtcctggaactagcagctttagcttccacaaagcacttgttagaatgcaaattattgggcctctcctaagtctcttttttctaaattatttattcttaagactggtcaagtgcagtaacgagaagggaggaaagagttgaacaaggagttcaatctataactgaacaatcaattgagataactcactaccttcagaccagtctcctcagtcttacggaatccaaaactcttggggtgggcccaggaatctgttttaacaagccctctagttgattctgatgcatgctccaatttgagaaaataccctacagtttctgtttaatttaactttaagtcaaactctttgttaagaattacagagccacacattgttaagccatgagtctttttctttagatgttattttattgaatttaatatataataaaatgtaaactaaaagagtctgcaaatcagtgttcataacaaaaagaatccagttcaatttatattagaaagggaatcagcataggtctagatattttaatgttgtgtgggttttattctgcaaactaataggaagatgactgatattttaaaagcctgacttttatgctactcttaacactatactgaaatgtcgtcatttgctgtggattattaaggtctaccaggtccagaaggtcctccaggtctccctggaaatggaggtattaaaggagagaagggaaatccaggccaacctgggctacctggcttgcctggtttgaaaggagatcaaggaccaccaggactccaggtaggaaatggaagtagatatctgatgagagaagaatgtgggtgtttgtattcaaaatgtgaattctaagctgcatcattttaattaacactcactagacaaggttctatgtgtggctcactggcgaattaaaaagacagtagaaggcaagtttcctatagtctcctaaagggactttgttgtattatagtcagagttcctgaaaagatacttcacctggagtctttggtatgcatatttggatttgagtagccttcatttcagtgaaagcaaatttatgcaaaggagacatgcatattagagcattgcatatagatgaatccacccatagagaagtaattatggtgaatagaggcatcttttaggctttgaaattagataaagttagggtcaaatgtcagctcccctgcacacttctgctttgtatctatgaggaaaacagacactgggtttctgtcttcacctataaaaagagaataataacatatccactcatgtgctttctatgttggtttgagtgacccagagcagagagtcacattcctctttatgggttctcaaaactgcctccattcggtcaagatgattgctggtggatttggcagtcaacacaatctggactgtcttttaattctgaagactgctttatggcagaaaaaaagtatttaaagtagtgatccttaaagcttttcaaaatctaatctttttccccatgccatcactattcttccagttacctagacttaaaaatttacttctgtttactcattctctactcactccctataaatatgcatatttccagaaacaattaagagtaagtttcacctgctatacccctttaccactaaatattttaatgcagatttcttaagattaaaaatattctcatgttttattataagatgacaataaaaagctatgggattgtttatattttataaaattcttaccaaatgtcttggctgcagcctgtaatcctagcaacttgagaggctggggcaggagggttgcttgaggccaggaatttgagacgagcctggacaacatagcaagaccctgtctctaaattttttttaattatataaccacagtacacttattaacttcagaaaatttaacatagatatacattaatttctatctttcatattccagttgggtccaatgacctaataatgttcttagcatttcttcttccagtacaggatccaggccaagtcatgttttgcatttaattgtcatatctctttagccttctttaatctgaaacagttcctaagtttattttctttttttcatgacctcgacatttttaagaaattgtaccaccacccccatttttaaatagaatattccttttttgcctgatgtttattcataattagattcaggttatgcatccccagctggaatactacatgagtggttctgtgtccttctcaggctaaccgataaggaggtccatgatgtctatctgcttctcatttgtggttttagttttaatcatccagtcaagttgttgctcagtttctccactgcatcattaggtttttccttgcaactaataaaactgtaggaaggcacattaagatagtgcaaatataccaatactcatcaaaaatttcccttagatttaacatctattaatgattttgcctcaaccagtctctagtgggatagtggcaaaatgatgttgtttcaactctagcactacctccacatatactagtcagtcctactgtaagcaagagccctcccttctctctggtttacctatgcatttcttatcatttttgactcattttttctcatgttttccactaatttacaatttctaaactatcattacttatttcgatgctctcattgttccagatttggaagccccttcaagctggatttgatgtttttctgatatgtacttccctccaactatttttttagcactttttaatattatttcataataagatgctccaggcttgttcctctttcattcttactaacataagcttcgttgtcctgcacttgaagtagagcaatagcctcctatatgatcttgctattctatattcttcctgtagttgggtggctgaggggggatgattgtttgagcctaggagtttgaggccagcctgggcatcatagtgagatcctatctctatagaaaagaaagaaaaaacaaagaataaaataatagttacctttcattaagtacacaccacacaccagtcttctaagcacttaatattgtcagcaaaagacaatgagatctagaggagaaaaaggaagagctttattttctgtaaaaagtaatctgcggattgggaaggcacagctttctgtacaagcgaaagtgtgatctctgaagaacaaagggagggtttggcttaagtagggaaagttctcacccatgttctcaaccaggtccatttatgcaaatgaaggattcagacttatcagttctgattgattgaaatacttgagccctgatcaggtgatttccaaaaccaaagccagaagtctgccagatgtttctttcaaatggccaatgggcagggggtgtgttcaagccacagtttatcttcgcagtggtttgacttgattgtacaaagggagatcctgtgacacttttacaacatctttccaagaacacaaggtatgtgacatttcccttacccaaccacggccagttggttgtgttttaactttgcgcacctcagttagccatgggaagttcattttgtctgtcagccaggggtatattttaacaatatgaactgtctcatttaattctcaccacaaccctatgaagtaaatactgttattttctccaaatttgaggtgagaaaactatgaatcaaggaggttaaataatcaactcaattcacacaagataatataaggcaaaattgagattacagtcttggaagtttgactctagaaatagtgctatatgccactatgtaattcttatgccctcaatcaccttcctcccctcgctgcaatttttttgtaacattaatgattttatttattcagggtaatcctggccggccgggtctcaatggaatgaaaggagatcctggtctccctggtgttccaggattcccaggtatttgaagggatttttgtggtttccctttatattaaactcctctgggacaagatagccattttctgatttgactgggtaaaggttgtagccctgttgctttgccataaaactgtatgtaccttctgtgcaggcatgaaaggacccagtggagtacctggatcagctggccctgagggggaaccgggacttattggtcctccaggtaagacttattcctgaagatagttatacctgatacttagatgctttaaagaatttgaaagttttcattctgtctttcagccagaccatcggaggctaagtccccaacaactgaggcaaaataaacaaggctctgcctttatttactaatctcttaaattctctattttagtaacataatattgatagcagaccttttaaagttaagataaatgcaggatcaacaaaaatgcttccttgacattagcttctatactaacttccccaaattcaattgaacagatcacaagagcaagtcacatatgaattttttataatattttcgatattaaaatagttctttttcctaagaggcttatagaggtttcttataaattgagaaataaggaatctgctaaattcccctactagatcaaagggtccctggacaagcacagcaagcaaaaactgcaaatgatgttggagtcagaatggatgtgtaagggaataaaattgtcttcccctgacaccagtgttcacagatttgaacacagatggatgagactttgtagtaactgagtaagattcaaggtttgaaaatagagatgatatgcttaatttttacactgaccctaagaaacttatttttcaattgaaaattatttttcaattttaagttttcctaaacagatttctgttagatatggcagcaattcaaaaactggtttctctcacaccaatttttgtcctgaacttaggtcactttggcttccatttcttgtaacctttctctttcccttcaaatttgtgtgttttgtctcataggtcctcctggattacctggtccttcaggacagagtatcataattaaaggagatgctggtcctccaggaatccctggccagcctgggctaaagggtctaccaggaccccaaggacctcaaggcttaccaggtaccaatgcagatcatctttattatcattattatacttttaatttctgggatacatgtgcagaatgtacaggtttgttacataggtatacacttgccatggtggtttgctgcacctatcaacccatcatctacgttagatatttctcctaatgctatccctcctctagcccccctaccccttgacaggccctggtgtgtgatgggcccctccctgtgtccatgtgttctcattgttcaactcccacttatgagtgaaaacatgtggtgtttggttttctgttcctgtattagtttgctgagaatgatggttttgtccatgcaaaggacatgaactcatcaattttcatggctgcatagtattccatggtgtatatgtgccacattttctttatccagcctatcattaataggcatttggattggttccaagtctttgctattgtgaacagtgctgcaataaacatacgtgggcatgtgtctttatagtagaataatttataatcctttgggtatataccaaaatgggatggttgggtcaaatggtatttctagttctagatccttgaggaatcgccacactgtcttccacaatggttgaactaatttacactcccacaaacagtggaaaagcattcctatttctccacatcctctccagcatctgttgtttcctgactttttaatgatcaccattctaactggtgtgagataatatctcactgtggctttgatttgcatttctctagtgaccacagatgatgagcttttttcatatgtttgttggcctcataaatgtctttttttgagaagtgtctgttcatatcctttgcccactttttgatgggattgtggttgtttttttcttgtaaatttgtttaagttccttgtagattctggatattagccctttgtcagatggatagattgccaaaattttctcccattctgtaggttgcctgttcaaactgatgatagtttcttttgctgtgcagaagctccttagtttaattagatcccatttgtcaattttggcttttgttgccattgcttttggtgttttagtcatgaagtatttgtccatgcctatgtcctgaatggtattgcctaggttttcttctaggatttttatggttttaggtcttacatttaagtctttaacttatcttgagttaatttttgtataaggtgtaaggaaggggtccagtttcagttttccatgtatggctagccagttttcccaacaccatttgaatatgaaatcctttccccattgcttgtttttgtcaggtttgccaaatatcagatggttgtagatgggtggcattatttctgaggcctctgttctgttccattggtctatatatctgtttcggtaccagtaccatgctgttttggttactgtagccttgtagtatagtttgaagtcaggtagcgtgatgcctccagctttattctttttgcttatgattgtcttgtttatatgggctctttttttaattccatatgaaatttaaagtagtttttttctaattctgtaaagaaagtcaatagtagcttgatggggatagcattgaatctataaattactttgggaagtatggccattttcatgatattgattcttcctaaccatgagcatggaatatttttccatttgtttgtgccctctcttacttccttgagcagtggtttatagttttgcctgaagaggtcctccacatcccttgtaaattgtattcctaggtattttattctctttgtagcaattgtgaatgggagttcactcatgatttggctctctgtttgtctattattggtgtataggaatgcttgtgatttttgcacattgattttgtatcctgagactttgctgaagtcacttatcagcttgagattttgggctgagacaatgaggttttctaaatatagaatcatgtaatctgcaaacagagacaacttggcttactcttttcctaattgaatacccattatttcttcattttgcctgattgccctggccagaacttccaatactatgttgaataggagtgaactcaggattaagaaactcactcaaaaccgcacaactacatggaaactgtaccacatgctcctgaatgactactgggtaaataacgaaattaaggcagaagtaaataagttctttgaaaccaatgagaacaaagacacaatgtaccagaatctctgggacacagctaaagcggtgtttagagggaaacttatagcactaaatgcccacaggagaaagcaggaaagatctaaaatcaatacccttatatcaaaattaaaagaactagagaagcaagaacaaacaaattaaaaaactagcagaaggcaagaaataactaagatcatagcagaagtgaaggagatagagacacaaaaacccttcaaaaaatcaatgaatccaggagctggttttttgaaaagatcaacaaaattgatagcaagactaataaagaaaaaaagagagactcaaatagacacaataaaaaatgataaaggggatatcaccaccgatcccacagaaatacaaactaccatcagagaatactataaacacctctacccaaataaactagaaaatctagaagaaatggataaattcctggacacgtaccccctctcaagactaaaccaggaagaagtcgaatccttgaataggccaataaaaagttctgaaattgaggcagtaattaatagcctaccacccaaaaaaagtccaggaccagacggcttcacagccaaattctgccagaggtacaaagtagagctgataccattccttctgaaactattccaaatgatagaaaaagagggactcctccctaactaatttcatgaggtcagcgtcatcctgataccaaaacctggcagagacacaacaaaaaaagaaaatttcagtccaacgtccctgatgaacatcaatgcgaaaatcctcaaggaaatactggcaaaccaaatccagcagcacatcaaaaagcttatccaccacgattaagtcggcttcattgctgggatgcaaagctggttcaacatacacaaattaatagacgtaacccatcacatgaacataaccaataacaaaaaacacatgattatctcaatagatgcagaaaaggccttcaacaaaattcaacagcccttcatgctaaaaactctcaataaagtaggtattgatggaacatatctcaaaataataagagctatttatgacaaacccacagccaatatcatactgaatgggcaaaagctggaagcattccctttgaaaacggcacaagacaaggatgccctctctcaccactcctatgcagatcattcttttaaggcttattcattggagaacatttccctagttctccttttacatgtcagaggttgtctctgacaataggagtctaagcaactagtagaataccagaccaccacaagttccattttcttttttcttgaaagtgttaatttcccatggttgaatttctcttagactatgtcaggttactgttagcccctctggctgttccaatttgaacaactaattaatgttagaaaaatttataatgaaatgaaaatgcatttaagatctggtgctttctgtacatcatccagcagaaagattgaaggctgatttggtgggctatcagtttcccactgtgaagccccttgtcttttaaactaactggtgtctagctggccatttgactctacgtttatagccaactttcattaatcattataaaagaaaactagaactaacttcagtcttttgctcttattaagtgatcaagtgacagtcttatcaaaaacaaagtatacctggcagtaacttatggtggaatagaaaacgaaagttgggacttacattcttgtctgattctgaagacaaagagagcacaactccattaaaagcatcccagaagcaaatggattgtttaaaactaaagctaaatccttgttggcttctttggtcctggacttgagttatctcttcttttttctggatttaagacaaaaccaaattgtgaattcagtgtctcgagaaccttatgtctcctagatctgtccagatgtgaaaatattctactcatatttgaatgcctcattcttttcctgtaggtccaactggccctccaggagatcctggacgcaatggactccctggctttgatggtgcaggagggcgcaaaggagacccaggtctgccaggacagccaggtaagacaagtaaaacatgctgttggtggagggaaagtctttgagtctgagagacctctggacatagggcctccacttagagctgtgagatcttctcttgatgttagcatagctgactggtgaatgtggacctgaggaaaataggaaagcacataataaggagatttgtcactatcagagaagcatacaagattgcttttatttgtgtttagagcagtggaaaactcagttaaattttccaagcactcactgtacttacttgttcagcaaattttcaatatgttgatttaaatcccttgaccatattgaaactattgtgaatatttccacatttgaaaatatcgcagtaggctgtaatttctttcataaagagcagcaaatataaatgaacagtttaagtgattgccatagacctttaagagtcatggtgaagtttcatattgagatgataaattgatattaggagcattaataggtgctcctgataatattgagtctggtatctgttagattttcaatttgtactcaacctacttccaaaaagaatttgagtcaacttgaaataaaaaatactttaacgttaaggtttctaaaatagaaatagaggatcatacattatatatgttaacaactctagattatataaatatgactaataaataaacataaagagtttgtatttcaaatatcagtggcaacacagcagagtggtaatacctatagccttcctagagtcaatgccctgacatttcattaatgctatatttctagggaaataacaagttagtgtcatcttcatcacaagtgtttctgtgaagtttccctaaaatgaaaatttatacacagactgtccaaaggcctgtatatacagaaaattattaaatgaactcaaaccaagaggctaaatcaggaagggaagccagtggtggattgaaaatgggcattttgaaaatacttctttagaatgccctgcctgttctctacacaaaaaggtatgcctgagaataattcccccagacggattcaaaggaaaatgtttttcagcaatgaagctggcagattgatggcaaccacacccttcctttctcattgatgaacaaaacagcaggctgaaaattgaccatggggttcagattcttttagtacaacaagagactaaataacatacagactctccaaataagcatattttatttgtctcctagcccatgatatctgacaatgcctttatagacactctataaatatcaaataaattaactagtcaaatgaggtcataatgttttgtcaatatccataagagtggatcagagcttacttaatcttgtatactgattatttcgtggaaataggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttgggtgagataatcaatatctaatttcctactgtgccttttgtttttgtttcagaaatcctgttgggttctagagtagccttggccaaagtgcctctctctattcttttggggcttccgaattgaaaaccatgtcaaaggcaactgaatatattcactatgatttttaaataaataatatttaaccttaaactaaaagcattaattagctcttgtgaggtacaattcttggcctaaagcagatcatttcaaaaaggccacatttacttttagttagattagttattaagggaacagtttccctgggctctttgcagtatagcagctgcttgagtgtgcagtgtttataattcctgggagatacttacctcatctttgaaactggtcttcatcaagttcataagttctgaagagaatcttggttcatagatcaaagaaagtaaggtcattgcttaattatgctagtttgtagttcctaaaataagtgccttagctttataaagtattgctggagtcatttaaagctatataaagtatgacatttctgtacaaaatccagttcatttaaggtgttcccatgtatcttctctatactggggtggacagctaggttgatgggatgaggggactaaatcactctcaaggactcttccatccccatgaattcttttcctggaattctgactttggatgttgaagtcccattgtcttacctggggctgcattttgttgttgttgttgttgttgtgttgtttttttttttgatacggagcctcgctctgtcgcccaggctggagtgcaatggcgtggtctcagctcactgctacctctgcctcccaggttcaagcaattcttctgcctcagcctccgaagtagctgggaattacaggcgcccgccagcatgcctggctaatttttgtatttttagtagagacggggtttcaccatgttggccaggctggtctcgaaatgttgacctcgtgatctgcccacctctgcctcccaaagtgttgggattacaggcgtgagccaccgcacctggcagggctgcctattttaagactgactatcccctttgcctccataaagacatttaagaagatagtctgggctcccagtttctgggatctctatgatgagaagcttcctgagatctcattgtctgggccattcattctgtggaaatgtttctgcagcagcagagaccccggaggtcagctttactccctatttttccaaggcatatggccacaccagttctggcccaccagggtaaggatattcacttacatgtaagtcagtggtcataggccattttatgaaaccaaataatgtaagggtttgcccaatagctttcttttccatcttctttttttcttccgtttatatttcctttttctccttttcaactttcctctgctacttttctttctccttttcacttggttacatctttttaaattttataattgaccaatcttcattaaattagtaattaaattatctttccataatttaatcgaataataaatatctaaataattaatttaatttaatatcttcaggtaattttctctagtctttctcctataaatttcttttttgttcattctctctacactgtcagacttataatcaaactttaaacttcaaatccctaacctaccaggtcaacagaggaaccattataagttttgagcactacgaattcaaaaatgtaatgcagttagaagatggaatctgctatcagcatgtaattataacttttcagaatccatgtattttctctaataagaacaatcagatttggaatctataaactggccctgactctggtacagtttaggcctcagacacaggaaggccatgacggagcccaagatcctaggaatggtcctggattgcagaggctctgctggggctcacacaaggatcacattggaagtatcttgatgactaagcaaagatacaggcagctgtcactttgatgttaaagaaacaattacctcctgatcgaataaatgcagtctgtgttgaattagtggaaggattataggatgtaagaaagaagacagagaagatggattaaatactaaagcttttctgtctgggagaaaagaaaaacatactgagaaccattagtctattaaagtcttataactatggggtatagagggcattgggagtatatgggatcactctctcttcgaaaatttggagactataacccagaattctgcatcattgtgggcagccacaggtgcaaccagatactccagatacttccatcattatgggccttccttttatttacctttcttttccttacgagactggatattttcagctctgtcccaaattaggcagtagaataggtttttttaaattactttataatgtacaaagcactttcatgtccattgtctaatttaatttacacaactatgattaagaaaaatgtatataaatattctgctttttcattttatacacaaagagactggctaataggttaaataacttacagttagaaagtgatggaggtaacacctgccaattctaaatccatttctttttaaattttcccatgttgttcactcttacatgactgtgagtcagtcaggtttttcttaacgagtttttgaaagggataaattagactaaatcaatgattttcaacctagggaattttttaagactcctagtcttatgccaaatccattgtataaaaattccaaataattctgataatacaggtttaagatctattggtcttttatcagtcatcttcagtctgagataagcatacccctttgaatatatgaagaatttccatgatgcacagaggcattattttttaaaaatcaaatttcaactcctcgacttttatatgtattttctcctaaagtcaatctgactttagcagatgtgctttgggcaatctcctttcccatgtctcctttgtctcctttcactgtcatgcattccccactttgtaagagtcatactcttgcacattgccttgaagtatgaaaacctctgacagacaaattcaaagggataattcaaaataacagctttgctaaagatacaattaccgttagatccagcaatcccattactggatatttacccaaaggaaaatagtatatcaaagagatagttacactgacatgtttattgtagcactattcacaatagcaaagatatggaatcaacctaagtatccaacaaaggatgaatggataaagaagatgtggtatatatacacaatggaatattattcagccatataaaaaatgaaatcatgtcatttgcagcaacatggttggaactggaagtcattatcttaagtgaaataagccaggcacaaaaaaaacaagtatcacatgttctcacgtatatatgggagctaaaaatttgaacacatggaggcagagagtggaaagacaggtagcagagacttggaagggtaagtgtggggaatggggaggatgaagagaagtgggttaagggatacaaacatacagtaagatagaaggaattaattccatatttgatagcagaagagaatgactatacttaaaaaatatattgtacatgagtgatggacaccctaaataccctgacttgatcactatggattatatacataaaaaaaatgttcatgtgccccataattttgcacaaataaaaaattaatggttttgttaaagtctccattaactcaagctctgtaattcacttttaatccaaccttctaagaaatacgtttctaataaaagtttttttgtaataattatataaaaatttataatacatatatttttatcagttgtgaattaataataacaatgacaggtcaaaataaaacatttaacacgtaaagtcttatagtcacaaagttttaaaaaggtatattcaatattaatttttgagaaatatgatagcatgatcaataaaaaactttcaaaaataaaaatatgttacattaggaaaaaactgtgtgagaaaagtggaatggaaatataatttttaaatgtagaaggaacaatgtataatttccaactgctaaagacaagtttatatattttctataatggttaatgttagatctcagatcattatattggatgcatttaaaagagtgatataaaagtttgttcttagatatcaatattcacaaaacaccataaatgaaaactggcaaggtagaaatgtggtttgcaaattcccagtccctgctattacaaagtggaataccgaagggtgggtgtggagctgagagacaatagctaaaatcttaatactggcacagtatcaatttaaacttacgatgaaatttagatatcaaaactttagatatgttaactttcaaaagtgtaagagagtgcatttttcatcattcttttgtgagtaaatgagaaaagaaaggcttgatcacaagtaaagataacctctcttgtccctactagctctgaatttcaaagattagtttctttctttttttggtttgtttgttttcccctcacatctttccttcctgtcttatttttttcctttttacgtattcttcaaacctgactgtggtggctgtgcacactggccagcattactattgtccctaggcctaagaagattgcagattcacacaagatacatactgaggaagtcttagaagaagagagggcagcctggagcacgaaatattgataagatatcgtaaggactcagtatgtgtccttcacttgtacacaatgaattactaaatatcctccataagacaccattgtttataagatgcatcactagtttaaaaacagcattagggaatatataatgagctaccacaataaatattaacatactttattaaacacatcctaattttataaatgttaaaatatgagtaaatcttagacttaagaaatatagtatatttattacctatgaaaggctggcaagtttccttgaaaggctgtttgctattgttttagaagaaaccaaagtatcattatcacgcagtcctttactgttttctctccaaatctttctagggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcggtaaggcattgatttagctgtgacttttaccaatccccagttagttagctagtcagatttgagtccaaagctaacaatctgatgatattcctcctaggttaggtagaacagaggtacctcttaatattcaattaagtatttagtttgactcatatttattgggggtctgcttttgaccaggcccccatgatagacatagtgtaatagccagataatgcacagtgtagtaattatttattacataaatttgtctaatatatatcagatttgggctaagttctataatagatataataaaaatgttatgaaaacatagggaaagagatgtttagtttcaactggagaaatgtgggatggccatatggaaaaaatatgtcttgaactggtcagtccttgaatgactagaaggacttgaggcacaggcagttataaaggggaaatatacactaggcagataaatgacaatgggtaataaaacaatgtgtctaggatgtagtatgtaaaggttatgttgggagaaaagattgtaaagttagcttgggcccagatggtagaaggccttctgtaccaaattgtagtttaaagtttatttgatatgtaacaaggagccctgaaatattttagagctacacttcaggttagattatagtgccatcaatgtgtaacatggattacaaaagggatagtctcgaggtagagagaccagttggattgaagggtattgctatagccctgatgtgagtaaattggaactcacagtggggtacatgtatcacattattaggctagataggatttgacagttgattagctatgggaagaaggtggtagctgagatttggagcatgagtaactaagaggagggtgataccattaatagaaatctcttagagttttgccattttgaaacctagtttaactcaatctcttaggaatgttggttattgccgtttttattctgatcatgacccaggatttcaataaccataaaggatgaattgctggaaattctcgttcctttgatagtaaatataaagattaaagctggttcagccttagtagcaaattcatggtgccctttttaatacattttcctgaatcctttgggaatttgggtgtatgtgtgtgtgtgtgtgtgtgtgtgtgtgtacaattttgtcagtcccaactcttgggagtaaaagcttgtctaaatgtattaactattttgttaggtaaactgcaaaactggcctcagtaatatgtcaagaggtccactcatgttttttattaaagatatggaagtctcagctatattcattctgttgctatcttacttgattttatagatttcagccacatctccaagtgcctgggtacctgcccagcattctggatatggtgtacttctccagatatagtcaaatgtttataaatgtcctttggaccaagaataatgagtagagattgagaaagcgtccgtttcttatattttccagtctttctgacattgttcttaccacagtttcagcattactaaatgtctcccctccaattgagtactttgacaacaagtagtatgtgcaatacaccaaaccaaactcttacggcaattgaggcattgactatagcaagtatgaatagacatttagggcataatggaatattaaaaggccattgcactggttctgcagttttttgaaaaaagtttacagtttattatgtatactgggagacaatacttagcaaatgcaatcctcaaagtgcattttttcaccttttgtgatcattgaaagagacattaatcggcttccatactaagaaggcttccaatgaagcaggatggctacttctcacatgctcactctgtagattatgttccttctccttttcctttaccagatgtgcagtatgtgaagctccagctgtggtgatcgcagttcacagtcagacgatccagattccccattgtcctcagggatgggattctctgtggattggttattccttcatgatggtattttacactcttccttgcatttgtcatcatagctgactgtccattccatctacatttcttcccaatatgaggaatccctgtcatttgcataataagaagcttaaacttcaaacagcttctatccaagcactgtgttccccctcacacattttttgtaacatattttcataatctgcctattacttttttttgactacccttggtgtggatactattgtcttacctctgggcctgttccttcactagatttgaatttggccaagctcagcacacatctttggatattcactaagctattatggcacatgggtattgcggcacatttttccttgtcttttatagcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcaggtaaagtgcttatagctttaattcaggtccaaagcttccttcagagatgctagggaagaaagagacaatttatggatggtttatcctcaacaaatgttaggaatttattggattgtgtactttattcttgcttgttcttctcatatacatgactcaggtcagaaaaacagacttgattattaatattaggtgagtttggtttgtgatagcttagtagtaatccttcaataatgaaacagagataaagaaaggttatgtgaccttcctaataagtcagcagctgttcaactagattgagaccaccccaggaattgaagttacagtctgtcttttccctctcagtccagtggtctcctttcccaggatattttaaagattctcatttaagggtttgaatgagcaagacatacgtaatgtatgtacctcaggatacttcattctgttgatttttttcagtttaaatttatttttatgtgttgcttttgggttatcactacttggtatttttcttatggtccttgttatctatcataacatcatcagttgcccagatttccctcatcctgtgaatattagaaaaatgtatgagagaaagagaaaaagatagaaaatgagagggaaacacaaatatacaaagataatagtggtggggagaatcgttacaaaatatctatgaccactaatggctcttaaaccatactagtcactgcattagatcatattgctgaaaagtaaaccattaagtcaccaagagagctacttaacacacaaaaaatgtttagttataaatttgaaccagtaacagaattgaaataccagaaaatgtggatctgattgtcttatttcttatttcccagtaaacctcagtcagaaacgctgaaagcaggagacttgaggacacgaattagccgatgtcaagtgtgcatgaagaggacataacattttgaagaattccttttgtgttttaaaatgtgatatatatatatataaaattcctaggatgcagtgtctcattgtccccaactttactactgctgccgtcaatggtgctactatatatgatcaagataacatgctgactagtaaccatgaagattcagatgtacctcagcaatgcgccagagcaaagtctctattatttttctactaaagaaataaggaagtgaatttactttttgggtccagaatgactttctccaagaattataagatgaaaattatatattttgcccagttactaaaatggtacattaaaaattcaattaagagaagagtcacattgagtaaaataaaagactgcagtttgtgggaagaattatttttcacggtgctactaatcctgctgtatcccgggtttttaatataaaggtgttaagcttattttgctttgtaagtaaagaatgtgtatattgtgaacagccttttagctcaaaatgttgagtcatttacatatgacatagcatgaatcactctttacagaaaatgtaggaaaccctagaatacagacagcaatattttatattcatgtttatcaaagtgagaggacttatattcctacatcaagttactactgagagtaaatttattttgagttttatcccgtaagttctgttttgattttttttaaaaaacaaacccttttagtcactttaatcagaattttaaatgttcatgttacataccaaattataatatctaatggagcaatttgtcttttgctatattctccaagattatctcttaagaccatatgccccctgttttaatgtttcttacatcttgtttttactcatttctgactggacaaagttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccaatataaatttaattaaagatatatgttgtaaggat

SEQ ID NO: 37852 - DNA, 20625 bp, Homo sapiens
gctctgggagtgtgaaactgggagagacggttaagctggtgagcaaataggaaaaatatgttccctgccaacccagcggtcaaggcaaaatgcacaaatagagtgtgtgtgtccctatgccctcatgtgctgtctgtgtgtcctctgggtgctgggtgtgacattttccctaggtgggcctgagcgagtaacagcattcaactaacttggttaggggaggcagaggcaagggggctgggaggctgaaaggcagcgaggagggagggaaagacaccgctggggttctagggggttctagagggagaagtttcaagagggagaggtaaaaagggcgcgggaggctgtgagcaagggaaaagaagaaggaagtgatggagagtgggaggtctgccccagccccttccgggcgggcaggagggggcggaggcgagcaggggactgggaggggctgcgagaggcgcgaatgcgaacctggcccgtgcggaaagggcgcggagagccccggcgcggagcaggcgggtagggcgaagggtcccctttcgggcgccatggggcgccgagcgcggcctggcccctcgggctcctctgcggggagggcaggccgcaggctggagcggggtgcggaggctggcggggagcggcccccggaggctttcctggtagaagttgatgcgaggaagggcggcggggaccaggtttgcgagtcctaggcgagggtcatgggagttgggggtatttctggcagtagaatggcctgcgtcgtgactaaactagccctgtgaccttgggcaagttcctgaaatccatgggagcttttgtttcattgtcagtaaactgaagataacaccaacttggcagcgggagtttgtgtcttctgtatgaaatctccctgcctctgcacctggttgagttgctgtcattattttaggggacggtattcagaattcgagcgcaggagctccgcttctccacctgctcccggggagctattgggtaagtcgtttatctcacctgtgactccaggtggccatcaagacctgcctctctacttgccacgtggttactcaaatgcagtgcctaagatgatgtattggagtatttattccccacatttgctgccagcggccatgatcatcctgcctcttaatgcacctcacaaataactctagtctacctttccctttcccgcaggcctcctcttccagcagcctctatctttattctacaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctggtaagggcagggatgacttttctaaggaagttaagtctggctcccacgtggtggcaaggagcaggaaggactctgccccctgcccacccctctttctatgatgagaggaagggtcagcagctctcaccccacttgatctgggaagtgcctgggagggaggcaccagctcctgaggggtaattaggggcagccacatttcaactcagcttaagggacaagtttgcgaccgacaagctgtctgaggtggaggggagcccagcctgtgtgctcatttggcaggaaggctgggatgcatgggagaccttttttctactccagactgcaaagcccaggatgagaggttctcactcatcttcaccctggggtccttcatgaacaacttcatgacattccccactggctacatctttgaccggttcaagaccaccgtggcacgcctcatagccatgtaagtcccaaaggccagcccaggcaaaggtgggtaagaggaatccttcaggcagcagcctagcttggagtgaaatccagagtcagacagcccggccaccctgccaggcaccacacctgcagctcgctcccagcagctgttaggaacagccccaggcagcgggactctctctagacttgcccacttcaccacagccccacttccatttccttacctcgttccctgctctgcataaatgtggcttccctatcacgtgctgaattgagccggaggccagggtgacttcctgtaagggctggcttggagccagggttacaaaattagcaaaacctaaaattgctcttctcttccttcaccccaaggatccttgtcctcatcccctgcacagcctcacatccaggttgcccaggcttcatcctcatcctcctcaccgccccccctccccgccccaacagccaatcactccctaggggcttagctaataggaagtttctttggtattgccactggtggaatttcaggtcccttctgactggaggggagactgggggggtttcctgtgcagatgagtcagaaggttcgggacgtgatctcacacacagtgtgttgctgcatcctaatctcgtgctctgtggccaggctcagtggtaatcagcggcctgctgggggctgatacagctcagagcaggtgctcccagggaggcacatgtgagattggctgtcagagagagagacgggagggctggctgggcctgcctttccggaaacagccagagtaaagccagtcccttacaatttaagcctttggatgcagaatgactgtacctcagtccttcttggtccttggctccctgctacctcccctttcctccccttcctttgtcccctccctcttctccagccttaggatattgcttttttttttttactccatgccttacaagacccccaaatgctaagggagcctgataaccttgggactgtagtcctgaaatcatagcactctgagctagatcagtccgatcatttctttttatagaaaaggctcctgaggcccagagaaggacagcgccttgcccaaggtcacagagtgaggaggagttagaactcaaggccttgatttgcagaccaggcactaacccctttctccaaggggttgggctgttggggcttccaggtgggaggaccttcgctttgcccattctgtcctggctaagtcccaagccaatcacatcgtcagctgagctcattgtccaagactttccatgctagccttgggcctcagaatgagcaaaatgcactgtccatgaggtcaggaccacatctcaatctcatcgcggcttcttgcgcctggttttgagcctggggctcagaggcatcagtgcccgttgcatcccaggctgagggtgcggtcaagtcctacacttgtgggctggctgagcagaatcatgttttttctcccaggtttctccctccttgacaatattctgcttttcctgttatgtgtttcagatttttctacaccaccgccacactcatcatagccttcacctctgcaggtgagtgctgtcaggtgggtgggagggatgcaagctcagaggcacctggtggctggggcaggtgtgagcagagggctataggcaagatatacagaccacatggttattcagagatctgcagcttgaaagaatcctggaaggatcttgagctattgctggtctgtgaaaacagtttattgagaaaatgtgaaaagcaaggatgatggagagggattacttcagagagtagaatttattcaaaactttacatctggccaggtgcagtggctcactcctgtaatcccagcactttgggaggctgaggcgggtggatcatctgaggtcaggagttcaagaccagcctggccaacatggtgaaatcccttctctactaaaaaaaatacaaaaattagctggatggtggtgcgcgcctgtaatcccagccactcaggaggctgaggcaggagaattgcctgaacccaggaggcagaggttgcagtgagccaagatcacaccattgcactccagcctgggtgacaaagtgagactctaccaaaaaacaaacaaaaaaccctaaaaaacaaaacaacaacaaaaaacctttacatccttctcctatgtgttaaaatgttctctttctctttttaatgaaatgattatatgaatgaccattttgcaaatatccttacttagcagggtaaaagttgacaaccctattgtactcaaaatctttgttttaaaatttcaccagtctgttaagtctggaactccaatctggtttattttccaccacccttccacccattacacagaggagaaactgaagccacagcaggaccccttgcaaagacatgtccatggccacagagaaagcaagtgggaggtgggcctgatgtgcaggcctcctgatccctcactcttctttctgtcattgccttggttatggtggccacgagatgcctcccaatattccttcctagtgttagacccgtggctcaatttttggtttaggaaagaaagtacattactcttgtgtgtgtaagctatgctaaagctgacagcatcatgagattgtctgcactcatgctgggcaaacacagaggctgagtgtctttgttcacacagatctcatgagatggcccagcacctcaaaccaattatttcaaaccactctccttatcaaaccagcatcatctactctaaaagcctgtaaatgatttttaagcaactgaatgtggaggtggtggctgggtaatgtttgactcgtgcctgcaaatcgtctgagcaacaatcctcctcttcctccataatatagggcttttcagttttgaaaaaagcattgagcccataaggactctattgtgaaaggagtctccaacctttagtagtaggagagatgtacattttataaagacagaaattgaatggtaaactgtgtgaatactctaaaattagctcttggcagtgcttcttaaggtatagcacggtagttaagaggatgttaggggcacacgcatactacgtgaactacactaacaaacatcaaatcacctggtagaacagctattccctttttatttctctttcagtccttctgatttcatgaaagaatgtcttcatgtggggccagtgtgattttaacactgatgggaagagcaggtcttaggctttgaacattctaaggtcaaatgcatccagctacaattgaataacattgttttcctttcattgtatttattttgacagttactttctattcatgacaagtaatgccagtgttttcatctacagtagtgatataaagtgtcctttaaaaatagatactttttggataaaagtgagtcaacttaaaacattttagcaaataataggacaggcataggttgtggccagaataatggtgggcagaagtctggtttggggaggaagaatttgtcaagggttcccctagcccagctcttgagcttttttgctgtggtctcacacttaccagacctgttataaccatttgtttgcatgtcagtctatttaagggcaaggactatctgattcatcttgcatttccagtgccaagcacaatgcctggcaccaaagaagtgctcagagtttagtgaacaaagaaaagaccatggtccttttctcactcagttctcatagcacctgagacaggaagagcaggaactgttgttcccattaaacagatgattgaagctcaaggccaataccatgaattagggaatgggctagagggttgagccagggacctgagtccagggtcttcttttccaggagtgtcaaggatgaaagggagaggcagcttgtggtttactgagggaagagagaggtggcttcacttagagctctgcctctgtctgtagacttcctggcctgccacagactgaggaccaactttggttgggaagaaggtggctcagaagacttccacagagatatctggggaagccttggccggtatcctaaaaacccttgaaggacgctggaacgctggctagaattggggcctggataccaggattgttgggaatttggagcaggtgggagcagagtttggggctccatgtttgggttgcactatgacaccaccctacctctgactttgatggtccaggctcagccgtgctgctcttcctggccatgccaatgctcaccattgggggaatcctgtttctcatcaccaacctgcaggtgggagccttccctaatcccaggcactcggcagggtggcgggaaggtggagggaaggagagacccttttctataattggctgcctcagatggggttggcccaagctgaggtgggagctctagcggtggagggtgagtttgggtataaggagggtctgccacatgctgggtgctcaggaagtatctgtttcatgaataaataagtgatccaggctagtcctatcatccccagattgggaacctatttggccaacaccgttcgaccatcatcactctgtacaatggagcatttgactcttcctcggcagtcttccttattattaaggtaaatatagcaacagcctacattcactgggcacttgtatatgccagacacttgtcttgtgaacctgcattatttgtctccatcaactcggtgaggtaggtactgtgttacccccattttacagatgaagcatttgagtctctgaggttaaaaagcttgttgaaggttctgcagctagtagccatgatactggaacttgaacccaggcttgtcggttctagagcctgagcttgtaaccgctaagccccttcttcagacttgcccaagcttttgtggcagtggtcataatgtgcttgggccagtgttgggtagaggctgggggacctttagagtggggcgtttgctgctgtgagcttctagtttggacaagaaggtggcaagtggctagtgggtacagcaggggcagacacagaggcttgtccagctgtcccagtggctgatgttggggtatcaggggatgaactgttgccaaggctattagaggtcaatcaacaaccattctgtcttattcattgcgaacagttttatctgggcagtgacccgcttagcccaggggatgaatcctgattgattaaagccaaccatggcaatccatttacccgttgctagtgataggtggaggtcagcatatgatccagtcctttttaatgagataaagggagtgtatatagtggaagattcaaggggacttttcttccctgacgcaaggtgaaagcagagtaaaaacaaagtcttcctcattgaatgttgtggtgtgaggatgtgatagctggagttgtggcaaccatgcttcaattatgaggcagcaagctggaggactaaagccagcacaccacagatggctgagtgaaaggaagggaagagtgtggatctcaagccatccaacctgggacttctctctgggcttagtgttaggtcacaggcagttggcactgcctgcaggttatgggggcagagaagaggatctctggcagtcaccacccagacatgagtctagcttagtcccataagctttggaggtttggagggttatgcagagactgagcccctgaggcactcaagcctttctactcctggcataagagtcactttctgggttctccctccttcccctggagaacccagatggctgcctcatctttctttcctctctcttttttttttttttttattattgagttggagtctcactttgtctcccaggctggagtgcattggtgggatcttggctcactgcaatctctgcctagtgggtttaagcaattctcctgcctcagcctcctgagtagctgggactataggcgtgccaccacagtcagcttatttttgtatttttagtagagatggggtttcgccatgttggccaggctggtcttgaactcttgacctcaagtaatccgccttccttgacctcccaaagtgctgaaattacaggcatgagccaccatgcccagcctctctcctgtctctctagagttggaaggggaaagggagcaggaacaggaattcttagtttaatctgactttgctgctgcttactctgtcaatttattgagcaattcactgcacctctctggacctcaacgtcactctctgtaaaatgggaggaggttgggctaggtcggtggttttcaaactgagctgttgaggaacttagggattctctttgatgtcataccagtcaccaaggagaataaagagggagatgactggcaagctccccattggtgtgttttgtaagatgaatttttgtgtaaaattttctttgaacaaaaggcctttgctgtcgttgggggaaaaaaggcactgggctagaagatctctggggagccacacgaggaggctccaccggctgtggggatgggtcgtatgaggactcctctactgccgggtgtgtcttggggtgggtgggggcatgtgtgtaccaggtgtccctaatcagcttacaggatagtaggtgatggcttgtactaggactccttagaaaacagggttccagcccctgcctcttctgctgatgtttttgtatgcaataaaatatacataacataaaatttactatcttaacctttttttttttttgagacagagtctcgctctgttgcccaggctggagtgcggtggcaggatcttggctcactgcaacctccgcctcccgggttcaagcgattctcctgccttaaccacccgagtagctgggattacaggtgcgtgccaccatgccccactaatttttgtattttcagtagagacggggtttcaccatgttggccaggctggtctggaactcctggcctcaggtgatctgcttgcctcagcctcccaaagtactgggattacaggcatgtaatcatgtaatcatatcctctcacctcagcctcccaagtagctggaattacaggcgtgcaccatcacgcccagctgatttatttatttatttttagtagagatgaggtcttgctgtttcccaggctggtctcaagctcctggactcaagcaatcctcctgtcttggtcttctaaagcactagaattacaggcaggaaccactgagcttggccctgcatagtgctcttaaagttcatccatgttgcagcatgtgtcagaatttctttcctttccttttttttttttatttggaggcaaggtcatgtttcattgtccaggctggggtgcagtggcccagtcatgactcactgcagcctcaaacttctgggctcaagaaatcctcccactcagcctcctgagtagctggcactacaggtgtatgccaccacacccagctaattaaataaaaattttctagagaaggggtgagggtctcactatgttgtcaaggctggtcttgaactgggctcaggtgatcctcgtgcgtcccaaagtgctgggattgtaggtgtgagccagcatggttgcctctttccttttttaaggctgaataatattccattgtgtgtatagatcacattatgtttagctgttcatctgctgatggacccttagtttgcttccatcctttggctattgtgaatagtgctgctatgaacgtgggtgtgacactgactttttccttctccttctgcagcttctttatgaaaaaggcatcagcctcagggcctccttcatcttcatctctgtctgcagtacctggcatgtagcacgcactttcctcctgatgccccgggggcacatcccatacccactgccccccaactacagctatgggtaaggactatctggtgattgtgggccagagcccctcattggccctagggtgggatggacagggtaaagcaaacctatcacaggagaggaggaggactggagcagtgcatctgttagctattgctgcataacaaactatctcaaaactcagcagcctaaaatgttaagcatttattatttttcacaagtctgtgggtagctggctagttccgctgatcagggccagatgtagatgattttgacagggctcattcatacatctgatcatttggaggattacatgggggctggctatgctaggatggcctcactcacataggtttggagtgacagggatgcctgggtcacgtggctgtcatcctccagcaagccagcgtgggctcattcacaccgtgatttcagggttctgaaagagtgcagaaatgcacaagcgttcttgagatttaagcttggaattggcacagccacttctgctgcattcttttggctgaagcagttcacaaggctggcccagattcagggcatggggaaatagagctgcagtctcattcaaattgggggaaatacagaggaggtgaagaaatgtgatcatttttgcagtcatttgccacaaggagtagaggaagggcattcctttgctgctcacttactaattgtcagaccccatgtgctctctgatttcatcctcacaataatcctctgagatatccttatctccattttctaaatgcaaaaaatgaggctcagaagggttaagtctgagccatctttctgttgctaggaagaggcagagctgggatttgaacctgggcctgccctactcttttcatgcttcctaaactttgctgcttattagaatcactagattcacatagagatcttagaaaaggaagcctggctctcacctccagacattctgatttaactggtctggtctgcaacctgggcatcagagtggctaaaaggtgattccaaagtgcggtggaatgtgggattcaccatgctattccctccagtctgagtctcaggttcggctcacagtccttggccttgctggtggggcttttgtttccatagcctgtgccctgggaatggcaccacaaaggaagagaaggaaacagctgagcatgaaaacagggagctacagtcaaaggagttcctttcagcgaaggaaggtgagccctgctggctaacccatctctcctccagacccaagcctctccttgtgcctttcctggcccctcacctccagagctcccccagggacccagaatcaggaaaggcaggacagaaaaagggccttaggcatcttcccaaccctctcacttaatggagggtccagggctttcgtctcttttctgtccctcttttctctatttcgcatcctatcacttccccaccccttgaagcccgcctgccatgggttgccttcccttccccccactcctcggttctgccctcttctgtgatgccattgcactaagtctggtacagtgcccccatttctccaggtctcctgggtccgccctctcttattgtcccaactctatcactgcttcctttccttcctctctgttctgcgtctttggttacacacatcacaaaccgcagctagctacagtagaaataagaacggggtgggagaggagatgggagatgcaggtcgaaggacaaaaaggagcagatgagcaggatgaacaggcctagagatctaatgcacagcacgaagactgtaggtcatcaaactgcattgtgtttgggactttcctaaacaagtagattttaactgctcttgtcacaaaacaggtagaaatgtgagatgatggatatgttaatttgcttaactgtagtaaccatcttagtagctatatgtatcctatgacctcatattgtatatcttaaatatacagaataaaattgatttttttgtttttatttttaccatctgacaattggatccaaaacatgtatttatttatttattttaaagaaagaagaatagggttctgggaagcttccaaaatcaagggaggacattgaacttgccagggtgtaggacctattttagattaagtccatcctaatctaaactcatggccggtctgccttgttaggaggaaccatctcattggttaaccttgagagaggaacagaacactgaattcatggtcccatctggaccatgaagattagggtagaggaagatttcccaaagaaactcaggatactggtatcaaaagaaagggaggtgctgaggagcaggttagaacagagtatccacactcattctcctctcccttctgactttctcctctccttgtcgttcctttcacctttctcgctgagaaagatcaggaaggtattactgcaagaagtgtcattgaccaggctgtgagagacagatcggatttcaatagagaagaacacagagggtcatccaaggtggtagggccagcatgacaaagcagggaggtggggatgtgtgagtccgaggcaggtgcagagcacgccgggtgagttctgggagccaagggtagaaggtgggcccggatctgaaatgttccattgaagcctccacactccccatcctacctgtccactttcctcgtaattcacgcccagatcctcctctccccattagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgaggtatgtggtagggctgggaggtagcccatctgcatgtcccagctgggaacacagagcctcccagcagggctgtacacaccagaggagggtctgatggtgtggggaggagggacatgcagacaagggtaaggtgggagagtccctgcctggaagggagttttggaaacttctcatcaaccaacctctctcttccttctgcagtcagcacctacacaaatgcctttgccttcactcagttcggagtgctgtgtgccccctggaatggcctgctcatggaccggcttaaacagaagtaccagaaggaagcaagaaagacaggtgagatgcgggggagggcaggggctggtcagggaaccaggaagggaggtcttcatttaccccatgacatcttctctcgctcttttttttttttttttttttttttttgtgatagagtcttactctgttgcccaggctggagtgcagtggtgtgatctcagatcattgcagcctgcacctcctgggttcaagagattctcctgcctcagcctcccaagtagctgggattacaggcgtgtgccaccatcccccactaatttttgtctttttagtagagacggggtttcaccatgtcaggctggtcttgaactcctgacctcgggtgatctgcccgcctcagcctcccaaaatgctgggataacaggcgtgaagcaccatgcctggtcttctcttttgttcttaaccctgtctagttgcactcattcattcattaaaacactagtcactgagtgatagttatgtgtcagccatggtgccagacaccagggattcaatgacagacaagatagatgtgttctttttctcaaggtgttctcagtctagagggtggagaaaggcaggtagtcaggcagttataatccgtgaagcaaacccacagggggccatggggggcacaaagaagcgcacataatctgttctaggtgaggatgggattggtgtcagggaaggcttcctggagggaatggcacctaagccaagacctgaaggatgagtaaggagggaggagatgaagaggcggggccttggagagtggcccaggagcacagtggggtcaaaatggtgaatgagagagtgaaacattgaggaatctgggcagatgagtcgggctggctagggcacagagcactggggaatcttagggaagtggctggagagagagaggtaagaaggggtcaggctgtttaccacatcagggagttttggcctgatccttggacctggttggaggagtagaggtatgctgaggtattttaacctgctgggtcaggagggacaaaagtagactaacattttgcatacttatttcatctatcccttcccccacccatgcacctgcttctcccacacctgctagagttttcaaagcaaatctcagacatcgtatcatttcatccgtaaatatttctctatacccgtacatgtatctctaacaaataaggcctcttttacttaaacatcaccataaaatcatgatcacacctaaaaaataacaataatttcttcatatcatctactgtgcagtcactgttcaaattcctccaatcatttcaaatacatccttttacagttggtttgttccaattaggatccatgcctggtccatgcagtgtatttggttgctgtgtcttctatagcttttaaaatctagaacagtcctcccccctaccttttcttgtttatttgttgaagaaactgggtcatttccccatattttggatttggcgttgttttaatgtgtcatttaaaagtattcctttccttgggtatttcctgtaaacaacaggattagaagcttggaggaaacgcagtttaatttttttttttttttttttgccgtgaataactcagtggtagagctatgggtttcctctgttctcctgtcagcagcccctggtgtctgttgtcttgttacgatgttaagattgatcaactggtttagacattgcgagtctgatccatccactataaagtttcccatcaaccatatacttagtgattttaggagccattaatgatcaatgcctaggcccattatttcattaggatcgcaaaaggatgattttcttttctttctttttttttttttgagacagagtctcactgtgttgcctaggctggagtgcagtggcgtaatctcagcctactgcgacctccgcctcccaggttcaagcgattctcctgcctcagcatcccgagtagctggcattacaggcacccactacctggctaatttttgtatttttagtagagatggggtttcaccatgttggccaggctggtctcaaactcctgatctccagtgatccacctgccttggcctcccaaagttctgggattacagccactgcccctggccaaaaggatgattttctatttctatcttctacttttaatcactagaattcttctagaaagaaaaacattccttactattttgttacccagaaataaatgcttggcttacacatttatttaccagtttgaaatatgagttggtgccctagtgaccttcagggatggctactaattgtttcttttataatatttcattttaaaatatatttgacatgttttaatctgttctgtcatgattcttcttgatgctcaaattgtctcacctttggccattgaaaactttaccagcccagaatctgtgtcttttagatgaaatcacattatttctagagagtttccttactttctaacacaattaaatgttcaggtccatttcactaggtgtgtttcttgccctagacatgaaattgtcatttttcccaactagccctgggtttctttaattggaaatggtagagactacagtctggatgctgaggttttttattgctcctgggttgtcactgcttttgggttttggatagagttaacatatatataatttttttataagaaaaatatcataaatacttaatactgatatttttattcaaatttttatttccttgattttacatttgtagccctttctcttcctctgataaacttggttcctaacatatgcatatgtaaatgtacatacacatatatagtattttaaatataattactggttttaccaatattgatgttacttgataacaatacaattgctaaatactgttgctacttctttgtttccttttttctgtccttccttattcctttctcatccttaggatatatcccattagagatgtacagtcaaattgccatattttcttctttatttttagggatgaggtctcactctgttgcccaagctggagtacagtggtacgatcacggctcactgcagcctcaacctcctgggctcaagtgatcctctcccttcagcctcccaagtagcttggactacaggcatgcactaccatgtctggctaatttaaaataattttttttttttttttttttttttttttttttttgtagaggaagggtctttgttgcccaggctgatgtctaactcctgagctcaagcaatcctcttgccctggcctcccaaagtgttgggattgtgggtgtgagccaccacactgggccaaattactgattttaagggtcactaatttggtatagagttatgttcattgatttcattttattttgtttctgatttttaaagattgttttacttgttttcttcctattattattttattttatttgtaaaacatttacatatcagacatttacattttcccaaaggtaaaactgtgaaacaagatatattcaaagaagtttactttccctctctgtttcttgtaccccttttcctcttctttaggtaaccatttttatttttttaaatataaacattgtgtaggtgtatatacatgtattagtctgttttcatgctgctgataaagacctatctgagactgggaagaaaaagaggtttaattggacttacagttccacatggctggcaaggcctcagaatcatggcaggaggtgaaaggcacttcttacacggtggtggcaagagaaaaatgaggaagaatcaaaagtggaaacccctgataaacccatcagatctcgtgagatttattcactatcacaagaatagcgtgggaaagactggcccccatgattcagttaccctcccccactgggtcccacccacaatacgtgggaattctgggagatataattcaacgtgagatttgggtggggacacagccaaaccatatcaatacatttccctctcttttagataaaaggtagtatactgtatacactattctgcagagttttttttttttttgatgtaactctatcctgagggtgctctgtagcagggacctctcatgccttttaaccactgcctgggtctccattacatggctgcagcatagttgccacagcattcctgtactgatgactatttggattgtttccagtcttttgctattaccagtagtgttacaaagaggatctggctacatgttcagggtggggaggggcagatgtgtagcctgtcaggagggtattgcagtaatccatgactgagttaatggtagtttaaagctaggatgagtcagtggggttggagagaagtgggcacatttgaatgatatgtaggaggtgaatgatcagcattattgatgagtttgaggtggggcatgtggggaaaggattcgaggatgactcccaggtttctgttgggacagtggatggatagtggctcctcccctttttccaatcttccttggcccttcgctgacttctgttgggttggcctacagagagcttctttttcctctctgttcgcccaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgcgtaagtggccttggggcgggctctgtggagacggacacactggggcaaagagaagctggaggtaaagaaattgggaggcaaggcggggcctggaggcagtcaggtgcgggagactgggtttgggggcaggtgtggagggggtgagaccagaggtggtgggaaggatagaacattcatgcacttgagcctttacatctgcggtgccctctccctctgttttctacctggtgaactcgtattcatcctctgaggcccacttctgtttcagttctccagggaagaaatggaaaagtgtcttcccttctttgtgcccttagtactctagtcttacttcctttgctagtgcgtgcattgtctggcatgccatccatttacatgcctgtcttttctttcctggtgcagcctgcatgagggtcctgtctgtttttccagggccccgcatgtgccttcttctgggttctgtgggtcaaatgtctgagcagagctgaagagggaaaggccagacaggtgtggttggagggcaggcctaggacaggggagctggggacaagcggccgacagcccccagaggccaggcttctgcttggagggagggtccctgaagctcactggaacccctctggtttctctccccagtttcccttcagagcactttggcaagctctttgggctggtgatggccttgtcggctgtggtgtctctgctccagttccccatcttcaccctcatcaaaggctcccttcagaatgacccattttacgtgagtactgggaggatggggatccctggcaggaggcctgggccttaggccttggctgccccaaatctggctgtgatggcctgggtatgtagcatggtgcagcttcccaaagggtctgtgttattcaagtatttggggcaaaagtatttgtgtgtgtggggaaacagacattctggagtagggtggggaattctcacgaaacttcaagcaaaatcctgagacctcaaaggtgtttcctgcttgtggtgagtgcaggcccaccctggcctctcccctaggcccacacagggtttccacagttggccccagggacaggacctctgtgctttcacctctgtgtccttacacctggagggatgctctgaggtcctgctctaggaggtggtcgtgagtctcctgctctttgcagaaactgaggctcaaagaggttacttacgtgttcagaggcaccagctaaggagcaaaagtcaactttgaattctgtgttttgactactgcacagctctatttgcctcattttttatttttaaagcagcaaatcttagaataggagtttaaatccatcacttggagaaaagaaagactaaatgttttttgtttttgttttggagacacgatcttgctttgtcacccaggctggagtgcagtggcacaatctcggctcactgcagcctcgatctcctggactcaagcgatcctctcatctcagcctcctgagtagctgacactacaggcatgtgccaccatgccaagcttattttattttatttttttgatagacactggggtttcgctatgttgcctgggctggttttgaattcctggcctcaagcgatccacccgtctctgccttccaaaatgctgtgattacaggcgtgaaccactgtgcatggccaaaagagtaaacttgaaatctgaggcgaatgacttgattgtgacatcaggtgacctagtaatcagctgtgtattctagctggtgcctctaccagcttcccatgtgaccttgaacatgtcattgaatgctcgctaggcctctgtttctttatctgtgaaatgggcttgatattcctcctctaccccaaccgatagtgcagaatgaaaagtaactgaaagtccttcctccagggcaccatagtgtctgggtgaaaagtagaatataaactcggtagacttctggtcccttcattggtcatggaatggaccagtgcttgcttcattgagcaacagttctgttgttcagaattcctggatttcacctcacttctgctctccctgcaggtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggc

SEQ ID NO: 37853 - DNA, 62967 bp, Homo sapiens
cgcctttgctgccctcacagacttggcccctagcagtgcagaactacaagtcccagggatcctagcgaccgtccgtccgtagtcaagttgccggtggaattggcccaggatgacagctggagaatggagtcaggtacggggagcggctttgagtggaaccgtgtgaaagagccggggtgggtagtcgctggcgggtcgttgagtcggccatatgaaacaggttcgggggcagggcaagagttatgagagcctaaaggtcctgtcccccggggttcctgacctgcagtggcaggcggaagggacaagggttggagctgagtactacctactgagctcgaaccggtgactgtggctaccctccccctccctgccaccgcctagggagtggaaagaagtgggggttaattactctgacatctcggcggtgtggcatcaggacagggttctaccacagcagtgatagcatatggcaccgtactgaggtgatgtgccagggtgatgccaaaggcagggtgtgatgccgtgggagccacctgatatctaagagacctcggtgagtccatagcctggtgacatcacagcttgatgagggtcatcttaaggataccgggctgtggtgttggcattttaatatcacgatattaactatgttgtcaaggctttgctacaactattaagctaatagtgtttctttttatagaaatcccaaatagtgccatagcagaagcaatgcaagactgatcctttatagggcatatccagaggacattatgccacaactaggtaacgataagaatacattcaagaaagagactcatgatgtttatgtttatcctgttatagtgtagaacaggagttgggaaactttctgtaaagagccagatagtaaatattttaggctttgtaggccaaaaggcaaaatcaagaatattttgttggtacttttatgacaaaagagaaaacaaatttcaacaaatttttattgatgaaattcaaaatataatagtaattgagtactttttttgtaatacaggaagactaccaatgagaagaatagaattctttttaggggataatattttgcttaattggggctcagaattagtgttccctattgtcaaaattgattttaagtgttcatctgttaatgctgatctgttaggaaatttttacctatttaatctttgaaaatgtcattttacatagataggtactgccaaatactgatatcaattcataaacatatacttttttatttttatttttatttaatttttcaaaaatttcagaatagttgtagatttatagaaaagttgcaaggttagtagagttcctgtataacactcactcaaaatgaggcacattttacatatcataaaattcactgatttcaagtgcataattaaatgatttttggtaactttactgaagtggggcaaccatcaccataaatcagttttagaactttttgatccctccagtaaggtccctcatgcctatttatagttaatcaatcctctgtcccattcccagccccagacaaccactaatctacttttttgtttctataaatttgcctattctggacattttatataaatgaaatcatacaatatgcagtctttgtgtctgatttctttcacttagcataatatttttgagattcatccatattgtagtatgtatcagtacttccttacttttttattgctgaatagtattccattttatggatataacacatttttatctgtctactcactattagataggcacatcagtttccaatttttggctactatgactagtgctgctaagaagattagtatgtaagtcttcgtgcggacatatttttttcatttctctttgatagatacttaagggtggagttactggatcacagggaaaatttatgcttaacttcttaagaaactgcaaaactgttttccaaaatggcagcaacattttgcacttccactagcaatgtatgagagttcctgtttctccacatccttgccaacatttgttatttactgtgttttttgttatagccattctaagtgggtgtgaagtggtgtctcattgtggttttaatttataaattataatttataatacggtgagcatattttcatgtgcttattagccattcatatatcttcttcagtgaagtgtctgttatatcttttgtctgtttttaaattgagttatttgtttttttagtgttgagttgtaaggatggtttatatattctagatcaagtccctgagagatatatgatatgcacatatattctcccagtctgttgcttgcctttttctttttttgatggtgtcttttgaagtgaaaacgttttgaatttgggtgaggttcaatttatcatttttttttctttcatggaccattcttttggtgttgtacttaagaagtctttgcctaattgcaaggtctcagtgattttctccaatgttttcttctaaaagctttattacttcatctcttacatttaagtctatgattcattttgagttcattttttctctgtgatgtgaggtgagagtctaaattcatctttttgcatgtggatgtagaaattgtcctagcaccatttgctgaatctcttatcattaacgtcttacattgctatgctatctatgtcacaactaataagcccacagtggtatattgctattaactataccccatgcttttttttttcaagtttcactagtttatctctagagatgctgtcccatccaggataccacattacgtttagtcattgtatctccttagcctcttctggtttgtgacactttctcacacttttcttgttttggtgaccttgatagttttaaggagtactggtcaggtattttgtagaaaacccctcaattttatgcttagactggcattatgtgtttggaagaaagtctgcagaggtcaagtaccacattcttatcatacactatcctcaaacatgattttaattgagcatattcattgcgtggaatagaattctgttcttctcttaatagtgccttttagcattatgtggcaggttaatcacttccaattgaaagtttggtgaaagctgctcaattgcacagttaaagggattttggaatatggaatatcctttgcacttgcttcagggttcaaaaactgctgctggaactgtagtctgaattcagaaaatatatatgctgcaaattcttatggaaatagatatcttgcttcttgttttaacttttatttcattttattttgagacagagtctcactctgtcacccaggctggaatgcagtggcacgatcttggcacactgctatctttgcctcccaggctcaagcgattctcctgcctcagcctcctgaggcgcatgccaccacgcctggctaagttttgtatttttagtagagacagggtttcgccatattggccaggctggtctctaactcctgacctcaggtgatcctcccaaagtgctgggattacaggcatgagccactgtgcccagcctattttattttttattgagacagggtcttcttctgttgcccaggctggagtgcagtggcacgatcacggctcactgcagcctccacctccctagcacaagcaatcctgtcatctcagcctctggagcagctggaactacaggcatgcaccaacacactcagccaatttatgattttttatagatacagggtctcactatgttgcccaggctgatctcgaactcctgggttcaagtgatcctcccacctaggtctcagaaaatgctgggattacaggtgtgagccaccatgtccagctgagatttcatttatttcttctgggtacttaactaggagtggaattgctgggtcatatcgtaactctgtttaagtttttgagaaactttcagactctttacaagagtggccgtaccattttaccttcccatcagcaatgttcgagggttcagatttatccacattttttttcttattttcttttctttcttttttttttttttttggagacaaagtctcactctgtcgcccaggctgaagtgcagtggcatgatctcagcccactgcaacctctgcctcccaggttctagtgattcttgtgcctcagcctcctgagtagctgggattacaggcatgtacctccgtgccggctaatttttgtatttttagtagagacggggttttgccgtgttggccaggctggtctggaactcctgtcctcaagtgatctgctcaccttggccttccaaaatgctgggattataggcgtgagccaccacatccagccaaatttctccatatctttaccaatacttattaatatctatctttttgattataggcattctagtgggtataaagtggtatttaattgtggttttattgttttgacttgtgacagcatgggaagtggataaagcatcttgacattacttgtgattcaaataatattgtcaaaatgactttactacagtttttttcatatataagcattgttttgccttgtaattttaggttgaattaattaataaacattatccagcctgcatcaaaagttaatttccaaagccattcagtgttccctaacagtgtttgaaggtggttcttccaaccatttaaaattatgagaatcattcgtaccttgcttgccacacaaaaacatgagatgggctgaatttagcctgccagtcatagttggtatagagcagaagtgccctgcatattcaataaatacttctctagttgattatggaggtacagtatccctgtgttgtggtattcacaaagtattgggtatagtgacctttcaccataaaaatgcatcaagtacttggatctgattggtagaaaagctggaaaaacaattccaagtgcctttcctactgagtgacttgtttgggtagtcttcttttataaacagtatattttattttattttattttattattttattttattttattgtatgttatgttatgttatgttatgttatttatgtgacatggtaattaactttcaattctgagtcctttaaggctaaggggaagttatcctttgactttttgaaagctgcaagataaataggtcttagaggagaaggtctcttctcttttgtggctggccccaagttatggaggaatgatgtggttgctgtttatgtccattaagagacaaatggggccctgttagggtctgactccctttctgctcttatgattgaacgttccctattgccttttccactgatcacctggattctagatactaaaacaagctaagttcatcttctaggcttgaagaataatgccaataataactagcatttatagatgacattgtcagttactgagcttatcttatgcaatcctcacatcagctctgtgaggtaggtactattatcctgcagctcctaccttttttaaaatgagaaaacaggcacagaggagagaagttacatgcccaaggtcacacagtttagttggagctataatagaaatccaggcaattctactccaaagtcctactacttaaccactgcaacatgctgctaaatattgctgaaaatggaattatgtgtaaatgataatcctaaatattgcaatacaaaatgctgtcagagttctttgggttgtaactctacctgtgattttggtgaaatgacaagattttaatgctctagagcagtgctgtccagtagaactttctgtgatgatggtaaacttctatatctacgctgttctagtatggtaaccataaccacatgtagctcttaaagacttgcaatgtgtctaggaactgaatttttaatgtcatttaattgtaattgttttacatgtaaatagttttgtgtgactcattattaatcatcttggacagtgcagagagagatcatttccccccacttgttcctttttaattacactaaatattttacccaatgcaaatattctttccatagcacaacaggaagtgaatatattctatactgaaaaacaacttgagggtatacgcaaatcaattaactgcatgacagttgcaggaacaggttctgggttatccaccatgaaacttctccattcccagcacttactaaataaggttccataactggctcaaaaaccttttgcaattgatttttcactgcttacaaatgtaatttatgtggcttattgcactttacagttgccagttgcttggtttaagatgagacatcttaatctgtggctctaatttttttttatatacaagtttttttatataaaagttctggggtacatgtgcacaacgtgcaggtttgttacataggtatacatgtgccatgtgggtttgctgcacccatcaactcgtcatttacattaggtatttctcctaatgctatccctcccccaggccttcgccccctgacaggccctggtgtgtgctgtggctctaattttttttaatcccgtgttttgatcccacatgttaaatgtccttggtgttatatgtcactgggctatacaaaccttccccatttaaaagcgattccttcacaaaactggcaaactgttacaggctgttataataaagcactttatatttactccctgagttttagcttccacactcttgttttaagttgtttgctttataagtggtttctttttttaaaagggttttattatgaataagagactcgcaataatttgcaaagatagtacagaaaggccccatataatcttcatctgagttacttcaatcattgcattttacataattataatacaatatcaaaaccaggaaattgatactggaatgatacgtgtgtataattctatgttattttatgatgtgtagatttgtttaaccattatcgcaatcaagaaatattccatctctcctgtgctacctctttatagtcacacccaccacctacccccaccattgataacccctgaaaaatactaatttgttctccttttctataactgtcattttaagaattttatatataattaaaatgatttaatttttagaatcataaagtatgtgaccttttccactatttttcactcagcataatacatttgagactcattcaaattggtatcaatagttcattccctcttattgctgagaaatattacacgacatggaggtaccacagtttttttaaccattcatctattaagggacatttttaaatgtccagtttttggctattacgaagagaactcttattaacattgagtacagtgttttgtgtagatggaaattttcatctctctgagataaatgcccaggagagcaattacaaggtgggacggtaaatatatgtttaattttaaaagaatctgacaaactagttttccaaagtgactgtaccattttgtattctcaccagcaatggtatgagagatccagtatctccacatcctttccagcatttggtattctcactattttttttttaagttttagccattgtgataagtgtgtagtgatatattactgatttaatttgcatttatctgatggctaataaagttcaacatcttttcatgtgtttatttgtcatccccatatcttcttcatttaaatatctctttatatctttggcccattttctaattgtattgtattgtttgttttactgttgagttttcagagtgctttatgtattctagataccagttctttgtcagatatgtagcttgcaaatattctcttccagtctgtggcttgtcttttcatcttaataggattttccacagagaaagagcttttaattttgatgacattcaacttattgatttttttccctattatagattgtgcttttgttgttacatctaagaagtcttcaccaagtcgtaggtctcaaatattttctcctagattttcttctgaaaatgttatagttttacattttacattcaagtccatgatccattttaagttaatatttggcataaaatgtgaagtttaggtcaaggttaatttttttggattattgatatctagttacttcagctccattgaattgcttttgcactgttgtaaaatataagtatgccgtacttgtgtatatctatttctgagttttctaatctgattcattgatctacgtatgtgtccctctgccataccacacagtgttgaatactgtagctctataataaatcttaaaatttgatagagtgattcctcctagtttattgttttcaatattgcctgttcctttaactttccctataaattttagaataaacttgcctatatctgaaaaaagttagctgagatattgataggaattgtattagacctgtgtatcagtttggggaaaactgacatctttactatgctgagtcttccaatccatgagcaccatatgtctctccctttatttagatcttcttttatttattttatcagcactgttcaattttcagcatagaaatcttgtatgttttgttagaattatacataaccatttcatttttggagtgactattaatggtattttattttgaattttggtttccatgtattcattgctagtatatagaaatataaatgatttttgtatgatagttttgcatattgaaaccttgctgaattcactgattagttctagggggttaaaaggtatttttctaattttttttcttttgttttcattgttttttaggactttctatgtagaccatcttgtcatctgcagagagggacagtgatatttcttcctttccactctgtgttttatgttgaatagcagtggtgagagctaaattcttgtcttgttcccagtcttagggaagaagaggtcagtctttcagcatcaactataatgtagttttttttgaagtttagatcgttccctcttgatttctagttgtctgagtgtttttatcatgaataactattgaattttgccaaatactttttgcatcaattgatatgatcttgtgatttttcttcttcagtttgctaatgcagtggattacactaatttattttcaaatgttgagctagccttgcatccttggataaaacacatttggatgcgatgtataatttatatgttatatttgctcatatttgctggggatatttgcttctattcatgaatgatattggcttgcaatttaattttttggtactgtctttgtctgattttggtatcagtgcaatattggccttataataagagttgggaagtagtccctcctcttctattttctagaagacattgtgtaatatgagtgttaattcttctttaagtatttggtagaatgctgcagtgaaatcattcaggcccagatggtttcaatgaagaatttttttttttgagttttaaaattatatgttcaattttcttaatagttaccaagctattcaaattatctaatttctattgagttgtggtggtttgtgcttttcaaggaatttatccagcttatcaaaattatcaactttatacatgcatatttgtttgtagtaatcccttttggtgtctgcaaggtctataataatatctcctgtttcattcctgatattaatgatttgtggcctatcttttttatttgtcagttttgcttaaggtttgtgaattttatgaggcttttcagagaactacctctttgtttcattgatgttgtctgttgattttgagttttcaatttcattgacttctgctctttatctccttacttctgcttgctttcagtttaatttgctcttacttttctagttccttagggtgggaaattagattattaatttcagacatttcttcttccctaagttaagcctttagtgcaatgaatttccatctcagcactgctttagctgcatgtcatgtattttttttatcacagtaaaaaaccatagcaggagatttagttcttaacaaactttaaagtgtacagtacaatattgttaactataagcacaatgttgtacagcagatctctagaaatttttcatcttgaatgactgaaactctatgcttattgagcagcaactccccatttcccaccccccaccaaccccctggcaactactattttcctttctgtttctatgaacataactaatttagatatataagtggaatcatgcagtatttacccttctgtgtctggcttatttcatttaacataatgtcttcaaggttcatccatattgtagcatatgacagggtttctttttatggctgaataagattccgttatatgtatataccacagtttcttcatttatctgtggatggacattaggttgtttccacctcttggctattgtgaataatactgcaatgaacataggagtacaaatatctcttcaagattctgatttcaattcttttggatacatccctagaagtgggattgttagatcatatgggaaattttaattttttaaggaacctccatactcttttccataccaaccgcaccattctacacgcacaccagcagtgcacaaggttccaatttctccacattcttgccagcacttactgttttttttaataatggccatcctaacagttatgaagtgatacttcattatggttttgatttgcatttccctgacaattagtgatgttgagcatcttttcgtatacctgttggtcatttgtatgtcttatttggagaaatgtctattcaagttctttgttcatattttaattgaattatttggtgagattttttgttattgagctaaataatttagatattgaaccctatcagatggtttgcaaatattttctcccattctgtaggttgcctttcattctgttgtttcctttgctctactgaagctttttagtttgaggtagtaccacttgtctctttttacttttattgcctatacttttggtgtcatatacaagaaatcattgccaagaccaatgccatgatgctttccccctatgttttcttctaggacttttacagttgcaggtcttatgtttaagtctttaatatattttgagttgattttatatgtagtgtgaaataaacatccaatttaatttttttgcatgtgggtataaagttttactagcaccatttttttttttcttgcgggggagttgggctggatctttgccccctttttttttcaaaaacttttaagttcctggttacatgtggaggatgtgcaggtttgttacataggtaaacgtgtgtcatggtgatttgctgtacagatcaacccatcacctaggtattaagcccagcatccattagttattcttcctgatgctctccctcctcctccccctactcccctgacaggccccagtgtgtgttgttccccctacccatgtgtcctcatcgttcagctcccacttataagtgagaagatgtggtgttaggttttctgttcctatgttagttagttgaggatgatggcttccagctctatccatgtccctgcaaaggacatgatctctttcctttttatggctgcacagtattgcatggtgcagatgtaccacattttctttatccagtctatcattgatgggcctttgggttgattccatgtctttgctattgtaaatagtgctgaaatggacatatgtgtgctagcaccatttgttgaagagactacccttttccccattgtgtatttttggaactatcattggagattagatgactgtatatgtatggatttatgatcaagctctctgttctgttccattaatctatatgtctgtctttatgactgtaccgtactgtttaatccacttatatttaaagtaattattgatagggaaggacttattattgcaattttgttcattgttttctgtcttgtagcttttttgtccttccttttctttctttctcttttcctttgggtttcattgatttttttgtagagacatgctttgattctcttcacacattcttttgtgtatcatttaaagggattttctttgacattaccatggaacttacagaaaacatcttataacaacctatattaagctgaaacaaacttaaacttcaattacatataatactttactcttttatattatccaccccacactttatgttatcgatgtcacaaattacatttttatattgtgtatccattaacatgtttgtatagttataggtatttttatacttttttttgagacagagtttctcttgttgcataggctggagtgcaatggtgcgatcttagctcactgcaacctccacctcctgggttcaagaaattctcctgcctcagcctcccgagtagctgggattataggtgcccgacaccatggctggctaatttctgtatttttagtagagatgggatttcaccatgttggctaggctggtctcgaactcctgacctcaggggatgcctcccaaaatgctgggattacaggcatgagctgccgcacccagccaatttttatacttttgttttttaacttctatactaaaattaaaagtgatttacccaccactattacagtgttacagtattctgtatttttctacatatttacctttaccagtaagatttatgctttcaagttgctgttgagcatcttattatttcaactcaaatgtctctctttagcatttcttgtaaggcagttctagtggtgaagaaattcttcagcttttggtcatgtgggaacgtttttattcctccttcattttgaaggctaattttgctagatgtaatattcctggttggcaggttttttttttttctttcagcactttgattattccattcccttttgtcctgcaaggtttctgctgagaaactcacagataatcttatggtgatttccttgtacatgataagctgcttttcttttgctgctttcaaaattctttctttgtcttggacttttgacaatctgattacaatgtttctcagtgtggatttctttgggttcatcctacatggagtctgttgggcttcttgaatccagatgtccatttcctttcccagatttgacacatttagagatgttatttctttaaataaactttctgtccctttaccccttctccttcttggaatcccataatgcatatatttgtttgatggtgtcccataaatcccttaggttttcttcactgattttttgttcctctgactatatcatttcaaataacttgtctctgagttcaccaattctttcttctgccctatcaagcctgctgtttaatacctgtcatgttttttttttttttcagttcagctgttatattcttcagctctaaatttctgtttggttctcttttatgttttctaaatctttattgatatttgtcattttttgaactcatagatggcatctttatgatggttattttgacttctttttcaggttattgatatacctctctttctttaggattggtttctggagatttattttgcttctttggaccatgtttctctgtttcttcatatgtctctaacgtttttgttgggatctgcacatctgaaacattggtaacttctttcagtcatcatggactggctttgtacagggaaagacccttaccagtcagcccagctagagattctgggggcctttgaaacctttttggaggatacttgacttctctgggcatgtgtaggtaatttctcaactagaagcttaccagtttcttttacaggagcttataatcacttgctccctctgtgtctacaacactgcaagttttctggttctatatcagtaagcctcctctctctctttttgttctcagtggtcatcaggtatccagtgtgtgctagcttcctaagtcagtgccccaagtcaggtgagacctatactagtaccttaggcagcctggtgaaaagtcaaaatgctgatgaatattccacttgtttccctccctcctgaggaagaagccttaagttgtgtatctcctcccaactgtgctgaactgtgctggccacagcaagttacccaccactttcctttgttctcagcagcctcaaggcagccaaagtatgctggttttgttagtgcttccagtggggcaaaatagaaacctcttcctggttccttgagcagccctccaaaaacacagaacattgaaaactttgtacagtctttgttccccccaccctgaaattgaaggctgggatgttatttcctggtgctgagctgtgccagcttgggagaggggctgatgcagataaggtgagattgcccttcctacccattttaatgtggttattcttgactttgtgcttacctagggtatgcaacttcttaactgaattctggaattctcataaaattattttactcaatatatcattgttaaattggtcttcctgtaggggaacaagggctggaacttcctattctgccatcttgctcctatgtcacatatttcgatatgttgtattttcattttcattcagttcaaggtattttttttttttacttcccttgagacttcctctttgaccaacggattatttagaggtatgttgtttaatttccaattgtttcaaaaactttcttgtttcctttctgttattgagttctagtttgattccgttgtagttagagaaatactttgctatagaaaccttacttccctttaagtctctttactttctcccatctataatataattttaaaaatatttttcccatatatttttagaatcacatcagacaatgttatgacttttgctttaactgtcaaatataatttagaaaactgaaaaaagaagcaaagtctgttgtatttggtactattttttactcttatttttctttcttccttcctgatacctaaagattccttcttttatctttcctttccaattcacaaatttcctttagccatccgttcctttaggtatgtctgctggcaacaaattcttagtgtttcttcacctgagactgtcttgattttcccctaaaagatattttcactggatatgcaaatttagattgacagttcttttatctcagcatttgaaaaatgtgccatttccctttggactccatggttcctcttaataaatctactctcattaaaagtgtttttcttctataagtaaggtatttcttctctctcactactttcaagatttttttctttttctttagttttcaggagtttgattatgatatgtcttactgtggaattcattggatttatcctattgggtttgctcagcttcttgaatctgtaggcttacgtcttttgccaaattggggagattttcatattaattagcttgatttagctattccacatgtatacacatatcaaaacatcatgttgtataccatagatatatacaattttatttgtcaattaacaaaattaattgattgttaaatatttgggagattttcacctatttttttttaatactcctttagtcccacactgtttctcctctcctcctggaactctgatgatatgaatgtttaatgtatcattaaagtcccgtgtgtccctgaagctctgtttacctttttcaatttattttctctctattgttcaatcgcataatttctattgttctgtcactagtttcactgattcttttttcagtctcctttttgctattcagcccattcagtgagtatttcattttggtgattgtgttttacagttctaaagcttccatttgcttctcctttatgtcttttatttctttgctgagactttctttttataaaaaaatttgttttcagcatgttcgtaattgcttgttgaaacatttttaagatgactgatttaaaatccttgtgggattaattccaatctgtgtcatatcaatgttggtgtctgttgaatgtcttttctcattcaagttgagatgtacctggttctttttatcatgagtgattttctactgtatcttgggcattttatgagactctggattttattttaatcttctgtttagtaggcctactctgacaccattctggtgggggaatgggagcacagttttattattcagggaaaggtgggagtcaaggttcctcactcaccatccattgatacccagggtaggggtagggatgccattattactaggaaggagtggaatttcaggatcctcactaggcctccagtgacaccactgacacctccctaggcctccattgacaggcctctacaaccatcatatgccgggggactcattactgcctggcaaggatgaaagtcccagatctccattcggtcatttctgaaaccacctcagggagaaggggatgtgtgactatttaaaaccagttgaaggtagaaatctaggctccctacttgatttttgctgagggcagtggagggaggagtatagttttttctgctgtggtgtttgccttggatagggaagttattacctaaaagttttctgtctctctaggctaccccttttctgttcctttggctagagatagccagttttttgaggcacttttttttttttttttttttgcacccatggcattgctgggttgctggcttctccatcaccaggtccaggatacattactcaaaaacaaatccagggaactcactgccatattgttacttgggtcttgagattcctagccaccaggaatagaagaagccacctgcctccttctatttacctgtcagagatgtatgagttatgtatatatatatatttatttatttataatgtccagtgtttttagatatagagggataaataggggaaagtgcatctagtctatcttttcttggaaccagaatataaaagtgataacttaatgaaaatatggatattgtgttagttatagcctttctcccagtaaaaatttagttaggaatggggaaaatcaccacgatcactaccttcactggtatacttctttatttttagcttttttttaaattgtggtgaaaaatataaaccataaattttaccgtcttgatcgtttttaagtgtacaattcagtaggattaagtatattcacatagttgtgaaacagatctctagaacttttttatcttggaaatctgaaactctatacccattaagctacaactttccatttcctcttccttccagtccctggcaaccacccttctaatttctctttctatgaatttgactactttagatacctcatataagtggaattacacagtattagtcttttttgtgactgagatatacattttttctttatccatttatctatcaatggacatttgggtcacttctactttttggctattatagtgctgctatgagcatgggtgtgcaaatatctctttgagaccttgctttcagtacttttggatacatatctggaagtaggattgctggatcacatggtagttctatttttaatttctttaggaacctccagactgttttccacagcacttgtaccattttacaatctcaccagtggtgcacaggggttctaatttctccatatccttatcaacccttattattttctatagtcatcctaatgggtgtgaggtgaaatctgattatggttttgatttgcatttctctgaaagttgatgttgagcatctttttatatgctttttggccatttgtatatcatctttagataactattcaattctttgcccatttttaatcaggttatttgattttttgttgttctttatatattctggatattaaccccttatcagatatgtgatttgcacatattttctcccattctggaagttgccttttcactctgttggttgcatcctttgatgcacaaaagatcttaagtttgatgtagtcccatttgtctatttttgttcttgttgcctgtgcttttgatgtcatatccaagaaatcatcaccaaatccaatgtcttgaagcttttctcatatgtgttcttctaggcattttacagttttaggtcttatgtttaggtctttaatctatattgagttaatttttgtatatggtatatgctaagggtccaacttcatacttctgtatgtggatatccattgtccccaaaatcatttgttaaagagattgttctttacccattgaatggtcttggcaccctgttgaagatcatttgaatatgacagggtttatgtgtgagctttctattctatttccttgagctatgtgtctacctttatgccagtaccatacttttttgattactgtaactttataattcttttgaaattgggaagtttgagtcctctaacaatgttctttttcaaaattgttttagcatttcaggatctcttgagatttcatatgagttttaggatgaattttccttttcttaaattttggttttattaattgacacacagaataattgtacatgtttatgggatacatggtgatgttttttataaatatgtgtagtgatctgagaccaggtatgtggctcagagctgtaatcccagcactttgggaggccaaggcgggggcggatcacaagagtttgagactagtctgggcagcatgatgaaaccctgtctccacaaaaaaaaaaaaaaaaaaattagctgggcgtgttggtgggtgcctgtagtcccagctacttgggaagctgaggcaagaggatcccttaagcccagaaagaggagggtgcagtgaaccgagattgtgccaccgtactccagcctgggtaacacaatgagaacctgtctcaagaaaaaaaaaaaaatgtatagtgatcagatcagggtaattagcatatccatcatctgaaatatttatcattttttttctgttgggagcattcaatatcctccttctagctatttgaaactatgttattgttaactatagtcatcctacaatggtatagaacactagaacttatttctcctatttagctgtaattttgtatcctttaacacagctctccctctcccttaccactacactcattagcctctagtattctctgttctactttttacttctatgaaattaacttttttcaactttcacatataaatgagaacatgtggtatttaactttctgtttctggattatttagaatgcattttttctatttctgcaaaagtgttaggattttgatagggattgtgttgaatgtgcgtattgcttcaagtagtatggacatcataacaatattaagtcttccagtccttctgtctctttgtttatttttgtcttctttaatttctttcaggaatattttgtagtttctcattggtatacttgggttttttgagacaggatcttgctctgtcacccaggctggagttcagtggcaccatcacggctcactgcagccttacccttccaggctcaagtgatcctctcatttcagcctcccgagtagcttggatcacaggcacgtgctaccacacccagctaatttttaaatatcttgtagagacagggtctccctatgttgcccaaactggtctcaaactcctgggctcaagcactcccacctcagcttcccaaagtgttgggattacaggtgtgagccatcatgcctggctctcattgctatccttctatatattaaattaaagtcaactataaagtaaagattctttgctaaatcttgcttttccaataatttcaggttacagaactatgattggggtacttttcattggtcctacaaattatttgctgcttggcaaaattgctgcccatgccagaggctctgcttatttagacattaagccttggctggctcctttacactgcaatagaatgggaccagagtctgcttcccatctttttctttattcattattatgaaattttcctgaagactagtcaccttcagtgactcttaacctgaggccctggcagtactgcataagggttgcaatcaagaaagggagcaccaggctttggatgaagaaactcaaattaaacccaattctgggccctgcttcctccatgaagccttctctgactatgcttcccatgttcatctcccttttctggcctcctataacacttgcctctactgtgcaagctaacactcatcgtgtctcaccaagtagagtaaaaccttggttacttgactctttctgggaaaagggcttctaaaaatttttatttcttttagagttgcattttcactgagtatattttattaattctttattttttaaacattcttaagcaattatttaaaaaaaatagagacatggtcttgctttgttgctcagactggtctcaaactcctggcctcaagcagtcctcacaccttggcctcctacagtgctgggattacagtcatgagccactacacctggccctattcattttttaataattttttaatttttaatgtcttgtgggcacatactagggatatctatttatggggtacatgagatattttgatataggcacacaatgcataataatcacatcatggagaatggggtatccatcctctcaagcatttatcctctgtgttacaaacaatccaattataatttattttaaaatgtataattgaattattattaactatagtcaccctgttgtgctatcaaatagtagatcttactcattctaatttttttgtacccattaacctccccacaaggacatttttaataaccagtttttcccaaatggctcatgatttgatcaatttaagcactgtgagcttttaacattttaaccatcctgaatagtattttctaaaacacaatctacttccctgacttttttttttttttgagacggagtcttgctctgtcgccctggctggagtgcagtggcgcaatctcggctcactgcaagctccgcctcccgggttcacgccattctcctgcctcagcctcctcagtagctgggattacaggcgcccggcactacgcccggctaatttttttttgtattttttagtagagacggggtttcaccatgttagccaggatggtcttcatctcctgacctcgtgatccgcccgcctccgcctcccaaagtgctaggattacaggcgtgagccaccacgcccggcccttccctgacttcttaaacagtatatagaatataaatttgttttgtgtaaggatcattattgtgactgttacttgttgtattatcctataatacactgatattctgaggcctattgaaatgttttttggtgtcttcccctgtactaaatggtccccgaacatttagtctgtgtatgtgtgtgtgtgggaaaccatactaggtttttatgatttttttttatctcttttcttgtcttttagcccttcttgcttctgtcaacctacttttgtaaaattgactccccatctcctagctctgtaggcttgtagtcgatcaaggcttcttcattggacttgatgcctgaagggaatgcttttcaagggtcctgagaggttcagtatttaccttctctagtccatttttttttctttatctacaatcatgttctagtttgaagagctaatttgtgggactaataactaaatctacagaaacaaaaactactgcagactttgaaaccaggtcaccctactttttccttctttcaagctccttgcacactgcagcgctctccaattggaggtttcttgctggggatactagaaagaatagttggtgacaggaagcattttaggcaactctggtgcacatcatttctcatcagagaaacaggcttcagaaggtgacacaagaaaagacactgtccattggggggcactggcaaggagtatttggggcactgacaaggagttcagagtgaggagtattttaaaattttgttatggggctcatgatggatggcagagggtagaaaggggagagcagttttcaggggcagttattgtgaaattcagaattgggagttggggactatggcactatgcatgtgtattagtctgttttcatgctgctgataaagacatacccgagactgcgaagaaaaacaggtttaattggacttatagttccacatggctggggaggtctcagaatcatggcaggaggcaaaaggcacgtcttacatggcggtggcaagagaaaatgaggaagaagcaaaagcagaaacccctgataaacccatcagctctcatgagacttattcactatcacgagaatagcacgggaaagactggcccccatgattctattacctccctctgggtccctaccacaacatgtgggaattctgggagatacaattcaagttgagatttaggtggggacacagccaaaccatatcagtgtaccacatgggtgttgcagatgcagttcaaagttctagattagggaactaaatctagaactttggctagagatgcatctaaaagttgtaattgcgaaaagcaggaaggatgttattaattgtacttctctttacatgtctgtttttagtatttattataatggcattgttttgacttctcagagatgttagaatttgagtatacttgctgatcctgactctttgttgaaagctagatatgtggaacttgaatacaagctttgaaattaaagtactttttttattggctacaccgaggcacaagctcttattaaacgcttagtttggggcatattaacatttcttgaaagtttacaaagcattttcatattcattttctcatttgatcctcactacggccctgtggagaaggtattatctctattttatggctgagggaaagaaatcctaaagagcttaaaagtctggcccaaagtgactttgcagtaaaaggcagagcagaaatagaactcagctctcctaattcataggccagcattctggtattccgtggcattctagtctactatgccctctttcaataagatttggggaacaaacttgttacaaaataaacttaggcacattaaaattttaaagagtttatttgagcagacagtgatttataaattgggtagcaccaaaccacaagtggttttgctccacagcagggatgtgaagggaaaacttataagattcttgcagaaataagacaaagaaactatttgattggttaaagtggaaagtccctagttagaggttagttggtggtttttaattggtaaagtctctagttagaggttagttgttggtttctaattggttaaaattaagtgtcattttgctatttacagtgacttgggtattggttggctcaagtaggaaccaaaggcactggagccatctcagcctaatgacctctcaattaatttttttaacagacttaatgtatttatgtgatgaagatcatctaatgctatagtagaaaagaacaattaatgaatttataaatttgtagtcaaagcaagtctgtaaatataggtagcattctgcagtgctataaatggaaaaatctaataaattagccttatagataatatctgaggcccctaactgcttgcatttagatttgatgtgtatgtgtgcatgtgtgcatgtatgcgtgtgtgtgtgtgtgtgtgtgtgtgtgtgtgtgtactgaggggtgggataaattcagaactatgtttctgcttctgttaaataagagattgtggttagtataatttttacagtctataccagaaataaatctagtatagagacttaccattttcttttttctttaattaaggtattcttaccagcagtaaaatgcacaaattttaagtgcatagttcagtgaaattttatgtatgtgtaaactccacactggaaagttatagacatttctggtccctcagaaggttctgtcttgcctcctcccaggtaataccacctcccaaatgtaacacctgttctgaccactgtcatcatagattcgttttgcctggtttcaaactttatgtaaattgagtcatactgtatctactattttgcatctggcttcttttgtttaacatgatgtctgtgagattcagttccttttcattgctatgtagcattccaaagtatggtacaccacaaattttttaatccatttccctgttgatggacatttgggttgtttctaggtttttaaaatcatgaatagaagttgctatggacatctttgatcatatctcttggtgaacataagcactcatttttattggatataaatctaggagtagactcactagagtaggtatgataaaaaaaagttttaacttagaaaagtcttaatgaaggaactgatggctaaccatcttataagaaaacccactttatgaagagccactattagagattaaaaatgggttcgtattttgtttagcaggacatattccctgtcagacattagagactatttttgcttcacacagtgggctgggtctttcacacttgtgagtagatatttattttcctggtgtctgctacatacggtgcacatcagggatgaggagccctttaattgcaagctgtatcttttttggatggggtcaaattgtcttttcttgggcgatgtggctcaaatgatcataaaataacattggaaaatcaagttcacattacagaaatgtgccttaggattaatttggaatacatcttttgttttgaaagtgaaggtacgtgtgtaattttatgtaatcccaaaacttaactctggcagtatacttttacattacttctaaggtaaagaatttttaaacatcatatgtctgctggcaacatttactaatgaggtgcgatgttgaaagggtatggggaaaattcctgtggtatgggaagagggtgaggtggttgtaaactgaggagaaaactgggaaggtgctccaaagagtactgtttctggaaaagactctgtacttctcccccggtgttgtaacacttcacatgctgtgagacagggaacctccatcctcctcaacagagagaatcacttccggtctttgttttttttaacagaatttaatttgatgatgaatgttcaaagagctaggatttgctttctaggtgactacttggtgcaccacttctattctgcaaattgcaggatacccagactggattttgggtgtatccgaaaccctttaggggccccatgaagtctggcttaagtccagaattctgaccaaggctgccaaggccagcatctcctggctccaccttcctctccagcctcaacccttgccagtccccgtacagcatcactaattccacagtctcttagccttctgcatttggtacaagctttctttgtctggaatgtcctttccctgatgaatttgcttaactctcactcattttctaaggtcgagtgctgccatcagctttctttccacagcctcctttatgcctcggattgacttagatgtccctcttctattcttccttagcctcctatacagatactcatcacatactgcatcaaaattaactcttccttctctttcttcccattagactcagaattactaagatatgttgctactgctaaggcctagcacagtactggttacatggtaggtactcagtaaaggattgttaaattgacatttggatggacatataaaccagcttttaggctttttttttttctgtacccatccattcaacaaacgttaaaccttaggagaggacttattgcaaggcactatgaccagagctgtaggggatagagagatgaacattacatggactgagactttaaggagttcatttcaatagcagagagataacatgtccacaaataacaataatctaaagtagaaagtgctcagtgtcataaaggaggtataaattaaggactgtggatgtttagaagaaggagcaagtactccttgttgggaaaactgaagaagaatgattcatcaagaaaggagcatttgaggtgggatttaagggcaagtagaacatgaatgagcaaagatagaatctcctccgtatcatgtgttttattttgactgaaaagagtagatattatgaaggagtaatgagtaatgggaaacaactggaaatttacgaagtgggccttattagagagggctttaagtgccacgttgatgagtttatatttgattcctgtcaggtggaacagtcttggaagcccatggaagatgtttagcattttattgtcaacagcagagagatcctgtaacattagtctggcaatggcatatcttagtaaatcattattaactaattaattgctaagcctatagttttgctaagtagtgtggaaaaaccctaaggcctttagctcttttacatttttgcacctgtcttttctcactggaaatctagatgaggtaacagattatatgaccaattagttctgaaaaatgaaaatagaaattgacaggggaaagaaacactaccaagacagaagtgcctcataataatgtatagacatataaagtgttgtttgcttaggaaccgtgtccaaaacattgctttcagctgtctggaaaaatccagacacagtatgtgaattatattgttaatatttattcctctgggagtagtttagatcactttcagttaaacataactataatgttctaacctcagactgtctgctcttattgtcccttataaacagtgggtattgcattgtcagtttgttttatagtgtgttatataaccagagcatctggtttcttgctgccttaggccgggccttcaacactttatgcctggattgttgcaacgactttctcattggtctccttatctcctgtgcttagaatccagctttttttttcataacagcaatgtatagtgggaagaatactggatgaagagtaatattaactgggtttgaatcttgattatactgctcactagctatatgatcttgggcaagtcatatcacctctctgagactcagttccctcaactctaaaatggaggtaatggtccctgccctgtccctctcaaggggctgtcaccagaatcatgtgaaagtgctctgaaaactgtcaatagctttaccaagagttggactccactggctggctttataccttccagaatctagtcccatgccacctctttcatctcatttgtcaatatcccccagaacctaccccactctccaatgcatgtaaatgtatggtgctgtcatctggaatattctctcctcttgtctctgctcacccaaattcaaggaataatttaaagaccagtccaaattctactcgctccttaaaatcttccctgatgactccagtgctcaatttcctccttttgtgcattttgacagcacttagttattattaacacttgtctgtacattaccctttattattaactcttttacataaggttcctatctttaattcgattatgatattatgatgccttcactggttcatttaacatccagtgaatgtttatgaggatgcttcctttgtattcctcatagaaccaagtttggaacttaataaataattgttggttcatttatttagaagttcacatacagactctcttaagagagacaagtgaacacatcttctcttcctagggctcggggtattcctcctaacaccccatcctgcctccacgtactacagaaccataaaaaactccttataataaaactgtccagtaaatttttctgagattctgaaactgttctgtatctgtgctatccaatacggtaaccaccaaccacacatggctattgagtgcttgaaatgtggctagtgtgactgaggaactgcatttttgtctttaattttaattaaacagctgcatgtgactagtggctactgtattggacagtgtaggtgtggaccggtggctttctaacttttttttttatcataacaacacaatgagaaatacattttacattgcaacgtggtttttatacacacaaacaagtttcatgaaacaatacttcttatctgcagtatactgatcttttctattctattcaatttcattttttaaaaatgctgattgcaaccccctatatagatttcaccacccactgataaattaggatgtgctgtttgaaaacacactgctcattttatagatggagaatctgaggtccagagaagtgcagtagattttctaaggtcatatattaagtggcagggcaggactagaacacaaattttggggctcctagaatagagctatttctaacagggatgtaggaatttcctccttttccctttccttttcctccttctcctcaccatgctggatattaaagaaaaataagtcgacacactattcattttgattaaatattttcatggtgtcttgattcctaaatgagccatgagctcagtatttgagtattgttgctttttagtttggttattgtccaaaatcaaagatacagtaccatggaagctttcttttaacccactgcatggcttggcagcggcactaatgtgaaactgtcctccttgggaattcaatcatgctttcctccaatttcccagtaacaactgaccagcaggttgattctaaacaacaaaacctgttgaagaatcaaggtgattctcacctcagtttgtgaaaaaggtgcctctagtcttgaattatattgccaaccaaatatttttcttcatcagtacatccagtgtgctaccctttttgtatgccttatcaacaaaaacgatagcctttacaaaggcggcatcctctgagcagcaccttgttatcacagaggcatctagactctcctttcaaagctagtctttttatccttctggaaatggcatctatcaaaaaagagcagagctatcttagcaaaggcaaaaagaggcagcaattcagaggtgcagtggtctatgtgttagtacattcctgaccagtttgtgtatggaatctcatttccccatagacgtttccaaatgcatttcactcagcagacagcaggcagcaatttatccctaagtgaaaacaacaagaaaaatacacttaaaaagggaataagattttcaaaagcctcactttaaaggaaacacagaaatagcccaattttgcattacatttgtcagtgggattaccattatgtcagtaggatgaattaactgaaatctgtaagaaatgtcatattttctggggccaaattatctatggcctgattaatttttctagctgaaaaccagagtcttatagcttaacaattgtcccttgctaaccagactggttactttgctgacttgccctgaaatttatcaggtgtagcctcctctgctccaccactgctaacaccagtcagttaaatagaatcccataaagtcctctctagctgaaggataactctttggttaagattctctaatgtaagtttgaaaatttcactgttgtcttaggaagtcaaagtttataccagtctgtagagaaatcattcatgtcttttgcattatttgacaacctagcattgctaggatgtgacttgctgagtaaattcaagaaaacttgctgttttgattgtgaaaatccacttgaaatgctaagaatttttgcccaatcttctgttttctaagttcttggttgtcagaaaagcaggtcacagggtggaagacaaatgaagatggggcaaggcctgtgcacaggtgagcagaagctggggactaacaggggagtaagtgaacccaggaggaaggggatgaaagcatgttgcaggctgggccagagccttggtcttctggctgtcttcctgctttcccaggccctgctaattaacctgccatctatcatgcctgttttcaaaagccctgtgcaggttgactttcccttcactgttttttaaacccctgtccacaaatccactgagtccaacagattctggctagaccaagcttattatctccctacccacccccatggttttctgccaccgtttcatcaccaacacttgaaaactacaagttatttttgactctctctcactctcccctgccccaccctacactcagttgcttgccaagccctttcggtgttccctcaatcaggaattccctcccgtcccccttaccacttatatcttatttccattaaggctcagctctgatgccaccttttctaggttgtagaaagcctattcacccccagttggaattaattactgtatttatttccttttctttccctgtcttccacatcactttcctttcacttattgcacttctgttagttgtttccagacctagcctctccactaaaaagcttttggaaggtggagactgtatctcactgatgttttaccctctatacttaacacatagtaggtatactctataaagtttatggaatgaaatatgaatgaatattcagctgttaccctacctatcccctgtggatgttgtcccaagttctttaagatgtgatttgatgtatgcattgctgagaaggctgttttagcaccagcagtgtcctggcatgctgttagaattgaaagacctataaggaggttatcctatatctcagacccctcctggccctgagattctatggccttttaatttcactttagagagtttgtggtgcttctttctttagcacaagctccacagaatctaagatgaattgactgaaattcatgtcatgaggtataagtgtttttgttaagccctgtcagaaaatttgtttttcaaagtgattttctcatttacttgcaattttccaaataacccttagaaatgtagtcaattgccggaagccatattattaaagtaagacattggcaaaaatggcagagtaagtacctctgaaaattctctccataatagcaatgaaaaaactggcagaaatagcatcaaatttttcagaactctagaactaaaggcttgcagcaatccagggaacatttactcaagaaaaatggctgcatgttgataagaccagtgagctttgtggcattagtattttcattcaccctattcccatccctttctccctggcttcaaaatcaatagccttcactcacagggaaaaccagcagcctggcagccaccagaggagacagaatagggttgggactcctttacagcctcatttctagagaattgtcattattcgatctgtctggagttcccccagaagaccccccacttgtaagactttatttatttggcctgacacagagctacagaaagccttttccccagggcctttcttttggaaaatgattagaggcagtcaattaacttctcagctgcctgaagcaatggataacatttccagctaaccacaaagctttgaagaaaaagctggggaatgagattccttggggctttggaaagcttgggcatattcctgggaatctacaagattacacgcatgcatagggctgtgcacatgctccggaaagacctcaataggtcctaagctctcactctggctgatcttgagcttggcataagcagaaagtgaagacaaaggcagaagacattgtgtggctgagtgttgaagacatgccccaacatgtacacagagtcccttggccaaaactgggaggctttttgtttccaggaatttaaggaaatctttgtctaattatgagctggccactaaactaacccagcagagacttcagtacaataattattattaaagtacagtggaacagggtgaagcctgttgtccctgagaccttgtagaaactaattcttggtccaccaagttatagatttgtagctctgcctgtatagtccctatctctttaaacagacagaaaaggcagggaactcatatcagcctgatatctggtttgtttatttttaaaggcaagacaaaggtagtttgtgaaaaatttaaaacaaaaagcattgctgttaatcagaagtaattgtattggaaatgatattttacttctgtacctcatccacttcccagattgctttttcatatgagttctccctatgtaggacctgttcctctttcctccctagacccccatgtacataatcttcccatctcactgcttcttgcttctgttaatttcattttctgttctttcatttgttctatacatgtagcctcgattcaaggatggctgtggcctcacatactgcattcggggtgtctatcttttaagagaagaatcaagaagaatagagactgtaatgaccttcttgctggcctagctaggcctgagagggggtgaagtgcaagagtaaaattctttggctgccattttgatcagagccatcccaaatgaagcaaggcagttgtcacaagctttaaagggctttactaatttgacgagataactggccagtgactcactgagacagggttggcaatagagaaatggtatttctttggccagtactaaaaaaagacccaaggcttatatgcatacatgctgtacattcatccaatgccatccatcctcacccctaccaaggcaatgccagagaggttgcccttttcctacagtctactcaagttacttattttctgattttctttctctttttaggctacactatatgttcatttaaacctgatttcttctgcctgtgaggggtagagggtagggtggggaggtgcacagtgtgatttgccctgcctcagtccaccacctcctggggatggcctgacctggataatcatttttagcctggtatttcctgggcatgggccaggggctgaggccagcagcagagaggctaagatggcacaggctccctgtcagatttggtagtgatgaattttcactggggaacaaaatggctgtttctaacttctttagatttgaaacactgcagagactatcatcttaataattaaaatatattgaggagaagggctacttaaatccttgaatgactggaattctgtaagatattttaagaaaggtaatatccctggttaacagtgtttctttttctttttctttttttttctttttttttgagatggaatcttactgtgtcaccaggctggagtgtagtggcgcgatcttggctcactgcaacctcggcctcctgggttcaagcgactctcctgcttcagcctcccgagtagctgggactacaggcatgcaccaccatgcccagctaatttttgtatttttagtagagatggggtttcaccatgttggccaggatggtcttgatctcagctgtgtttctaaaagtacttgtacaaattataatttcaacttccaacaaaatatttatatgatcagaacagactcattttttttttatcagaacagactcatttatatttaggagcatttatttctatgaaaacaacatgccctggccttagaaaacaaaaaataaaataaaacaatttatcctttcaagggatttcttttagagaatctctgcagctacttgtagttgtacaaatggccccctactttctctgtgttcccttcctcacaggggctgaggagcccccatgagttgagaggtgtatgttgaatatcttagctttgaacttgaaatatattttctcatagatatagcaccataaactgtgaaataaactatcaatttaaattttctagttacagattaaaataggttttgtggactagcttggaaatatatttactgtttataatataatttctctcagaaaattattattatttatttatttatttaaagagatgggggttggcactgaaagttccaagcttctgatcatggcttagtctttctggtaaccagcctccatccagaagcccaccaagagatacttcattagaacggaagatgctcttatcacccaggaaattcactaggagctctatgtcaggaaccagggagaaaggccaaatttcagaagaaaagatgcacgtagcatccctgtcactcaccataacaaaggttttaggagctctgtgccagaaaacagtgatagaaactaaatatatatttcttattatatcttaatagtcatctgtgaattccaagaacaagttatgtttactgttaacttcaagatccttctttgcagaagccatatgtgaataaaatggcaaataaaaatactgtgaaaacatctggcctttcagctaaaatattaccatatacacaggtgtacaaacattcaggcttgtcacagcaccttccaagccactggccactagaaacctcacaatacaaacctcatgatattccctgtgacatgggcaggagttaggtatgcaggtattgtatcacctcaacacactcagagtaggggaagctcgataattggctatttacaaagaaggccccatggtataaaatgttttgaagtaactgtggccaaatgattgtttagagatggtgttaaatgggaccttgagaaagggaaggtcaaaagagatggtcaagaggaaatccttcaactaaaggatttagaggtcttgtgagtgtgtttgttcctcaaggaaaaggaattgtttccattagattcaagctgctgacctttcaccttcagggtaaaggtaataatcagtcaaccacaaagataagccccttctattaaattttacttgtttctttccttttctttcagttttatccaagtatgaagatcagattactattttcactgactacctagaagaatatccagatacagatgagctggtatggatcttagggaagcagcatctccttaaaacaggtaagatttggtagcatttgtctgtaagaacccagatgaggtaggcacctgtggttcagggtttgtactttttcttcttgggttggcagagcattgtcttgctcaatgttaatgctactctgaggtggatttaacttgtagtcaaaggagcttaagcctcaggacttttgcttggacaggccccttccaaggccctgaaaggccctagtagtgtgtttacatggttataggtttttgcacaatttgcacaagtaatatatttttattcttttccttaaaggagaatccccaaattctagaagccttgggtttcaaaaaacacggacccactcctggtatcactaatcagtctctagcctttcgtgactggtctacatatttattactctcacatgcttgtctggctagataaaaacacccaaggacttctagacaacccatggacctcagaaacaatatcagacctaagtttttcttaagttttagatcttttgctgaccgtagcactgtctcagtttattctgattttgtatagaacttttagccactgcagctagatggaaaggaggcttgaatttttcttccttaccattacattcttatagattgggaaagaaagaccttttaacctgaaactgctaacagcccagcacccagataaagccagagcttggaaagaggcagctctgagatttgtgtctttctgaggagacatcctcttcagaggccctcacttagcgtggaggaaggaacaggaagaggctgatgaaaaggcaggagaggaagttaggcattgtggagctcctcctgagcctggcttcattattttgattggagaattctgaacagtggaaagcctggagctagcaattaggagaccttttgtattcagactcttctaactcaggtaagtcactgtctctttctggatcttaacttccttcagtggtacttaaaatgaggggatttgaggggatctcttctaattctgcattccatgacaacaggaatccccaggttgccaaatctactcgtattcaaatgttaaattgggaaacgcctcttaaaatgaaatcattgctaaaatgtccatacaactttcccagcgtaaagccacacaggaaggcataaagactgtcagaggcaggagtgagggtgtggacatttaagaggacgagcacataacagctaacatctgttataggttcactgcatactagtcaccatccaagcactttaagtgtattatcttttgaatactcacaactcaatgaagtaggtactataattctccccatttatggatgaggaaactgaagctcagagaggttaagttaaccaggttacacagctggtaagtagcagagtcagggttcaaacccaagcaaagtatgacttcgggtgtcttactcttaaccattatacatctgcttccctgaatatgctaggcaccggggcatggaagggagggaaaatacagatagctcaactttccgatttgctccaaagaaaaggaagacagaaaatagaaactattggctaaaagtagatttccctttgttctttttaagtgcagtgactataagttttatacagaatataatacagacatgttgagaagagggagagaggtgactaagaaagacagccacatctaagtacagataaaaatgtggaagccatatttgtggcccatcaaagtaaatttatgtcataaaatacaagaaagcatgctttgaaaaaagacacaaaaacatttgtgatattatatatgcatttagattataagtgccagttgcactagttgctatacatttcttacacacctaatttgcttagtaagacatttcctttttatttaaacatgcatgtgtgcatgaacagacacacatgcatccacacaaacaagccaacccctagtttttgttttgttttattttattttgttttgcttgagacagggtctctctgttacttaggctagagtacagtggtgatcatagctcactgcaatctcgaactcctgggttcaagtgatcctcatacctcattttttttgtagagatggggtctcactatgttgcccaggctggtcttgaattcctggcctgaagcgatctccctgtctcagcttcccaaagcactgggattacaggtgtgagtcgctgggcccagccaaacctctagttttagataagggatgatgggtgctgatgcaagatccaaccaaccatcattcaggctggagctgatagtcttgttagtgggttctctaggatccttaattttcttattccttgtcttttggcaatgatcccagtgtttgtaactgccaggactgtggaactcagtgaaaagatgacaggagctacccaaggtcattataccagtcaaatagctctggtcaaactataggttgggagaaatactgaaattatttggctaaaataagaatgggtttcctgtgaatttacctagccccataataatggaattgactggttatttgaaattaagttagtagctggctcagaagtaaaggtgggtatttttagatatggtgatttaattttaattttacatttaattacagaaaaatctaagctgttgtctgatataagtgctcgtctatggtttacatacagaaggaaattttcaccaattggtaggtaaatcatttgttttactgtgctttattccttgtggatagcttgcctgaggttatcagtgacttcatagaaacctcagaattaacagttcactatagcaaagaatttgattgaggagactaggtaaatcttacacttcatccaaaagtttcattgctaaagtatcctttcacatatggctctatttcattgagggattatgacagtatacttttgacaccacctccaagtgttcaggcaccagatgatattacttgttatacttttgagattaagggggaaaatcacataatcttttaatttgtataatatctgttaaattacaatccactgctttgtggaactacatgattattaatgaaaattgtgtcttgaaagaaagaaaataatttatttgttttttttcccccttatgacatgaaagcaccttgccattgagagacaaattacagtagtttccttggaactaattctaggctgttaccagctgtcaactagaaaaaaggacagctcaataggtgaagtgaatatgctgtcttcataaaggatatacaacacatttgcaagtagggtggccacttcctagtatcatggccctgtaggaaaagggcctacaaatggtgaaatctactcttctaagaggaaactagaatgaaatcaacctttctgttcagtgccaaaaatgaaggtcacacagacttttcttttctttctttttttttttttttttttgagacggagtctcgcactgtcacccaggctgcagtgcagtggcgccatctcggctcattgcaagctccgcctcctgggttcacgccattctcctgcctcagcctcccgagtagctgggactacaggcgcccgccaacacgcccggctaattttttgtatttttagtagagacagggtttcactgtgttagccaggatggtctcgatctcctgacctcgtgatccgcccacctcggcctcccaaagtgctgggattataggcgtgagccaccgctcccggccctttttttttttttttttttattgctctccccagaaataccccagtcactaacaaacaaaagaacaatctttagtaaccagtggttctgaactgttaactttctctggctgaggagctctttgcaaggctggaaaatatttctaattttactctgccaatattttggcaatagatgatctcttctttatgtgggcctcattgcatcttttccatactaatctggccaataatcccagcattagcaagagccaaaaggcaccccttccaggtcataaattggctccctccttcccatcttcttgtagtaactctccttcagtccccacaactaaaagaaaggggtgaccaccttgacccacttgtcctacaaggttgatgaccccctttgaagttagtcttctgagatcatgtttagcatatttttccacttccacactgggaaaagaaaacaatgaaaacaaaatatcctctctgccatacaagttatctgatttcattggccccttggaaaaggatattgagctcaccctggcctcaaatgtgggattttctttgcataaggtgttcttaaaatggaacctattgtcttatttcgtttattaactaattttataccttttaaagatacatttctaatttattaatatgggtttaaattatgatcatactcaaaacatcaagtatttgcatcatcctctatgggttctagaacactttcacagatattctctcagttcttacaatacccactgatagtaggcagagtatgtactattatgctcagcctataggtgagatttagattagataactagagactggtcttctgatgcctcatctagggatctttcccctattttacaatgtccttcttgctgttcagatcttcatagtgtatattcagaatagtcatgagccttccaaatctctttgaccattttgatgattgcctttggtagtatttgttctttatctaagtaagactggcttccctgagaatttcagggccatgcaagtgagctatgcaaggcaaggtttgggtctggcagatgatgacatggaatggactaagggttggtattcatacatggcagtcacctaccaaaattgcatgtatacctagaagtcttcaagcagaaaacataagggacacatttagttcatttgcttgttttatgtttggccatagaacctgttttggttgactcagcactatgtttgcaagttccaaccatatacccaaatcttgtttgatctgtgggtgtatctgtcacctcacttttcagagtatatatatttacctgtcttgtgtgagtcccaaatatgctgatgtttcaggaaagggcaatttgaggaacccatattaattcccttccattttgccaacaggtggaacgggcccttcatcagatgctggttggggatgtatgctacgctgtggacagatgatgctggctcaagcccttatctgtagacacttgggaaggggtgagttaaatttgttttataaactttctcagagacctctgcagtatcacttgctgctgttgatttagcttgatgctgagccttgggaacactcagtaacaaacttgagggtcttaaaatgctctctgcaagctcaagtggtggggctgacaagtcaacaaagcccctcataagaaggaaacagctaatgtttccttgtgagtcaccaagccagggagttattttcctgggacagaactgaacatcgagggaggtatgtcatttatcctttccatctttgctattgtttgagtaagtccttagaaatgcaagataacaaagggagcaggaagaagggtgtggtgattaagtctgtttcttgacctcatttaagatatctgcctggtgaaggatgtaagtgacctaaaggaagtgcatagagggagctggcgctattttggttttggttcactaaggatgtccagctgatgatgaaggaatctttaaatttgcttccttgggaggacatttaattaagaaagccttctgataatggttgttggaactattttttttttttgagtcggagtttcgctctgtctcccaggctgcagtgcagtggtgcgatctcggctcactgcaacctctgacccccgggttcaagcaattctccgcctcagcctcctgagtagctgggattataagtgcctgctaccacgcctggctgatttttgaatttttagtagagatggtgttttgccatgttggccaggctgatctcgaactcctgacctcagaggatccacccgcctcggcctcccaaagtgctaggattacaggcatgagctaccgcgcctggctggttgttggaactcttgagtcttgctttcttaagacatgtacatacttccctatgggcatctgaaggatggggttggctggatgccagttcaggcacttgggtgaaggtccagttggacttggggatgagagagcgaaaggacactttggatgagattgggctgctgaactcattggctgttgctaattgaggttcagaagtatagaaacatcgttttccttttcccactgtgcaaactcacagattttgctacagctttcagagaggattggagaagggcctagggaggtttcagggcttgttaccttctcttcagggtttgggatatcctgcttcccctggatagtataataatttccattttacagatgaggaaaccgaggctcagggaagtgatgtgatttacccagggtaaaacgcaagaaatcaaagatttggggataaaataaagatattccaactccttgtccagtgatttcccttgtttatacatgcttcttggtgtagatccattcttactatttaatttttttttcatttataacacacttcaaaatgattattttggaagtgagttctggaagtagggagcaaactggaaaaaaaaaaaaaaaactccacagtcagcaatctcaattgtttcaatacaaaatcaagtagcaggaagaagttggaaatagatcttgtagctaagatgagttaaaagagtaattttgtaaagatgtcttttggattgtttcctattcagctattttaaaattaaggtagagtattcacttgccattgtcgtcagtgaatatttagtgctatttagcagccagctaattaggatttccccagacttggacaatttggtagctaatgaaaagaagttggatgtggttcaccctctgagggctgtgctggatccaaagttaaaaactttggttttagaaacactagaagcaaaagacaactgaagagtctggagataatggcctttggcttcaagtgtagttcagtctttatttcaaactctttaaaacctcaggagaaaaatttgtcttggacgcaaactaagcctcaaaaatctgtcccattagacagcgtttctagagctgagaggattgcagtgattacatagggtttttgcagttgtcctcagcaagttacgaatggcctctgtaggatttagggggctgtgctgaaggcacagatggtatccgtacagatgcagttattttggcattggtcttagggaaacattgaacacctgatagcaaaggtatttgttttcccaaagctcagcatggactttttaaaaggtggtgtaaaaacgacagcatgcaatttttttaagcttccttagttgtgagctatgtatattcccctgtgaactgtcgtatatcagaatagcacttcttacccgtgagatccttttgtcaatgctgccaaaatataagagcaaaagccattgctgtctatgtggagatgagatgctatggcatctggcttatataccgatgtactgccgggctttgtggtgacctcctgttcactgagtaactggccagaaaggcctttgtgacattgtttttatgtaatatttatccagctccagcccttgggttaagtcagttccttggtcaactttttgttttgcttttactttatacccactgagtccttgaaagcaatcactttccagatgtctttgtcatcaaaatgaaagatacttagaaatgttctaacttggtcatccctgccttctagatgtggtgcctttgtttttcttctaactttgtagttacaataaaagtgcagagaggaataaacagttataaaaatgtttctaacccatttttttttcttaaaaagactggagctgggagaaacaaaaagaacaacccaaagaataccaacgcatcctacagtgcttcttagatagaaaagattgttgctactctatccatcaaatgggtaaggtcataaatcaatagtttaaaggcagtgcctattcctgttccttctcttcccttgccttatatgtggctccattaagttgtccatctgcttaattatttatgcaaaaaattaagattttgtggcttattggaagatcttttgctaacatgttatttttttccacattaaaaacagcacaaatgggtgtaggagaagggaaatcaattggagaatggtttggaccaaatacagttgcacaggtgttaaagtaagtaaaagagtctggcatctgccttattctgctgtctcctatgcttccctccctagacaactaaacctcccatcaaccgaggtattcttgcaatcccgctaagctactcctcccactaaaccatcaaatatctgccattttgctcagatggctctttgaaatgtgtaagcatggatatctgtgttggtgtatcagagttatattcactggtagcagtatatgtggctgtatcctaggactcattcagtgtctcatgctacagattgatgctcatgtgcctgggagccattggcctgagggtccctttgaagccaaaagtttcatactaagtggtagaggctaagccagcctaagcaagaaatggacccccacagggctcccacatgcactacataatatttaaaaaccctgttcattcagcattttctgtgtacctttactgtgctaagttctgggggtgcagaaataaacttgacacagtccttgcctcaaggaactcaccacctgttgggggcgacaaaccccagggaagtcttggaatcagtttgtcatctcatagcagactcaaggtgtcccagtgtggtatttttccagttgtcttgttaaattccagaattcacctcccacagcaagaggcaaggtggagaggtcaggaccaactttttgaaagcaaacagggtgagtgatgttagtacttacacctgcagaccaccttacctgttgtcactctccttcctaacaacctatcactggatggaaactccatgagggcagagattgtatttatcttgttcactctgtaacactagcacatagaactgcctggcatgcataagtactcaataagtgctcgatgaatacatgaaaatggccgccagaatctgaggccagatttagggatcagaagattgaaaccttctggcctcctttggtgtagaatattaagctcctgggcattatgggggaacctgttccatgcaaagtacagacaggaccctgtttccattactaaccagtcttcagtgaactagaatgctttgggaatgtgtctgtgaggacagtggcctggattttttggggacccaaggaaaatctgtattgactttactccttcctaacaatgtaacctctctgaggctgctctcttgccatagtcagagtgccttctgggcatcgctgactctgctgagtgaaaatctggtaggatttcaggaatcactgtatgaacgtagtgtggaaagtataagatattagaatggctgtgctgagcccaaaactcggcttgaaatggttggtgttaaaataacatccctcagaatttgcttctttcttctaaattttaagattaccaacaacaaagtggaaacctagattttttttttttttttaggacagagtctcactctgtcgcccaggctggagtgcagtggcacaatctccgctcactgcaacctccacctcccagggtcaagcattctcctgtctcagcctcccgagtagctgggattacaggtggctgctaccacacccagctaatttttgtatttttagtagagatggagtttcaccatgttagccaggctggtctcgaacttctgacctcgtgatccacccgtctcaacctcccaaagtgctgggattacaggcgtgagccaccacgcctggtgtagatttttttaaagaatgtaaatgggttccaattcatcatgatcattagcattaacaacaacatattattattattattatattattgttattattctggggaaagataatacatcaaaatgaatgaaatacaagggtgatggtagttaacctctttctgggagctacctggtagagagaatgtgttttctttggtccagtgagactgggttttacccacacatcccagacgtagccgggttaaacatggccttacttaactggcaaggaaagaagaaggaaagggagaaataggcagggtactttacatagacttcagatcatctctcttttaaaggggttttctttctaatacaccataaagtcctacagttcagcatggtggctctcttcagctgctgaccagtaaagcttggcacccgagtcaatctgcagcctatgtcacttgagaggcactctcagggcagctggggaacagtggaagtaatctctctctctctttcccctccacccactgtctctatctctgggtttacctggaacatattctccatattatctatgatcccaaacaaatatctattttttacggacagcttcctttttaaaagtttttttacagtttcccttttgtaaaataaaaattcagtaagtcagaatgtcttttatttaagaaaacaaagtctcttgggactttgagagcagatgcatgggtaacttttcttttttccccagtaggtgtcccgtcattttgtgaagtagacttctccaggttgtaaagcagaaacttctttttgaggttcagatacagtgactctgtggcattctcaaggtctctagacatggagcatcccagagctctggcaaagaagccagagctgacctgaacaccagcttttctatggctcagtgtttggtgactttaggaacactgggcataaattgtactgttttctgctgatatttccatcttcccaaattgtgacttcattatacattgctttgcagaaaacttgctttatttgacgaatggaattccttggctgtttatgtttcaatggataacacagtggtcattgaagatatcagtgagttaccagcctgtttaacttcccagctgatgggtgatgagttcctccctcaccattcagtattctggggctcaagagagtctctctggtcttccccaccagggcaggggagcttaggggagcacagggctctgattctctttcttttcagctttctgagagggagaacaccattagaggggccttgctcctcctcagtgaggtaccacactccttccctgcagaaaacacaaagtgtgtataataatttattcaaccaccaacagatctttcatggaggctcacccttgtccaggcgtgtgattcctgcactgaggagtgagagcaacctaaagatacagtccctgtctcaaaggccctggcagacttgagaaatgagattcttccaataagcccagaatccctattgggagctaaacaagtacccagtggccagaatgaagagcatgagccctagaggaatggcctgggctttgtgcaggcggggagtcagctgagccctggtggcagaggagagggccttctaggcagggtggggggcatgtgaggttccccttagttttgatattggaatatcttctagggctgaagactccttacttatccaatattctgttcttccatttctagaaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtctatgttgatgcattcaaagtaagtcacttctttccctgagcccattgctgcctgcccatcacaccgccatctcagcacagagatccgtgagcagcagtccacaagtgagttgagaatcttgcattgtctttctctccaggagtgttttaagatgccacagtctttaggggcattaggaggaaaaccaaataacgcgtattatttcataggattcttaggtaagaaaggaggaatcacaagtaagtcatcgtgggctaggggagggcgtggggacaaggtttgcatgggagaccaggcaattccagttagtgggttcccgtctagcccaggaatgccgtggcctctggtcagctccttctgtctccggcctaactgatggagagtgatgtttctgtgtgcctgatggaaagcaggtccaatttcaatgccttccttgcttcttgataagatggttccattgctttcccactggatagccccaaggtcatagcattgctccagcatgtctctctcctgcctgtggggcccagggtggtggaatttcaatcccttggctttgccaatatctctcttattagggcctgctggctcattgttcagagctgtgacaggttgggaattggaggaggcaaagacagaagtacccctttcccgagaatgggggctaagccttaaaaccactaacctcttaatgtggacccgagcaagcaacccaacattccctgcataggaaggcacctctggaaacccagtctctttactcactagctgtgaccagagacatctgaggtccttggtacacaaggtaagctagcctagtgcttctgaagctttagcatgcacatgaatcaccttgagagcctattggagtgcaggttcagtaggtcttgggtgcggcctgagtttctgcatttctaactaggtggtgctgatgctgctggtccacagaccacactttgcatacccagggcctaaacacctggttagtgttgaagagcataagttagagagtgatgtggccaggaaaagttggtacaggacacctgttgcaggggtggaatggtctgagacttggcctcaggaaagttatgaggtcagattggttgacagacaaaggagagctacaggagttacaagggaatggcatgagggcacgtgcaaaggacagggtggagatggccttagttatcctccccaacacatctcctcttggacattcagggaggtgaggtgggatgggaacagacacacgtggctttgcatgccaatcccccacttgctagctgtgtgacttcaggaaaaagatatcaatattcagtctcaggttccttttatgtaaaatagggctaatgcctgactcgccctgttgtcatcttacagtaaagtgttcatcaaagagccaggcatataggacagtcactgaaaggtggctgcaccttgctttaccccaatacctatttcctttgccagccccttcttcctctctttaggttggggggtgtggagcggggcgtggggattgcacagctgcctctgctctctctaatgctgccatctattggttgagcccaagaattacagctaaatggaaaacgtggagcctgtaaaggcttttatttttctaagtataaaacctagtgtttggagttctgcaaaatcagatgccctctgttcctaagcatttgggttcaaagaaaatgttgcaaaaaatagatttccagttgctcatgcatgacttagtctcttcaggcggctataacagaatagtatagactaggtggctttataaacaacagaaatttatgtctcactgttctggaggctggaggtccaagatccaggcactggcagatttggtgtctggtgagagcccacttccaggttcatagatggctgttttcttgctgcgtcctcaaatggtagaagaggcaaaggagctttctggagtctcttttatgagggcactaatacattcataggggctccaccctcatgactaaatcacctcccaaagaccccacttcctaataccatcatactgggggttaggatttcaacatatgaattttagggagacataaacattcagtccacaacagtgtttgaggacagctttgaaacagattagaaaataactttggaggaatctcagtgaatagtgtgtgtgattcctgggtgccctggcctccctatcccaagttacctacagagaatttctccaagttgatgtagccctcctgtttcttgaggccactgggtcagagtagcttttgtgaagtttgactactcattaaaaagatgtgggcaatcctcagttctttaataccccaagacagaggttcacatagtgcccatttgcctgttaacttttataagtcctttgtgcaaacttcacttgagggctttaagtccctctgactccccttttctgactcacacccttactgtttgaggttgagtggtccagattggcagaatgtctgaagggagggaagagatgcaaattgccattttctaaatagttgtcctgttccagagacttcgcaaagtatattatctctctgtctacacatatatacacacacacacacacacatttatacatatatatacatatatatacattatatatataaaatatatatataaaatgtattacatatacgtacatatacatatacaaagtattatatacattttacaaatatataaaatgtataaatgtatatataaaatacattgtatatataaataaatgtatatataaaatacattgtatatataaatgtatatataaaataatatataaatatataacataaatgtatatataaaatatatataaaatgtattacatatacatacacaaagtattacatatacattttatatatataatgtattacatatacaaatacatacacaaagtattacatgtacatatacatatatacatatatatacatatatatacacatatatacatatatacacatatatacacatatatatacgtatatatatacatatatatacgtatatatacacatatatatacatatatacatatatatacatatatacgtgtatatatatacatatatatatatatatatatatatatatatatatatatcactaaggaatggtgccatattgagggctcagtgttggtctgtgctgctggcaaattgggcactcagcaggggctgtagccaggtcagccttggtgagtggaagtccatgttgctgaacccatgtgtaacctctatccctgccaccatggccactttgttcatgggcccattgggtgatgacacgggtggctgaggaaaaaggctgagtggtgtccacagaatgggtcatcctatctacttgattattaatcaagaatacacacaatatttctgtgaggtagagactgttatttctgttttacatgcagtgaaactaagagctaaaattaagagagattaaaaagttatttcttcaaggtgattctgttagaaagtggtgaagccaagagtcgatcccaatttgatcatctctacctaccaccttccattgctcccccagggccctcctgcccagtgggaagctgagagagctctaggtgtgggaggatatggccaggatgacactctggccttcaaattttgcctgcttagagagaaggagatgttggttccttgcacttgggtataggtttccacctggagatccatagcattagccctgtctctgcaggtggttggtcagcctgccttttcactccaggtctcactggagacctttgtttagtccccagatcatttctagagctttttacatctattgtatatctttttttaaaaaattttgttccagattcaggaggtacatgtgtttgtttgttacatggctattacatgtgtaatggtgtggattgggcttctagtatacctgtcgcccaaatattgagcattgtaccccaatggatgatgattagataaataaaatgtgttatatacaccatggaatactatgtggccataaaaagtaatgaaatcatgtcctctgaagcaacatggatggagctggaggccattatcctaagtgtactatatctcttataagcactctcagaaatgatgcagcttgtggcagcttgtggccaggcgcagtggctcacacttgtaatcccagcactttaggaggccaaggcaggtggatcgcctgagctcaggagttcgagaccagcctgggcaacatggtgaaatgccgtctataccaaaaatacaaaaaattcgctggatgtggtggcgcatgcctatagacccagctacttggaaggctgggatggggatcgcttccaagcagatcgcttgagcccaggaggtcaaggctgcagtgagccaagattgtgccactgcactccagcctgggagacagattgtattagtcagggttctctagagggccagaactaatggaatatatatacatatatatgtgtgaatatatatatgtgtgtgtgtgtatataacatacatacacacacacacacacacatatatatgtaaaggggagtttattaagtattaactcacatgatcacaaagtcccacaataggccatctgcaggctgaggagcaaggagagccagtctgagttccaaaactgaagaacttggagtctgatgtttgagggcaggaagcatccagcatggagaaagatgtaggctgggaggctaggcccatctctctttttcacatttttctgcctgccaccctggcagctggttagattgtgcccacctgattaagagtgggtctgcctttcccagcccactgattcaaatattaatctgctttggcaacaccctcacaggcacacccaggatcagtactttgtctccttcaatccaatcaagttgacactcagtattagccatcacaagtccaccccttgtcaacttgaacccatatacatatcctgagatcatacatcatcttcagataaagacaataataaggtcataatttgcctaacataatacaactatccttcgtacaactggaaacgcaccaatccccaacccaaatactattacatgaacttaataatacttaaatgctgatgtgaagtcaataaatcttatgtcacatgataaaggagaaaggaaataaaatgagaatattttcttagtacaagtgtatacatgcacaaacatatttttaacaaaagaaggaggaaatgttcatgacaattgcagtcctcgtttctgtagctggtcacgtggtcgtagctagtattgatgactacctacttttactacctattctgtattccctttgccgtcagtaaacacttcagcaggtcatgttttttttcctggtggagtgacccaaaccttcattcctgaagggtctgggccgtttgtagtcctgcctggattgggctgttgtagtttcccattgaccttaatcacagggcatggtaatactaagagacacccaaatggatctcctgtattccatgcatactttttcttacctccattgtggggtagtagactgatttcatcttgatagtccaagtcagtcaccccaaccaacactgtaactcccttattagcctgttgatgtaaagggaagaggagcccaaagtgtccaggtggcaatcttaacttccagtttaatggaactgttgtgtctcctgatggcagcattccttcctctggaactaagaactctaggccagcagaacgtaatgtcgggggaacaggaagcaaaaattttgctggtggatcactggggctgatggtgagtggtgccacttccacttccactccttgattcctggacctgtgaatcctggctatgagagaaagagtaccatatattgaatgctaattcagagcttacacagccttctggaaaactttgccccagccctacaaagtattgtcacctagttggcattgtaattgtaacttcaaaatgaaattccaccattctatcaatccagctgcttcaggctgatggggaacatggtaagaccagtgaattccatgagaatgagctcactgccacactttcttagccataaagtgagtgccttggtcagagtctgtgtgggataccatgatgttggataaggctgatggggaacatggtaagaccagtgaattccatgagaatgagcccactgccacactttcttagccataaagtgagtgccttggtcagagctgtgtggaataccatgaaggtggataaggcattctgtgagtccatggatgggagtcttggcagaagcattgcatacaggataggtaaacccatatgtggactaagtgtttattccagtgaggataaatctctgccctttccgtgatggaagaagcccagtataatcaacctgccaccaggtagctggctgatcaccctgaggaatggtgctatattgagggctcagtgttggtctctgctgctggcaaattgggcactcagcaggggctgtagccaggtcagccttggtgagtggaagtccatgttgctgaacccgtgtgtaacctccatccctgccaccatggccactttgttcatgggcccattgggtgatgacatgggtggctggggaaagaggctgagtggtatccacagaatgggtcatcctatctacttgattattaaaattctcctctcctgaggtcacccattggtgagtactcacatggcatacaaatatcttcacagtttttgaccactcagagaggtccatccacatacctcttccccaaatttggcaccaatttcccaatcatgcttcttccaagtccctgaccatccagtcaaaccattgactatagtctatgaattagtatataatcgcacatatggccgtttctccttccatgcaaagtgcacaaccaggtgcactgctcgaagttatgcccactggaaagatttcccttcaatgggtcagagtaacacacccaaatgaggaatgtgttgcctccaaaatccaaataggcccaaaaggcattgtgcctctttcttggttgtaggaggggccaattgcagcaacttatccttcaccttagaaagaatatcttgacaggccccacaccactgacccctagaaattttactgaagtagaaggtccctgaattttagtcagatttatttcccatcctctggcatgcaaatgtcttaccaataagtccagtgtgtttgctactttttgctcactggatccagtcagcataatgtcatcaatgtaatggaccagtgtggaagtgaaaagcgatcaaggtctctccaaataagattatgacacaaagacggagagttcatatgcccctgaggtaggacagtaaagatatattgctggccttgccggctgaaggcaaattgcttctggtgggcctcatggacaggaatggacaaaaaggcatttgccaagtcaatagctgcataccaggtaccaggagatgtgttaatttgctcgagcaatgaagccacatctggtacagcagctgcaattggagtcaccacttggttaagcttacaataatccactgtcattctccaagatccatctgtcttctgcacaggccaaatgggaaagttgaactgggatgtggtgggaatcaccacctctgtgtctttcaggtccttgatggtggcactaatctctgcaatccctccagggatgcaatattgttttttatttactattttcctaggtagaggaagctctaatggcttccatttggcctttctcactgtaatagccctcaccctaccagtcagggagccaatgtaggggttctaccagctgctaagtatgtctatgccaattatgcattctggcactggggaaatgaccacgggatgagtctggggacccactgggcccattgtaagttgcacctgaactaaaactccattaattacctgacttacataagcccctactttaactggaggaccacaatgatattttgggttccctggaatcaatgtcagctcagagccagtgtccagtaggccctgaaatgtctgatcatttcccttcccccaatgcacagttaccctgctaaaaggccggaggtctccttggggaaggatgggagagcgattcactgcataaattgtcagtaatatagtgaggtccttcctcaaggggacccggcctccccttcattcaaggggttctgggtctgtaaactggctcaagtctggaaattgattgatgggctgtgattctctgtttctgtaattcaaattagtcttttgtgcattcgacctagaagttttctgcttatataaattaagtaggaatgcagtaggcttcctatcaatttcacttctaggaacaccatgattaattagcaaatgccagagctctacacgagtcagactattctgattgcagtagtctgaaagcaatagtcagactattgctttgcctctgctgtccattacggtagctatgcccaccttgcctttgatggttgagtgctgccacttggcccctgccacctcaggatccaattattcccattatatttaaattttgtagttgagtgatacagttcccactgttagatctgacatacagagaagagcaattacagtactcttcgaagatgcatgttctgccctcacaaatctattttgcaaggcattggtcaagggtatatcttctggaccctcccagctgggatgaataggtctgaagtgactaatccactccaccatcccaatctccctaagcctttggatcccttcctctacataaaaccaagggagatcaggcatttccatctcgttcacagtgggccatcttttaatccatatttcagctaaccaagcaaataagctattagaaccttttttaactccccgagctgcaacattaaatgcagagtctctaacatagtgggcccaaatcaataaattcagcctgatccaactctgtgttctttccaccattatcccacacccttaatatccgttcccatgcctgttctccaggtttctgtttatataaattagaaaactcaagcagttatttttgagtatagtgcacctcctcatgggtcacactctcaacctcacctccaggagcccaccaggactttagtctagttgaagtctggaagcaaacaggggtgttgggggtggctcctgaggagaatcaacattatcttgcctggcaactgcctcagaggaggccatcactgttgcttcaggcagcacagggtttatctcctcagtcaaaggtggaaaggctgatgacagcatgggccggggaggggatattgccactactggagatggggaagctgtttcttctggcaaaaaaagttcatcagagtttacaaactcagtgtccccagcttcatcagggtcctcccacacgttcccattccaagttgcagggtcccattcttttccaatcaatgccctcactttaacagtagacacctggcgaggctgtgcatgcaccttttgttggaggccagtcactcgcatgataagagcttgtgtctgtttttccacaatttcagctctttctctacaggagataagactctcacttagggcaatcttagcagattttaggttcaatatctgcttctgaagcctggagctagaatccctgagttcatcattttctttcatgactttgtccactgaacttaggagcaaccaactagcttcattatgttccttggttttccacgtatggtcaattgtattatgtatagtcactgaactccttgcctctcacgagcgatgattcaggtgtgtcaaatgcatttattttgcataactctctaaacagttcacaccaaggactatcagtgttccctatactattagaagtacagtccttagcatttttgggtctaatcatattaaatagccaactccagaaaccccaaaaccaatgaaagaacttcatccttaatattctgttcctctagaacaactcctggtaccaaaatctgtatcagtcaggattctctagagggacagaactaatggaaaatatatatatatatatatatatatatatatatatatatatatatatatatatatatgagtttattaagtattaactcacatgatcacaaggtcccacaataggccatttgcaggctgaggagcaaggacagccagtctgagttctaaaactgaagaacttggagtccaatgtttgagggcaggaagcatccagcatgggagaaagacgtaggctgggaggctagggctgtctctctttttcacatttttctgcttgccaccctggcagctggttagattgtgcccacccagattaaggaccggtctgcctttcccagcccactgactcaatgttaatctcctttggcaacacccttgcagacacacctgggatcagtactttgcatctgtcaatccagtcaagttgacactcagtattaaccatcacacagagggagaccctgtctcaaaaaaaaaaaaaaaatgatgcagcttgtaaagctccactccatgcacatacacacacacacacacacacacacacacaccacccatgggaaaaggtcctggtcagagtcagagaagatgttattattctcaacaccttaactccaaacatcccattagatgactcagttctaaccctgttttggctttctgttttcttgcctacaacttcctttccctcagacctttctgtggtcttaggtaggcttccttctagccatcttggttgctctttagtgtaatctgaggctttttcagtatcactgatcttgcccacctgtggtctaggggaaaaacatctaccttgactttcataaagcaagtcatatggggggattgatttctatatactcttaaacatgcatttgtaggaaaatactgttgatttgcagtaaaatatttctctggccactttctatttgtattgtgttttaaggatttcacagaggtgaaatcttctggtccttgtaatataccatgaggcaactagaacaggcccgatgaccctagtttaaaaacaagaaaattaagacagagtgaattaagtggtttgtccttggtttatgacagaaaaatgttaaacttttcatgagacttcagaaatgaacatattctttgctgacagaaacatgtagatgtgcccaacacaatcctggataccattccagagggagtctttggggcatccctccctaccccagtctttggcagcaggtagatctctccttgctcgcctgatatagctgagcacacagagaaccagatggccctcaggcccggacagtgaggctggggtacctcttaggcacttttgcctcctcagcctgtggctgatgaacattagagggactgtcagccctttgaataccaggtcaaagcagaaattttattatcctaaactcctcccatgttattttggggctagactttttcaatttaatgaagcatagcttatatctcttgtgtcaaggtcagtcatctcaaagtgaattttccaagtgagctgtatctgtactgatgtcaatgtgacaaaggcagtgctttctgacaggaacttactaacttgctaataagtactaacttgctagctaatcaggaccagaagtcagctcactggtttctcatccataaagagtcagcattcccattccataaaaagtcagcatttcttttgaaggtcaggacctcctcccttaccagaggtgctttctgagcatggggctgagaaccagcagtctagcctgagatgctttccaatgtcaaaagaggcagaaagctccctaatggtacctgggcccacgacctggtgactccacctaccgcctctttgctactgctgctcacagagcctgccatgccatctgtggtctctcattcccacattttctcaaacctgtcactttccattttgggacttggactttgaggagatgtaaatgctagggcacatcttctcattgaatgataagatttgggcgcaagtggcttcctttaagcatgctcaccctggcttcaggctttctgtcattccattctcattgtcaccaagggaggggttaagagaaccagagtgcctcctcccaacaacagcagtgggccaggaccggtaatcctttgaaggttaagcatatctccttcaaaacaggtgacgagctcatcttcttggaccctcatacaacccagacctttgttgacactgaagagaatggaacggttaatgaccagactttccattgcctgcagtccccacagcgaatgaacatcctaaacctggatccttcagttgcattggtgggtattcgtaggttgggtgggccaggagatacgatgtgtacagattggttccctgggagttatccagattgctaggtaggaaggcaagagtatgtttgctcactatccccattagaggcagtagagtgtagtggggaaggaatggaccctggagccaaactgctccagttggaatcttggctctgccacttactaactgtattagtctgttctcccactgctgataaagacatacctgaggctgggtaatttataaaggaaagatgtttagttaactcacagttccacatggctggggaggactcccaatcatggtggaagatgaaggaagagcaaagggatgtcttacatggtggcaggcaagagagcttatgcaggggaactcccatttataaaaccatcagatctcataagacttattcactaccacaaggatggtatgggggaaaccacccccatgattcagttatctctacctggtcccacccttgacacgtggggattattacaattcaagatgagatttgggtgaggacaccaccaaaccgtatcactaactacgcacttaggaggagtcacttaatctttctgagcctcagtcttctcatctctaaaatgaggaaaacaatagttcgttccttatggggttgtatgaggtgcaatgcatgtaaggcacttagcactgggcctggcacattgtaagcattctataaatgttagttactctttcccctgtttccttcttgtcctcaaattattgctacccaggcacagggaggaagatgggatatcactagggagagataagggagcaagatgccctgggtgcacacaatctaggaagctgcaggattttcccccagaagtatggctggtgtctacacacactgaaggggcatctgcctgtgaagtagctggtggttctgaggcctgtctgcatcctctcctctagtttaatccaattgtcagtataccagtgaccaggagctgcaagtcctcctcttgtgaaccattctttcactactctgggatggatttgaggttgagaaagcacagactgatggttctctctattctgatagataatttcctgaaggtcaatgccatcttcttaagtattgcctctagctaaaagtaccatttggcttttgtttgttggcttaattgaatgttctttggagatgtgtgtatttgtacactgaaagtaatggaattaaccctacactttgaagatgatcttcaagttaaaatatctcgcagcatgaggaaagagggaaagggacagagagcaagggtgagaatgagagcaagactgagagagtgatatgtatgtctgagtaaggcaatgagttaggagagagagaagcccaggcagtcttccttctttattgctgagaagtcacatccacagagactggcccacatcctaattctgggccaacagctccattgtgcaataccaaaggtaattctaagttgtgttcttttgctttcccccaagggatttttctgcaaagaagaaaaagactttgataactggtgtagccttgttcagaaggtaaagctatatgtttttcttagtctgaaaaatgaagttacccaattttattccttttcaagattgtttttcatagtaaaaaaaaatcctactctgatacgactttactgcaagagaaagaaactaaggcaacaaagaaactatcaggtgtggggaattgtgcataacttcggggaaactgaacaaaaattttggtttgaaatatgcttagcatgtcaagggagtgatatttttagtgatgaaacctaatgttttatctcattaatagacaattattttctaaaggcaatacttacattttagaatgcagcaaaactgtatttatgtcacatttaaaggtggaatgagaattttctgataagactatgccttttattttattttattattttttgagacaaaggctcgctccgtcacccaggctggagtgcagtggcgggatctgggtgcactgcaacctccgtctccaggttcaagcgattctcctccctcagcctcccgagtagctgggattacaggcgcccaccaccacgcccagctaatttttgtatttttagtagagacagggtttcaccacattggccaggctggtcttgaactgaccacaggtgatctgcccacctcggcctcccaaagtgctgggattacaggcatgagtcaccgtgcccagctaagactatgccatgtaaattaggatatataccatacatgttggactgccactgaaaccatgccaatatgtagcaatagtctcttggggcagatttaatttcactaactgacatttctttggagccagtgcttcaggaacatgtcacccctaaagtgagctggacccatgcgtctggcacaggcactatgcctcatgatggagaataggcagtgagtgctggccttcatcagatactccccgcaaagtccttccttcctggctaaacagtatctagaattgaagatggctgagtcttcagatggttcaagtagaggatgcatgtattttctaggcccctgttttcacctggaaaccagcagaccactgtctcagggtttggggtcaaagattgccaattagaaatgttgtgactctgaagtatttaaaactgttttgtcatctccccaggaaattctaaaggagaatttaaggatgtttgaattagttcagaaacatccatcacactggcctccctttgtacctccagccaagccagaagtgacaaccactggggcaggtaagctgttgttcaatggctctcagctagcagacccacatatagcagttgttttatgagaaagaagaattgtggcccatgctttctgtggacagtaaaatttctactcagctggagtgataaaaaaatggcacttctggttattttaatcttctgatgagctgatatttaccaatttcaaagaatgataatagaagaaaatgagctcattgcaaaagttctatgcaaaatcaagatgactaggattgctttttcatggtctggttcagaatagcaaattgaggccatcgataattcaaaggtatcttgaagggctttcagagccttggccacatcaccgtcgttaggtttatgtaacaagtctggctattttgagtctttatagataatttctaatacttggcagtagttctaattgtaagtctcctccacacaagtctttctttagtacagcaattaaaaatgcttagtcttaactactgagtaaagtatttactgaccacttcaacccaagtgtcaagcttttcttctttctcatttccgtattctgatagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattgtgtagttgaagtaattataatttatatcaaaacgtttgtcaaagaaacgatgtcaaatatacacttcttgatctcccttctgtttgcggggatcttactatttgatgggtcactgtccccattcttactgatacttttgtcagatatcaccctgtccttaaatcatgatcacttaaatcaggggtcagcaaactttttctgtaaagggccagacgggaaatattttgggctttgcaggccatgcggcctctgtcacatctactcaactctgctgttgacatgcaaaagcagcaatagacaatatgcgtgtaaatgagtgtggctgtaatccaagaaaactttatttacaaaagcaggtggagggctgggtttggcctgcaggctgtagcttgccaatcagtgacttaaattgttgatttttgtttgataaattaaaaataaattgtgtttgaagtataccct

SEQ ID NO: 37854 - DNA, 14052 bp, Homo sapiens
cagccggctccctccggccgcgaactgcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgtcacccgccgcgccctgcccgccgaggccctggcagctgggggtgggcgccgtccgtacgctgcgcactggacccgctctgctctcgggtaagcgcggcgggcacgtgggcggctgctccctccccgcctgggctgcttgtcccgggcccagcgggacacggaggacgccggggcaccgctcctgagccaccggggcggagcgagcgcggaccctgcccccttcttatttctgttgggatccctggctctgcggccgcttctcccccttaagtagcgggaggacccgcgagtagcctttgccctagggattgcatgcagccgggaggggaggcctgcgggacaccgaggcgggggtggcccggcgggtccggcgggcaggtcggccgcttgctgcagaagccaggcacgtgtcgcttaagcgtctcggtggccttaagtttatctcccatctgcgtgcatcgttgagaccccaaatggggaggcctttagtttactaaatggaccgttactgagaactccgaagtaaaattaaaacagaagcgcttattaaaattaaagcaccaggcagggcgcgttggctcatgccggagggcggatcacgaggtcaggagatcgagactatcctggctaacacggtgaaatcccatctctactaaaagtacaaaaaattagccaggcgtggcggcatgcgcatgtaatcccagctactcgggaggctgaggcaggagaatcgcttgaacctgggaggcagaggttgcagtgagccgagatcgcgccactgcactccagcctgggcgacagagcaaaactccacctcaaaaaaaaaaaaaaaaaaaaaaattaaagcgccagatctagatttttttactagataaaacaatcataactttgaagattcagctatttccccaaaacaagtaagataaagtcttctggactcaacagaagttctgctaaagtttgtattggatcattcatgtgtgtgcttgctgaaatgagccctaactcaaacggacttgaaataactgggaaacctgcccatgaatgtttcggccatttgtgctacttcagcacaattattgcaggggaaaaacaattttctttttttttttttttctttttattgagacggagcctcgctctgtcgcccaggctggagtgcagcggcgtgatctcggctcactgcaagcgccacctcccagattcaagcgattctcttgcctcagcctcccgagtagctgggttcactggcgcccgtcaccacctccagctgagttttgtatttttagtagagacagggtttcgccacgttaggctggtctcaaactcctgacctcaagtgatccacccgcctcagcctcccaaagtgctgagattacagtcgtgcgtcaccgcgccaggccaacaattttctttacgcccaaatgtttgatacactgactgctcctctgcttcgattgcgtagatcagtgatggctcttgtctcattagctcattgttttagaaacctgtttggagctggaatggttgataaatttattccaaaatttgtagcataaagatttacttatgctgtcttgctaatagtctgtccgctctgtttctgatagggatccctacatcactaatttgaatacaaaggtaaagcatttctcagataagaatttagtttcaagtctgtggttttcgttccttttttttttcttcttttttgagatggagtctcgctctgtcgcccaggctggcatccagtggcaggatcttggctcactgcaaccttcgcttcccgggttcaaacacttctcctgcctcagcctgtggagtagctggacgacaagagcacacctccatctcaaaaaaaaaagagaagaaaaattgactaatactaatataaaatattttatctgactagtgacattgaaaaaggaaaatgcaaaattttcataaattgctcacaactcctaattttccgaggccaaaaaccacctttttcaaggcccagttagaaagtaattattgtccaggcacggtggctcatgcctttaatcccagcactttgggaggctgaggcgggcggatcacctgaggtcaggagttcaagaccagcctggccaacatggtgaaaccctgtctctaccaaaaatacaaaaaattagtcgggcgtggtggcacgtgcttgtaatcccagctccttgggaggatgaggccgaatcacttgaacccgggaggcagaggttgcagcgagcctagattgcaccactacactccagcttgggcgacagagtgagactctgtctcaaaaaaagaaagtaattatttacctaatctatccacttcttcctgtcgggccaagggttaaaggagaattgtactaatcattgcctttagcctaaacagcatgcttagtaaaataaagacttaggtctttgaatcactgcaacctctgcctcccaggttcaagtgattctcctgcctcagcctccagggtagctgggattataggtgcccgccaccatacccggccaattttttgtattttagtagagacggggtttcaccatgttggccagggtggtcttgaactcctgatctcaggtgatctgcctgcctcggcctcccaaagtgctgggattacaggcgagagccactgctgttggccaggactgaggggtaacattacctgtaatgttgccgtctccctctaaacttggggccaacaattttctttacacccaaatgtttgagacactaactgctccttgttaaggagaattgtactaattacaattagtaattgctcggttgctaaaatgagggtcacagcagccttactcctaaaattatcttcacaggtaggcaagatggcaaggtcaaagaaggtagtctcaggtggtgtttatagttgtccagtgcttactttgaaaaggtgttttagcttcaaactgctcataattggcatataaccggcgatttgtagcagagtgagagaattaagtgttaaagacaaataactatatactatctattttcctcagaatcctcttaataaactttaaaaaatcacgtcattctgcaactttttttttttttttttggagatgaagtttcgctagtcgcccaggcaatggtgcaatctcggctcactggaatctccgcctcccaggttcaagtgattctcctgcctcagcctcccaagtagctaggattataggcgtgtaccactacacctggctaatttttgtatttttagtagggacttggtttcaccatgctggccaggctggtcttgacctccttacgtcaggtgatccgcctgccttggcctcccaaagtgctgggattgcaggcatgagccactgtgcccggcctgcaacatgataatttaaggggaaaaatatatatatttttctcccaaagtgttgagattacaggcatgagccaccacgcccagggattttttttgtttgttttttttgagactgagtcttgctctgttgcttaggctggagtgcagtggcgtgatctcagctcactgcaacctctgcctcctgggttcaagcaattctcatgcctcagcttcccaagtcgctggcattacaggagtgtgccaccacacctggctaatttttgtatttttttagtagagatgtggtttcactatgctggccaggctggtctcaaaccccggacctcaggtgatccacccgcctcggcctcccaaagtgctgggattacacgcatgagtcactgtgcctggcctgcgacatgataatttaaggaaaaaaaaaattatttcattccttcagcttttgagtgcttgctatgtggcaagcactgtatttaaaattgggaaaacaaatgaaaataagataaaccttgctgtttcttggtgggtacacagcctacttcctggggagactgacagatgatctctagtatgttcagcaccgtgtgtgtgctgggggatagtggtacagggtgccgtaagagcatgttggctggcctaagaacctagacttggttagacaagcctttgggcaggaacggacttctgaatctagaccggaagtagttagtaaagatggtagggagagtctttcagtcaaaacacagtgtacacatcttaaactttcttacctgaacgtcagagtgacctgaaacattcagttctttgaagtggaatgaagcaaaataaatttcttagtgacacattttttgacttcttccactgaaggggtatgaactttagaaagtttcataattaaggggaaaagaaagcaatattgaattatatacttggctaggcacggtggctcacacactattatcccagcactgtgagaggttgaggtgggaggatcatgagctcaggaatttgagaccagtctggacaacatagacccccccatctctacaaaaataaaaaataaaaataataattatacactctacttacgttgtgctgcgtatcagagctgtaaccaaagcaattgaatgctgttttaagtactactatcctttgggtaaggggtaaaatgagccagtgaggcctctttaaaacagtatttgagttaaccatttttctatgaacttacgttgcattgtttttagaaaaatacttggtgtcagaatatgaactgtatttaatatagcatatgctttttaaaaaatattattctctaaggcaagtacttttaactttatatcctaaataactctttttactcttgaacattggccggtccttctttcaggattccctgaatcgtttgaccgtatctttagagaagtgctcagtaagtcgagggctgaacctgtccagtgagtggtgagcagagcttgattctccaccaacccatggcttagctctgagaagactgttgagttgtgatcttaattttcttctttaagcgatggtagtgctatcttcaaggttaggcttgaatttgattaaagtagaattttaagaacttagtcaaattatagttgttccaggaggtcagtttcattcctgtaaaattttactttgtaacccaagctgcactgaagctctcttaggtcaactctgcctaaagaggcacctgattattactgttatttttttttttaggttaaatcatttcttatatgagccatctttatgctgcctccctaaacctcatcaccccaaatttgtcttcagaggcacagatttttttttctgcaagacagaccagtaatagttaagtatacatttgaaatatgctccaaaattttcttttgtgatttaggctaagtaatgttaaagcagataatccaatctccaaaagatgcacaaggtgttcagatgaagccatctttgcttaaatggtactgctgtttaaatgcgtcatctctatacatgatcttcattctttcctgagccatgcactatttaaaggtagtgtcaacaggtcaaacagaaattctgggaaagtcttttgaaagcaatggtaatgaaaagtgcttcttaagaagtaatgctactgcttttctgaaatgttggtcttctgttttagtgcgtaaattcacagagaaacacgaatgggtaacaacagaaaatggcattggaacagtgggaatcagcaattttgcacaggtattggattatattgaaatatttgtcccagtgtgctcttgcatgatttgctttatctctacctttttaaaagtgtttaggctgcgtgaggtggctcatgcctgtaatcccaacactttgggaggctgaggcaggaggattgcttgaggccaggagttcaagaccagcctggtcaacaaagtgagaccccgtctctaccaaaagttaaaaaaaaaaattagcctggcatggttgctcatgcctgtggtcccagctactcaggaggctaaggcaggagggtcgctggagcccaggaggttgaggctgcagtgaaccatgatcatgtcactgcaaaatacaaaaattagctggtcttggtggtgcacacctgtaatcccagctcgtcaggaggctgagacagaagaatcacttgaacctgggaggcagaagttgcagtaagccgagattgcaccactacactctagcctgggtgacagagtgagactccatctccaaaaaaaaaaagaaagaaagaaagtaagaaaaccaaccagagttgaattaagtaaaacataatttagttagggcattatgtggtgttttaagagatgttgcaagcttaacactgaaagtaggaaacatgtcctattcaagaaggaaatgtgtgtgttttgtactgggcaattaaggaaagaggaaaaagaagagcagggtgttgccaccattttgtgggtccagtgatacacacgtgaccaggaggacgggaagaaagaaaacctcaataggcacagatgacacaaagggaaggcttttattcagcccatcttttctctgtaaattcccctcaattccatatggcgatactgtttaagagaaaatgagaagccaaatcctagcgtgttcagtgattttcaactggatgtatgtattgggtgaggcggggaaggggggatgttaactgatgggaatgcactcgtgtcacttaatgatggagctatgttctgataactgcctcctcggggattgcgtccttctgtgagcctcctagggtgcccttacacacacctagatggtacagcctattacacaccttggctgtatggtacagcctttgctcctgggctacaaacctgtacagcatgttactgtactgaatactgtaggcaatcgtaacacacttggcctatcaaaacacagaaaaggtacagtaaaaatatggcataggttgagcatctctaatccctgaaatactccaaaaatctgaaactttttgagcaccaacgtgactcttaaagaaaatgctcattggagcgttttggattccagaatcttggatgaggagtgctcatgtattaagtataatgcgagtattccaaaatctgaaatccaaaacacttctgctcccaagcattttggacaagtgatactaactatattataatttcatgggaccactgtcatatatgtggtctgttgttgaccaaaatgccattaggcggcacgtgactgtacaaaattcctcagacatgtaagatgcttgtgtgttgataatcacaattatatcttccttggcatctctgtatacctactatgaggcccagtgttggatagtttttgagatgttgtgtaagatgtcgtccttacctcctagagtttatttgtgaggggaattacctacatgagaatgacttgcaaacattacatgatggcatcggaacggtggggttgtaattcacttacctgatggagagaccacttctttctggagtcagggacttcagggagtacaaggtgtgaggactatgatttgtagaatcagtgagcaggatttcagcaaatgctttgggggcaatggtgtacataaaactacagaggtggaagaacaccaaatatgttcatgcccagaagagctagcagtgtttgccgggcgcagtggctcacacctgtaatcctagcactttggaaggccgaggcaagttgattatctgaggtcaaaagttcaagaccagctggccaacatggtgaaactgcatctctagcaaaaaattttaaaaaattaaccaggcatggtggtgggcacctgtaatcccagctacttgggaggctgaggcaggagaatcgcttgaacctgggaggcagaggttgcagtgagctgagatcaggccactgcactccagcctgggcaacaagagagaaactctgtctcaaaaccaaataaaacaaagagctagcagtcttgtgtggggcaggaggcttgtgttaggttgctaaagcctgtgagccagatctggctggcggctggtctcttgcagctcctgagttgagaatagttttttaaaatcattttattttacttagttttggagaacagggtcttgctatattgccaaggcaggtctcaaactcctgggctcaagctatcctcccacctctgcctccctaagagctgggattacaggcatgagccaccgcacccagccatttatttttattcttgacatggagtcttgctctgtcgccaaggctggagtatacaggtgcaatctcaactcactgcaacctctgcctcccagatttaagtgattctcctgcctcagcctcctgagtagctgggattgcaagtgcctgccaccacacccagctaatttttgtatttttattagagactgggtttcaccatgtcaaccaggctggtctcgaacttctgacctcatgtgataacacccactttgggcctttcaaagtgctgggattacaggcgtgaactaccacacctgactgagagtagtttttacatgtttaaaggattttaaggaaaactcaagaatgtagcccctccagtataaaatatatactaaatcttcattataggggattcagtgtttggcttattctgtttactggagggtttagttataacttcttagagatttttggttttgtcttgttttatttaggaagcgttgggagatgttgtttattgtagtctccctgaagttgggacaaaattgaacaaacaaggtgagtgttcttaggatcttagaatgatccatgccatgaattttgtttacattgaatagtaatttgtttgtaccctggattaattagagtgcttttttttttttggagacagtcttgctttgtcacccaggctggagtgcagtggcaccatctcggcccactgtaacctctgcctcctgggttaaagcgattcttgtgtctcaggcacgtgccaccacgcccagctaatttttgtattgtagagacagagtttccccatgttggcaaggctggtctcgaactcctgacctcgagtgatccgcccgccttggcctcccaaaatgctgagattacaagtgtgagccaccgtgcccagccaattagagtgcttttgacccaagtattaggttggtgtaaaagtaattgctactcagaggctgagacaggagaattgctggaacttgggaggcggaggttgcagtgagccgagatcccatcactgtactccagcctgggcaacagagcaagactccgttttaaaaaaaagagagaaaaaaagtctattaatatcgatatgttagataatatccttaaactaatgaatacccttttaagacattctgctaaaggtagttttttaacttgatgtaaaatctacatacagtgaaatgcatggaccagaagtgtacaattcagtgagttttaacaaatgtatacacttaaataaaccttcctagtcaaatagatgacctcttctctcgtttctacaccataggtttattttgcctattctttatatgaaaggaatcacacagtgtgtgttacgtttggctgcttttgggatttaccaagcttcttgaatctgtagattgaattttttttcgattaaatttggagacttcttattttagtcatgatttctttctcttcccacttcattcctttttccttctctgatttgagacatgttcgtcatatcacttgatattgtcctatagggtccctaagactgttaacttttcagccttttttaaactgttcttttttttttcttcttatttttttgagacggagtcttgctctgttgcccaggctggaatgcgatggtgcgacattggctcactgcaacctccgcctcctaggttcaagcaattctcctttttcagccacccaagtagctgggagtacaggcatgcacaaccacaccaggctaattttttaaattaattaatttatttatttcgaggttttggtagaggcggggtttcaccatgttggccaggctggtcttgaactcgtgacctcaagtgatctacccgccttggcttcccaaagtgttgggattacaagcatgagccgccgttcctggccagtagttcagagttcataattgtgttttttttgtttttttttttttttttttttttttttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgttttttttgtttttgagacggagtctcacactgtcaccaaggctggactgcaatggcatggtctcggctcactgcaacctccacctcccgggttcaagtgattctcctgcctcagtctcccaagtagctgggattataggcgcccaccaccacgcccggctaatttttttgtattttagtagagaccatgttggctaggctggtttcaaactactgacctcaggtgatcttcctgccttggtcttccaaagtgctggaattacaggcatgagccaccacgcctggcccagagcttataattgttatctgatacagggtacttcactgtcactggaacattctaaagttttcattttgtttttttctgagccacagctaagttgcaagaacatggagttttactgaacctacacacatctggcattcaggcacatcaccatttgttatttactgtgtccaggacacacagataggtccactttattgagacaatatatacccttctcgtggttattatagcctgacaaaacttatggttttatttttaattaaagaaatgtaggccaggcacggtggctcacggttataatcccagcactttgggaggctgaggcgggttgatcacgaggtcaggagttcaagaccagcttggccaacacagtgaaacgctgtctctactaaaaatacaaaaattagctgggcgtggtggtgcgcgcctgtaatcctagctacttgggaggctgaggcaggagaatggcttgaacccgggaggcagaggtggcagtgagcctagaacacaccattgtactgtagcctggtgacagagcgagactccgtctcaaaaaaaaaaaaaaaaaagagccaggtgcagtggcttatgcctataatcccagcactttgggaggccgaggcgggcggatcacggcatcaggagattgagaccatcctagctaacacagtgaaaccccgtctctactacaaatacaaaaaattagacgggcgtggtggcaggtgggcgcctgtagtcccagctactcgggaggctgaggcaggagaatggcatgaacccttgggaggtggagcttgcagtgacgtgagattgcgccactgcactccagcctgggcaacagagcgagactccatctcaaaaaaaaaaaaaaaagaaatttggaattttaaaatcatagctgtatgacaggaatctactttttcgtattttatgttttcaagtaactgacttttaacatttcatgttttctttaattttttttccacttagatgagtttggtgctttggaaagtgtgaaagctgctagtgaactctattctcctttatcaggagaagtaactgaaattaatgaagctcttgcagaaaatccaggacttgtaaacaaatcttgttatgaagatggtaagctgttgctagaaatttctcaaggaattactactacagtaaatattttatctagaatttaaagcaagtttagctgattgtgacttcatctttttctacttcttggtactaaatagagatgttctgctttaaaagaaaaacagaggttagttgaatacttaaagttatgtttaagatttctggctaggcgcagtggctcgcgcctgtgatcccagcactttgggaggccaaggtgggtggattgctttagtccaggagttggagaccagcctgggcaacatggtgaaactctgtctctatagaaatacaaaaattagctggctgtggtggaatgtgcctgtagtctcagttactagggaggctgaggtgggagaattgcttgaacctgggaggtcaaggctgcagtctatagtgagccaagatcgcaccactccactccagcctgagtgacagagcgagaccttctcaaaaaaagaaaaaaaaatctctgatgataaaagcattaccttattttgcagtttcttgatatcagttgtagattctttggttttggtgtaaacatctgcaaagtatttactttttcagacataaagcagccactcatattgtgtgacatgggaggtaaaaaaatatatattttgcattaatttttggttttctcacattttcacccttataatctaatcaggtaagctaacagcaattttctctattttgtagatgaatagaggctccaaaggatttatctgtcagggtctcatggctgataaatggcaaagctaggattaggttgtagttctcttttgtctgtcacctagcccttctaattactactgctttctaatcccgttaacctcagtagttagtgttccatttgttaaagacatacctggtcttgtgtatttggatcatatatttaaggacttatttttattatttttttgagacagagtctccctctgtcgcccaggctggagtgcagtggcgtgatctcggtgcactgcaacctccccttctcgggttcaagcacttcttctgcctcagcttcccagtagctgggatcaagggcaactgccaccacgcccagctaatttttgtggttttggtagagatggggttccactatgttggccaggctggtctagagctcctagcctcaagtgatttgcttgccttcgcttcccaaagtactgggattacaggcatgagccaccgtgcccggcccttaaagatttaaatgtcattttctgatgcttattacaacctaagagttcttaatttattatggtggaatctattctagccataattattttcatttgttatatacaagtattttaattcttaaggctaaaatttaaagttctatgaacaaataatgtatggtttttgtaaagaatacaagattgaggcgctcagaaatttattttacgttttggatgaatttgactttttaaaaagttaatgtggaatataaggttgtcttttggttgcaggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactatcttaattttgcgatacactgcatttgctggtgctatttttatacagtgaagcaacagctttgcagcaaaataataaaatacttcttcgttaa

SEQ ID NO: 37855 - DNA, 14052 bp, Homo sapiens; identical to SEQ ID NO: 37854

SEQ ID NO: 37856 - DNA, 19191 bp, Homo sapiens; identical to SEQ ID NO: 36772

SEQ ID NO: 37857 - DNA, 15907 bp, Homo sapiens
ccggcgggccgcgccgcgagccagtatctcagagagcgcggggtccggacagccgcgcgctgagggtctcggggcgggcgccgcgggacctctccgggccatgggtaagcggctctgcggcgcggcccggacaggggctcggcggccctgcagggaggttcaaggtgccggcgccgggtcccctccagccctcgtggcagtcggtgcgctgtgtggggcggagaggggcccggggtgggtttcggggcgcgggccaaggggagcgagcccggcccgcggcttcagcgctccccggccggcgcggaaggggtgaggctgggcgtccgcgcgagcttcgagaaaaggaaagacaaaaagttttggcggccaggggcttcccgggcgtttatctcgaaactcttttcgccgtctcttgcctgaaatatgccgagcccggtacggctctgtcgtcccacttcctgctgcggtttccacctcgagctgggctcagctaatttgttgtgacagctgtcggcagccgcccctccgccccgtgacatcccgcaggtttcagaaccgcggcgccgccgggcacagactccgggtccagagcgcgcggccctttcctctgcggccgccgtttcctgaaaggggctgcgcgggtgtgaagaacttgctcaatgcgctttgtaggatccactgttcctctttcggccgcgggctgcgccgatggtccggggagcccggcttctcgccccctgccccttccttctcttcccttttctcttttcctctcctgtctctccgcccacccgccgcagccccacaggagaggggtcgcttccctggttgctctcctctcctgtcccttgtgtgtccccttgtcttccctcggtctgcagaagggacggggtggcggctggggagcgtcaggggaagagggcaagagcgtgggctacgagcttgcaggcgatgcccggcttcgcgctcggcgggagctgcgggccaacccgggcccgcgctccgtccctccgcggtgtctaggggtcgcccgggctggggtcgcgtcaccctccgcccagcgccggcgtggtggggcttgcgcggtgcaggacccccgagggcccagggggtcccaaggcgctgcgggtccagtgtccctttgtttgcagagtcttgggccagtaaggagtgctccgcgggccccaggggaggacaacaggtgcctcttgccccacccgggctcctctggtgggagcccacacgcacggtggcgtcactgcgcctacaggcaacgctagagcacaggaggggtgggaggtcggggctcgagggcttcaccccgcagcagagctcagagcccaatccaggccttagggacccgcctggggcctagaacttggtgtggcagaggtagaaagggcctccgataatctgcttctacagttgagagacgtcaactggcacctctgagcctctgccccgtaggtgaaatgggaacacacgaaaccatctgaggagctctcactgtccgtcaccaccaaatgtggcccagactccgtggggagggacagtcccatcctggaactggggcttttaggacatcccagagcccggtaagagggacagggagaatggggcttggaagttggtagcctcacattcagtgtcccccgcacctccttccctttctgtaccctctggtggctcttgtggcctcagctgcccccagaccctgtctctctcgccctcccccaagctgaggtactgaggttgggctgtggcttgagctgcacctgtgccctgttagggagtgggggtcccaggcccatcgcgtttcttctcactgctggctccagctcaacacttggcaggcccccctccccaaactgctggagcaagctcgcgtagactcggcctggccgccgctcccgggctgccgagtggaccggccgtttcgccgcttcaaaggctgtctttgttttgctccagctcaagcttagagaaacttaagccaacaacctcagccgagggggcggggcggcgtctgctggttgttattgaggctgctgttaccattattgtggtaattgacgcagtgttcccagtcggtgacttttcatgaaaggaagtgtcacttccttcccatcacacccagggtgagtggggcgggcagcagaaagatggggagggagagaaggaaaggggtgtgtgcctccagcagacccttaaacttgagagctgtgtggccttgtactagtcactgcccctctctgggcaacaggggtctgtaagtccattgcgctcatcctgcacccaggaggctgatgtttccggagcacctgctgggcagcgaggtgccttggggagggagcaggacaggcaggcctctgatcttctcactgagcctggctgtggtttgtgggggaagcctcctttctcttctcacttttttctgctgagaacattgggcacattgagtctagcacgcccatcttgtagatggggaaagggagatacagaaccagtgaccaacttggtaagaggtgcagccatgcagtgctggaaccccttgccccatctgtcctcttggcccactttcatctgcttccagcttgatgtctggcagggcaggggcccactgacttccccgcatccacccactgcctggccccatagctaccttctagtcctggctaagccccgtgagacatcttaagtttgtcttcagtgactctcaaccaccgcccgactgccttcaccttcctgcctttgcatacctgcctttgcttcgccaggttggttgggccctggccagagctggccccctactctctcaggtaacaggtagcagttttttaaatggaatctcagtaggtatcaacaggtctttcctccttcctcaagattatggagataacaccccttattcaaagatggtgggtcctctgggccctccccgacccaggccagggaagttgattcatagagtgtgggggccatgccccttcccggccctccccctctccccgctgctgcccagctctctgaccagccccctcccatccctgagcctggatgccttagcagtcaacacagacctgctcttgttagcagagtgacaggagcgatgtgctgggaaactgcacatctacttggggaaaggggacaagtttgcatcctctgagcacagataaggaacttgaggtctccctgctcccattagaaagaaaaaaatctctagctctcagggatcagcgtctctcaggagtcagactaccctggttctgaatcccagctctgccatggataagctctgtggccccaggcaagttactgaacctctctgagcctcagacattatatctgttatatctggatggctgggaagattcagcaatgcaatgttgtatgagatgcctagcccacaccagccagggcactgatttgagtcggtggagcatgtaacttgagaacaagtagacctatgggagcatcctctactggaggcagtgacagactaacatcttcagtgctggagttttaggatctgggagttgagcttgactcagacaggagctatggagttggaaagaaatcagactcatagcacaggaagagcctcaggcaatcctcctgcccagcaccctgccgcaccccctctctgcttagtaagggactgggtcactaggagcccaggctcatcttctggcgcagccacctagcctgcctcggccctcttcccagcagtgaaatgaggaaatcgcaggggggcttttgtggagtgaactactgttatcagggtttttctaacaccattttctagctgcacaaaactcaaggaacaaactaggaataaacctccccaagaaagcacaggggctttttaagaaggaacttctgaggactgcagagggaaacctgaattatggagacacatggtcctgaaaagaaagatgcaatactgtaaaggtattatttctcctcaaagtagtttctaaatttaaatgcaatcaaagccccagtagtgggggttttttgtttgtttgtttgtttgttttggagacggagtctctgtcacccaggctggagtgcagtggcctaatctcagctcactgcaacctccacctcctgggttcaagcaattctcctgcctcagcctcccgagtagctgggattattggcgtgtgccaccacgcccactaatttttgtatttgtagtggagatggggtttcaccatgttggccaggctggtctcgagctccttacctcaagtgatctgcctgccttggcctcccaaagtgccaggattacaggcgtgagccaccgcacctggccttttttttttttgagaaggaatctcgctctgtcgccaggctggaatgcagtggcgcgagctcagctcactgcaacctccacctcctgggttcaagcgattctcctgcctcagcctcctgagtagctgggactacaggcatgcgccaccacccccagctaatttttgtatttttagtagagacgaggtttcaccatgttggccaggatggtctcgatctcttgacctcatgatctgcccgcctcggcctcccaaagtgtttttgtttttgtttttttttaaagggaatgtaacagaattatcccaaagttcaaatggaatatttttaaaagatgagtaatattgggcaacttgccctctggatagtaagttgttttataaagctacaaaaattaaaacagtgtgcacaggtcctagcatcccactgtggatgagacagaatagaaagtccagaaatagtcccagatgtgttccttataagcactgacattatggggaaagtagcattttacaccattggaggaggaggctactcactggggcccccaaccaatgaggggaaagtatggctaggatccctatttcatcctgtatactggaatagattccagatgtgttacaagtgagtaatgagacaataatcaccatcatcatcattattgcttgctggatggagaaaggtgaagtctggatgacattcttatggagagcagttttcttttttgcatttgatcccccacttctgttacaaataaaacatgtaaggcattgtgccagaaaagaatctgcacacacaggctgggaacaaggcagtagtgcggtggctcacagcagcagcagcagctatcaggggcaagtgggtttctcctgcctctgtgggctgagtggggctgggagacggggcctccagctccataagccttttccctcctccacagagccaggagagggcccaccccaccatgcaggtcctgcctgcctggctcccagctctctacctcccaacgctggacctgcatggcccaacatctatggcagcgggtttcaagcttattttttatagcagaaccccttttacaaatataaccctgatctgtgaatgatcagggaaagggagggattagggcagccagggacaagacagagggcaccctggagaccaagggggagaggactctcccttcttgctcatctaatgctgcagaagagggggcccaaaggcctgcaacccagagggccctggcaggacagagcactaaccctgagaatggagaccgagttcatctggggactcagctggacacagagatagaatgtttccctttgtggcttaaggcgaacagctctaatccctttcccatctggggttaaacagctcggattggtgacctcctttccaggtaacacgagcacccaactccaggagattttcccctggtgtggtccaggcagagcttgcaaactctgaaccatgcagaagggactagggcccctctcgccctgtggctcacaacctggctgcccactgggatgccctggggagctttaaaccctgctgccccaccttggaccttaaatcagactctgaggatggggccggagcattatgctcctccaggtgattctgatgggccctgtctaaccactgtatttttctgaagcccaaggtgcagcgacttgccaagggtcacatagcaagtctgtgacttaagaagccccagtcacaccaaggaagacatggagagggtctgtcgatgctgaggctctggggcagcaggaatgaggggaggggatgtgtgagctgagggtagcaggcagtgggagaagagccagtggaggaggtgcttctggacctggaagacttcaggaattcacggatagctagcaaagaactcaaggatcttcctctcccatttcatagcagggaagactgaagcacagagtcacagaggacttggttggaaaggcatcagtctgctgggtcacttgttagtacccaggatttctggagactggtgggtcagaggctagcccaagagggtggccctggtctctttctctttgacaagccttaggactggtttctctccaggcttacttggactcttcatgaaggccttgcaaatgttgataaccacagcagccactggaccagaatcagactttgttttgaatcctggtcccccagggaggcaagcaacttacccataaccattctggcttcagattccccctctttaaaatggaattcctccgggactgagggagagaatgtacaggcacaccttgctctatcatgctttgctttattgtacttcacaaatacagcattttttactcattgaaggtttgtggcaacccagcatcgagcaagtctatcgatgccattttttaacagcacgtgctcactttgtgtctcggtgtcacattttggtgattcttacaacatttcaaactttttcattattatatctgttatggtgatctgtgatcagtgatctttgatgttcctattgtcattgttttggggtaccatgaaccccacccacaaagacagtgaactaaatcgataaatgttgtgtgtgctcctcctccacctgctccatcgaccagcattccccatctctcttcctctctttctcttctttggcctccctgttgcctaaggcacaacaatattgaaactgggccaattaacagtcctacaatggtctttaagtgttcaagtgaaaggaggagttacaggtctttacttttaaataaaaaaactagaaataattaaacttagtgaggaaggcaggtcgaaagcccagataggccgaaagctaggcctcttgcaccagtttgtcaagttgtgaatgccaaggaaaagttattgaaggaaatcagaagtgctattccagtgaacacgcatggtaaagcaaaacagccttattgctgataatggagaaagtttgagaagtctggatagaagatccaacaagccataacattcccttaagacaaagcctaatccagaccaaggctctaaatctccaatgctgtgaaggctgagagaggtgaggaagctgcagaagaaaagttggaagctagcagaggttgcttcatgaggtttaaggaaagacgccatcaccatcacataaaagtgcaaggcgaatcaaccagggctggtgtagaagctgcagcaatttatccagaagatccagctaagatcactgatgaaggtggccacactaccacagattttccatgtagatgaaacagctttgtatcagaagaagatgtcatctaggactttcatagctaaggagaagtcaatgcatggcttcaaaagacaggctgactctcttgttaggggctaatgcagctggtactggtgactttaagttgaagcctgtgctcatttatcattccaaaaaacctagaacctttaagaattatgctaaatctactcactctgtgttctaaaaatgaaataacaaagcctggatgacagcacatctgtttataacatggtttactgagtattttaagccaactgttgagacctactgctcagaaaaaaggattcctttcaaaatattattgttcattgacaaggcaaccggtcatgcaagagcgctgatgaaaatgtaccaggagctgcatgttgttttcatgcctactagcacaacatttattctagagccaaggatcaaggagtaattttaagtttcaagtcttattatttaagaaatacattttgtaagactgtagctgccatagatagtgattcctctgatgggcaaaatacattgaaaacctccggagagcatttcaggtacatttgtggttcgtgggaggaggtcaaaatatccaagcatttgggagaatttgattccaaccttcctggatgactttgagggcttcaagacttcagtggagaagacactgcagatgcagtggaaccagcaagagaactagagttagaaagcagagcttgaggatgagactgaattgctgcaatctcatgatcaaacttgagtggatgaggagttgctttttatgggtgggcaaagaaagtgactttttttcttctttttttttctttccttttcttttctttttctttttcttttttttttttttttttgagacagagtcttgttccatcgcccagactggagtacagtggagtaatctcagctcactgcagcctccgcctcctaggttcaaaggattctcctgcctcagcctcctgagttgctgggactactgggacctgccaccacacccagctgacttttgtgtttttagtagagacagggtttcgccacgttggccaggctggtctcaaacttctgacctcaggtgatccacccaccttggcccccaaagtgctgggattacaggcgtgagccaccgcgcccatcctaaagtggcttcttgaggtggaatctactggcgaagatgctgtgaacattgtcaaaatgacaacaaaggatttagaatgttacagaaacttagttgataaagcagcagcagggtttgagaggagggacatcagttttgaaagttttgctgtggataaaatgctgtcaaaaatagcatcacatgcatgccatggagaagtctttcatgaaaggaagagttgccaggtgcagtggctcatgcctgtaatcccagcactttgggaggccgaggtgggtggatcatgaggtcaggagtttgagaccagtctggccaatatggtgaaaccccgtctctactaaaaatacaaaaattagccgggcttagtggcacgcacctgtagtcccagctactcgggaggctgaggcaggagaatcacttgaacctgggaggcgaagattgcagtgagccaagatcacgccactgcactccagcctgggcaacagagcaagattctgactcaaaaaaaaaaaaagagttaatggatgtggcaaacttcattgttgtcttattttaagaaattgccacagtcaccccagcccaagaaaccaccaccctgaaatcagtcagcagccatcaacatggagggaagacataagaacacctaccaaagcaggaccactcagtggccaaggattctaccctgtgcctctgagtaccactggcccctggcttacgctggtttgggtttcttgttcctgaggagattctttttctgtctgggatggaagggaaatctcataggttcctaacaataaggatgtcctgggagggagtgaaccaattcatacttgattaacaaaagaacaaaggacagaaagaaaaggttgtcagaagatgtgggttcctggtctggtatctgctgccagcctgctgtgtggcctcaggcagtttccagtggttgtggtttttgcagtggcagaggtgttgcgtttttgcaaccatcagcacatggtggttcttagtaaaatacagcccatggcttctcctgcccaccacgcagggttgttgtgagccttgctcattccagcttggcacctgctgtgtggggtatgggaagcctcaccgaactatcagggagccccaggagccacaggcagttcagccaggatggctgtgagtagcctagggcgagggaggagctgcccgtggccaggggccagaggaggccacccagaggaaggcacttgtcagcagagacctgaggggtcaccaggacccttgtaggtgaggagagcatgtggccttattagggcagttagaactctgcagatgctcagggaaaggtcagatattcctgaatattcccagaggaactactacccagggacccctgtgttgctttggggccacagccatgggatcctttagctctccagtgagactaagctgcttctcaactctgtgtctgagcatggggcagattttggagacaggatttccccaagcaccacagcccaaccccggcctcctgtgacttgacctcaaggtggttttgcgtttccttcaaagatgtggggagatagttggagcagaggaaagaaaagggacaggtgtggagcggatgcagcgggttgtcggggagcggggaggagggcctgtgtgtgtgtgtgcatgtagcctatgtgcagccagggacacaccccttccccctggccaattctttttttttttttaataatagagacggggtctcactacgttgcccagacaggtcttgaactcctgacctcaggtcatcgcctgcctgggcctcccaaagtgctgggatcacaggagtgagcccctgcactggcgccctctggcaactccaattgggagtagggagagtgctcctgttcctccctgcttgcatctcatatgctctctccccaccccttcctccttactccttccctctctccttgcagcagcccctgtcaaagggaacaggaagcagtccacggagggtgacgccctagacccacctgcatcccccaaacctgctggcaagcagaacggaatccagaaccccatctcgctggaggtgagttgactccctctgctgactccctgggcactcttccctgccaccctcacctgtgctccgcctccaggtgaacctggacactccccaagctctcaggagggagatatgttcctaccctggccctgcccagcagccaggggacttacttgtcatctgtggcagagagtttcaatcttggtttttgtagcagaacccttttttgaaatgaagatgacctaccaccctgatccattaaacagacaaaagctccagcccatgatgtaaaaccacattcacatccattcattcagatgcataacatgggcgtataaagtcactcggtgagaccagcaagactgtttcgatgagcacagaatctgaagggggagctgcaggcagctttttcggagcacagtcggccccggctttcattcattttggccatttgctttggtggcacagtctggaaaaatatcctgattcatgcagaaaagtggttgcaaatggtagttgtctttagcagcttgccaggaattcagaatagaggcctggaggagcagattgacttgagcagttatgagagagccttccttctgaggtctgcacagaccagccccagggccccagcatgttatgatttcatgggtgatatgtgagttcctatgttgtttcttcttagaggtctttaataccttaaaaacactgagctattacagaagctatttacaactaacaaaaaaagtaaaaacactgaaataaacttgaatcaattattatttttttttttagacagagtctcactgttacccaggctggagtgcagtggcacaatcttggctcactgcaacctccagctcctgggttcaaatgattcttctgcctcagcctcccgagtagctgggattacaggcatgcactaccaggcctggctaatttttgtatttttagtagagatgggatttccccatgttggccaggctggtctcaaactcctgacctcaagtgatctctctgcccacctcggcctcccaaagtgctgggattacaggagtgagccaccgtgcccagctggatcaaatatttttggaacacatggctgtctgcgctgtcctagtccagatggtttatgtcctggaagctgtctgttctctgagcagggtatgggccctaggctctctgccccgagccactcgctggataaacggcatcagcagagattgcccctctgggacccgcaaccaaaagtcctgtgcccctgacagcagtgcgcaattgaagcccagagcttcacctccctgtgctcagcacggcaggctggggccacacagaggctcggggaacatgggcctcacagagtaaccccagggcaccagaaagcaccaagcacctttgttccttcagcttttccctctgcggttatgggggagtcccagggacactgagcctgccctcctggagttcctagtctggcggaggagctgacacaaataggacaaatcaagaacaagacagagaagtgaccctggcctggagaaggctggggactgctctcgtggcagcctctggagccagctgctctggggtacccagcctccggggaggtcctggactctagctcctgtcctggggcgctgagagctgacacctgtgtctgccgaacccaggaacagtcactccctcccagaacagtggctaggtgttctctgggaaactggggttggggtaggtaccttattcctcctgcagccagtggtttctgcacatccccagcagccagccaccaactggggcccatcccaatgcctcctgttctctccccaggactcccccgaggcaggcggggagcgggaggaggagcaggagcgggaggaggagcaggccttcctggtcagcctctacaagttcatgaaggagcgacacacgcccatcgagagggtgccccatctcggcttcaagcagagtgcgtccctggggtgcaggcagggaggggggcccagcaggggaccccgcccaggcagggcatcgggcaggcactcccactctgggtgacccaggttgcagatagaaaggaggcctccctccaggctgccactgggccaggggtgcacagggcacagcctgcccgtctattgcagtggccctggctgggtgtgtgctggtctgtgcctggcctgtcagggcaccaggaaggggtggcatgctgtccccacctcccacagagactgacggccagcctgctcttctctcccccagttaacctgtggaagatctacaaagcagtggagaagctgggggcctatgagctggtaaggaaggcacctcccagtccttgccaaactgcatatccctggggtgagcctgcagcgctgtccttgcctctggacagaggaagagccaggatccccagtcctacccctgcgtccctgcctccctgccttccccgctggtactctgctgctcaaagcagcttttcagccttccccatctgttctgcccgccccgtgttgggaaaactgcttgggccagcagtccatggccctaggagagagaatcggctggccgctgctggagccgcagagcagctgccaaactgcagtccttcgagtccctgcgagggcggccggagctgcaaggaccccgccgccagggggcgcccgccggccgcgccctcacgaggtgcccttgcaggtgaccgggcgccgcctctggaagaacgtgtacgacgagctggggggcagcccaggcagcaccagcgcggccacgtgcacgcgccgccactacgagaggtacggcggggcgggcccgggtgctggacgccgcctaccctgcggggctttggccgaccttgccgggagggccgggtggactctgcccggagcgggcagggtatgcgccgtcctcagagctgcgggagcccaggctggctgggcgcactcactgagggagctgaagctttgggaccaggagagggccttcctcggcgccggcggggaagggggctcagaggaggctacagaggcccagggaggggatgggcgccggcctcctgggggacatgcgtggttcctcaccaggctggtcctgccatacgtgcggcacctgaagggggaggatgacaagccgctgcccacctccaagcccaggaaacagtacaagatggctaaggagaacaggggggatgatggggccaccgagaggccgaagaaggccaaggaggagcggcgcatggaccaggtaggcctgcggctggctggggccaccctgtcccttgcctcttgtagccccctaccccacaactccctgtggccgcggagctgtctgctcagaatacacagaacctgcacccagggcgggacttgcaaggttccaggttctccacagatggttgtgcaagtggactctgaactccagcctgcgcccacccaccaggcacctgaggctgtgtccactcagaggacagggcacctttggaaaattctgtacagaggactgcaggggctggcgggggacctgggcaggcctgaaagtgccacctcttgctcctcaggtcaggatgtggggctgaggcagtcctgaggcaagactttctctcattccagatgatgccaggaaagaccaaagcagatgctgctgacccagcaccacttcccagccaggagccccccaggaacagcacagaacagcagggcctggcctctgggtcttctgtgtcctttgtgggtgccagcggctgtcctgaggcctacaagcggctcctatccagcttctactgcaaggggacacacggcatcatgtcaccactggccaaaaagaagctcctggcccaggtgagcaaggtggaggccttgcagtgccaggaggagggctgccgccatggggcagagccccaggcgtccccagctgttcacctcccagagagtccccagagccccaaagggctgactgagaactccaggcaccggctgacccctcaggagggattgcaggccccaggtggcagcctcagagaggaggcgcaggcaggcccctgcccggcagcccccatcttcaagggctgcttctacacccaccccaccgaggtgctgaagcctgtcagccagcaccccagggacttcttctctagacttaaagatggggtgctattggggcctcctggcaaagaggggctgtcagtgaaagagccccagctggtgtggggcggagacgctaaccgcccttctgcgttccataaaggtggctccagaaagggcatcctctaccccaagcccaaagcctgctgggtgtcccccatggccaaggtcccagccgagagccccacgctcccgcccaccttccccagtagcccaggcctgggcagcaagcgcagcctggaggaagagggtgctgcccacagtgggaagagactgcgggccgtgtctccctttcttaaggaggcggatgccaagaagtgtggggccaaacctgcagggtccggcctggtctcctgccttctgggcccagccctggggcctgtgcccccagaggcctacaggggcaccatgctgcactgcccgctgaacttcactggcaccccgggccccttgaagggccaggctgcactccccttcagccccctggtcatcccggccttcccggcccacttcctggccaccgcaggcccctcgcccatggccgctggcctgatgcacttccccccaacgtccttcgacagtgccctccgccacagactttgcccggcctcatctgcctggcacgcaccaccagtcacaacctatgcagcgccccacttcttccacctcaacaccaagctgtaggccagcccatggtgttgtgtacactgtggagtcgacaggggcctacaacaggcaggtactgctgccagggggctctgaactagtgcctgctacccaggacacccgggccatgcccctggctgggcagcctggcacaagtgaagaagaaggcagtgggaaaactgggtttatctcaaggcagcagcctgagcccaggagcagaggacccagttgttataaggcgctgggagaggatgggcagctcccactgccccagagcggagctcgaagcacccaggttgcccacggaaaatccaataaaaagacaccagtgtgaatcc

SEQ ID NO: 37858 - DNA, 3746 bp, Homo sapiens
agttcgtaaaggagccgggtgacttcagaggcgccggcccgtccgtctgccgcacctgagcacggcccctgcccgagcctggcccgccgcgatgctgtagggaccgccgtgtcctcccgccggaccgttatccgcgccgggcgcccgccagacccgctggcaagatgccgcgctccttcctggtcaagaagcatttcaacgcctccaaaaagccaaactacagcgaactggacacacatacaggtaaaaagagaaaaatatatctagaactacgtatctagagctttgcaaatatgaatctacgtattacccttcaaataccattacaaaagagccaaagattcaactgttttcctttttaacagtgtcctgaaagggagcttacattcttttgatcatttagggttcgttttaattcaaaacttttaaaattcttgactaacaaggaacatttcattcaaatctcgcagcttcgtttgctaaagcctgtgtatacatgcataatgagtatgtgaaagatgagcaacataaggattgaattactgcgtttttcatgcactaagtctcctttcctttagaaggcggcttgatgcaggcatatctttgtactcacggtcgtaatacacctaaatagcccatacgtaacatggaaaacaacttttctgtatgtttaaaaataatgttgaggctctccttcctcaatggggacggcgaaggcactggcttggctgcactgtctgacttcagagcacctatagctccgtgcagctgtcagcctatgtgtgcattaagtacagtaactccgtaggtgccagggtggaaatgaaacattttaccagtgtgtatgccctcctaaatgggtctatcttcttcctaagaaaatcacgtgtgtgttgctaaatatctttccagtgtgtgtatacttgcgtgtggatttatttttaattatttttgccttaatcttctctccctcccttttctttcccagtgattatttccccgtatctctatgagagttactccatgcctgtcataccacaaccagagatcctcagctcaggagcatacagccccatcactgtgtggactaccgctgctccattccacgcccagctacccaatggcctctctcctctttccggatactcctcatctttggggcgagtgagtccccctcctccatctgacacctcctccaaggaccacagtggctcagaaagccccattagtgatgaagaggaaagactacagtccaagctttcagacccccatgccattgaagctgaaaagtttcagtgcaatttatgcaataagacctattcaactttttctgggctggccaaacataagcagctgcactgcgatgcccagtctagaaaatctttcagctgtaaatactgtgacaaggaatatgtgagcctgggcgccctgaagatgcatattcggacccacacattaccttgtgtttgcaagatctgcggcaaggcgttttccagaccctggttgcttcaaggacacattagaactcacacgggtaagagaaaaaccataggcaggaatgttactctgagatacaatgaagccctgggctggctgttggatttgcatgaagttgtgacatagtgcttttaatgatggacagtcattgatagctacttcctgactactcaaaaagttgttagggcacaaagtgctccatttcttgctaacaacctctgctccagggactgcaaacagcatgtagactttggaaagtagattcagaaggtttggtctcaaagatcagttagaaaatcaggaaagatgtgcttgaatgtgtgttctgtgaaactgcccccagtaatcagcaaatacaaatgttgctatcttaatcaattgatttggttaatagatgaaggcttttcctacagttttctgttagttacattcttgctctgatatttgtcacccgtgggtgacttggatagttgaaactaaatttactttgcctctcttgctttgtttggggattttttgctccttaatttcttattcgtatcacagaattattctgcagggtatcatggcacttagaccaccttaatcatagtacagaaagagggaaaaggggaaatattgggaaatgttgggaggtgctcaacattagctgcatctgctaaagcagaaagctttaagaagtgaaagtccaagaactacgtaaattatttctgtatgattggcagcagtaataatattcgtgtatgatttttaaatgcaatattcaagtttatcttaaaaattcaggtatttttaaaagtgtctattatgagggattttaatcaggttttgctgcttctcattatttaagcaaaatgtgattgacttttgttaacatgattttactttatgtttcctctaaaaacactgactgtctttctttttttctcccactccacccccaggggagaagcctttttcttgccctcactgcaacagagcatttgcagacaggtcaaatctgagggctcatctgcagacccattctgatgtaaagaaataccagtgcaaaaactgctccaaaaccttctccagaatgtctctcctgcacaaacatgaggaatctggctgctgtgtagcacactgagtgacgcaatcaatgtttactcgaacagaatgcatttcttcactccgaagccaaatgacaaataaagtccaaaggcattttctcctgtgctgaccaaccaaataatatgtatagacacacacacatatgcacacacacacacacacacccacagagagagagctgcaagagcatggaattcatgtgtttaaagataatcctttccatgtgaagtttaaaattactatatatttgctgatggctagattgagagaataaaagacagtaacctttctcttcaaagataaaatgaaaagcacattgcatcttttcttcctaaaaaaatgcaaagatttacattgctgccaaatcatttcaactgaaaagaacagtattgctttgtaatagagtctgtaataggatttcccataggaagagatctgccagacgcgaactcaggtgccttaaaaagtattccaagtttactccattacatgtcggttgtctggttgccattgttgaactaaagcctttttttgattacctgtagtgctttaaagtatatttttaaaagggaggaaaaaaataacaagaacaaaacacaggagaatgtattaaaagtatttttgttttgttttgtttttgccaattaacagtatgtgccttgggggaggagggaaagattagctttgaacattcctggcgcatgctccattgtcttactattttaaaacattttaataatttttgaaaattaattaaagatgggaataagtgcaaaagaggattcttacaaattcattaatgtacttaaactatttcaaatgcataccacaaatgcaataatacaataccccttccaagtgcctttttaaattgtatagttgatgagtcaatgtaaatttgtgtttatttttatatgattgaatgagttctgtatgaaactgagatgttgtctatagctatgtctataaacaacctgaagacttgtgaaatcaatgtttcttttttaaaaaacaattttcaagttttttttacaataaacagttttgatttaaaatctcgtttgtatactattttcagagactttacttgcttcatgattagtaccaaaccactgtacaaagaattgtttgttaacaag

SEQ ID NO: 37859 - DNA, 104093 bp, Homo sapiens
tcggtcagtgcgagatccgctgctgctgaggagaggagcgtcaacagcagcaccatgggtgagtctcagcttcgggtgccgcgacttggggtcagcggctccgaatgccgggaagctctgcggccgctggaccgagctagggaacgccctgaggcgaggcggaggcagcggcgaggggagccgggatgggggccactgcgggcccggggcgcggcagcggcgggctcggggggaggggaggcggcggcggtgacagtttgaattgaacgtgaggagagccgaggcggcggcatttcctgtgccgcggcgggctggcccccggcgcagagccgcggcctccgcggccggagcagcctgagcgtggtggtctcagccctgcccttgcttctctccgtcccttcgcctttcctcagtctcctcccgggcccgccggcttccgcggccccgcttcctcctgtccccggccgcatccccgtcggcagaagtcccctcgtggggcagtgggcctggctaggagggtggggacgagtgtgaacgctcgggcgagggtgctgtgtgggccaacccgggcgggcggcggcggggagggaggaagaaggatgcaccaggctgaggctgtggtggaggcggcggcggcggctgcagccgcagctccagtcaccgcgtcgcctccccgctcctcctcccgcctctcggggttgcctctctccaggcgcagcccggaaggccggtggatggcgggcgagtcttgagaacggagggagaatcggtagtttggtttggaatttgggcttaatttttaggagtaagggaaagagaacgcctgggaagggcgccccccggaggagatagaaagggtgggaagggtccttggaaaagggagggagcggagatgtggagtggcgaagtttagggaaattaatttttgaaaatatttcaatattctcagttattctcttaacgagccctttcatttcctttcctcccccacatgttggaaaaagaacaggccatttcatttacattttccactcctgagttccatttcagctgtgtgtatagtaagaaataagcaaccgagatttttctaggacatttccatttgctgagttacttttgaagagtacactgtttcaaatttgggtttttacagtcctaggaaagaatttgtgacgtccaggtgttttcttagttactgaaataataacttactacatttcttgagtttattgctaaatagttcagctttaagaattctttcttctggcttttttattttgatgaaaggaaaaaatatctttgttagtgcccctgagaatgtaaatgaacagatcatctaaattactaagcatctaacctgttttacatatttatgcacatgcaggtgatgagtatagtcagtttttccccctaaagtttatgtgcagacatggggaggagagtattttagacttaaaagtgtacaggtagggatgaaatttatggaatcctgatagactgaaggggggatataaacaatgaccaagtcagctattgctgcttggattctttatttcttcagactgcaagggaatgagtaaggggtggttgggtggtgatgggggggtggtacggtcgtggcgggagagcagtaaacaatctttcatctcattcagctgttcagtgggtgggactaaaggagataagagttgagtgaagctatgaaataaatgtggaagctacataggtgatttgcatggtagcattgtcttattctatgatgggacaacatgatggaaccaggtcttcataacacagttattaaaaatacatattttaccacatcttaggcttacagaattcaaattcacaacaaataacagaaatgttaagttgattttaattagttcttatcctttaaaaagaaaggatattgtctttttctaatgtagcttaacaatttttgttgcaggctttggtttggagatatttgatgcatacataatacatgaaaggtagtgttaaaagattgtatttcagaagtttgtgataaaattggttgttcagatttgcacattgtcccgtagaagtcattttaagtaaatccatgccagaacttctgaacaagtctgaggcaagttaggaatccttacagaacctaggagaatttagaggaatatgctaggacaacaacaacaacaaagcttgggggagaagagggaggaagaagagttacatctatggcttctaaggtctcagtaatggagagtgatcagatgagggaccagtcagaataaggatagtggtagagcagattagtttcagactttgtataatttgatgatatacatattcattgtagactgtattctgggaattgccgatagagaattcctacctgactaaattgcctgctgagaaatgtgtttcacattttgaattaataagctatcttcaatttttgattataagttgaacattttaaactaatgatttatgtcttttactaagttttgagacaaaactttttgtatacttctttttttgtactaagtttggactgtaaagataaactttattatacaatagaaactgaagaaaaattatgtttttaaggagcagaattgtaaggtagtttgattatgggtttagttcgctatatgagagcatactgttaaatgtagaccattgaactctacagcagtgttttgaagactgcaggttgtgacccattagtggacattgcacttaatattttgagggagattaaattttctttcaggtattgtgtactaggtggggaagtaattttttttaaggattgtggtcaaaatgtacagtatggatgagtcaaatctaaggtcttcgaaccttatgttaggggttggaggtcttggtgtgaggaaggaagactttaaaattaaagactgttaagtccgtgtggctttttcttactttggattcatttatcctgtactccatgtagctcgcatggttagagagatctgaggcctactcctatttgagaggatgttatcccccatagccagaaaccagggtggcttccaaaagaaaagggtagcattcggtgactctgctttaggccttgaggatgaatcttttctttgtttttgtcttcctgtgtccttttgcatcatcagagatctggagactaagctttgagcatgggcttggggaagaggggccaaagaggcagcttggctggcattaagtgttgaaggccgtagaccagacacacactaaatccttgtgacttacacttggtgcagtccagctatccagatgtagggattacacattggggtttgagttcaaaatcttaataatgatttagaacatgggctttgatgttagatatggatgcaaatcttggctttgctactcaatagatacaccagtcagagtaggttagattgtaattttaaaaactacagttaggcgttgttaacaatacggtacattgagaaatcatagagtattttacctacacaaacctagatggtagagcctactatacacctgggctatatcctattgcttctaggctatgagcttgtatagcttgttattgtactgactactgtaaacaattatgacaaatggtaagcgtgtttctttttttgttttttttttttttttttgagacgtaatttcgctcttgctgcccatgctggagtgcaatggtgcaatcttggctcaccgcaacctctgtctgcctcctgggttcaagcagttctcctgtctcagcctcgcgagtagctgggattacaggtgcttgcctgcctcagcctcccaagtagctggggttacaggcactcgccaccacgcccagctaatttttgtatttttagtagagacggggtttcaccatgttggccaggctggtctggaactcctgacctcaagtgatcctcctgcctcggcctcccaaagtgctgggattatagatgtgagccatcacgcccggccaagtgtttgtgcttctaagcatagaaaagatgatgtgctgtactatgaacttgtgactgctatgacatcacaggtgatatgaatttttttagctccatagtaatcttatgggactactgtcataaatgtccattgttgaccaaacgttggacatactgcatgactatactgcaaataaaaaaagtggaaatggaataagaaagataaactataagccccaattttttattattagtttcaatagacataaaattattctgctattaaattttccatttttgtgctctcaatttgtgtttctctgacataaactgataattcacagactggctcattggtccacagaccacactttgcatagcactaggttaaactatgctgcagcaacagactgtcatgctaaagtttatgtacagtattatgttttaggccagtgttaactttaaaaatactatactttgaaagctgagaattaagtatcccctgtgattggggggatagcctgaagctgctcctgcttacgttattttgaagttttctaagtcttaagtattcatgtgtcatttgcattttattcaatgtttgtttgctttatgtgaaatataaagatgatattcttcctccttccccactgatctggaagtaaaaatggactttcctgaagttgtaacatcttaattctgttgttttgtttaactctgggacacaactgactacttctggtagctttattggaggtgaggctccaggtcagagtttctcatttgaggttttgtaattatttgagggaggggagggctgtcttgagcattgtacagtatttaccagcatccctgctgtcatcgtgctaagatgccagcagcacatgctctctctggttgtgaaatgaaaaaaatgtctacagacattgccaaatgtcacgtgggggagcagaatcatccttggttgagaaccactgcactaggtgatggagagccattgaaggattgtgggagacggggaagaaggaacaagcttccttaactgtcttactttttacttcttcctggaactcctaccacttaatattcttagtatttcctaaacttgggaatcaaaattacctagatttttttgtattaaaagtttatcattaattgatatatttttgcaaagcatgatcagtaattactggacatagaacattatgctaggtcattattttctaaagtatggttgaagggtcaaccatggcttggagttaaaaatgcagattaactggttcccactacaagacccattgattagcaatctctgggagagggacccaggagtctacatttccaaatgctttccgacttatcaagtaacttcattattgtatgctttcatagaaaaaaatacgtggattttaagtatttagttcaatgaattgctgatgtgcatacacacatcttgtagcctttattctaatcaagatagagaatacttccaccatcccagagtttcttgtgccctgttggagttctccttctactgccccaggtaaccactgataagatttctaatagccatgaattagtttttttgtttttgttagttgactcatttaaagtgttttttctgggtaactttctaaagtctccccatccctataacttctttattatataagatttcaaataaaatgaacgtcatggtgtttttcaaagaatacagattctcatagtgtttcacactttgataaatgataggcctgggatggggccctgaaaatctttggctctgattgactgttttcaggaaaatcaaaactattttccaccagttttgctgtgctttataaaatatatttgaaatattcctgcagtggtaatttgaaacttttgtaaactttgttcattgatttaacaagtatttgactccaggaagtatcagacactttgacaccatagcaatcaagaaagctgtggtcatggatgttatgatgtttctgttttcatttctgaaattgcttttttaaaactttttttttttttttgaaacggagtttcgctcttgttgcccaggctggagtgcaatggcacagtctcagccaccgcagcctccgcctccccggttcaagtgattctcctgcctcagcctcccgagtagctgggattacaggcatgtgccaccatgcccggctgaatttttttttttttttttttttttttttttagatggagtctctctgtgtcgcccaggctggagtgcagtggcgcgatctcggctcgctgtaagaaggtctgcctcccgggttcacaccattctcctgcctcagcctcctgaatagctgggactacaggcgcccgccaccgcgcccggctaatttttgtatttttagtagagacggggtttcactgtgttagccaggatggtctcaatctgctgacctcatgatccgcccgtcttggcctcccaaagtgctgggattacaggcgtgagccactgtgccctgccaatttttgtatttttagtagagacagggtttctccacattggtcaggctggtctcgaactctcgacctcaggtgatccacctgccttggcctcccaaagtgatgggattacaggtgtgagccaccgcacctggttgctttttaaaaattttattgggaggttttttgttgttgttttgtttttttgagacggagtcttgctctgtcacccaggctagtggcatgatcgtggctcactgcaacctctgcctcctgggttcaagtgattctccttcctcagcctcctaagtagctgggattacaggcacatgccaccacgcctagctaatttttgtatttttagtagagacggggtttcaccatgttggtcaggctggtctctcctgacctcgtgatctgcctgccttggcttcctaaagtgctgggattacaggtgcaagccaccgcacccagcctggttttttttgttgttgttttttttaataggtaatataatcacttggttcaaaattcaaaaggttaaacagagagatacagtgaaatctccttcttacttctacccccaagtcacccagtttcctagtcctcggcatcctgtgttaacagtttcttgtatgttcttccaaaggtgttttttgcatatggaagttaaaaacatttatccttcctgcccccacccttggtagcattaagacacattatttcccacatgtttttttccaatgagtgtaatttgggttattccgtatcagtacataaagagcattcttattcttttatacagctgcataaccgttacatgatatctcagtctgtttgtgctgctccaacaaaatacctgagactgggtaatttataaggaacagaaatctatttcttaccattctggaagctaggaagtctaagatcacagtgccagcaggtttggcgtctctgcttccaagatggcaccttaaatgctacttcctttggagggaacaaatgctgtgccctaacatagtagaaggagcaaaagggtcaagcacctcccttgcacctcttttataaggtcattaatcctattaataccattactagtgattaagtatcaacatacaaattttgggagaacacattaagaccatagcatatggatagatcatgatatgggatatattttgatttgtttaacatgtctgcctctgatagacattaatttccagtgttttgctattaccaactttgacatggtgagtcacttgggatattgatctcttcacatttgttagtgtatctaacaaatacactaactgttagtttttgaactctttgaagcaggagactaccacttaaaagttgtagtattgacattgtcattatatcaataatgtattgatgttatagtatcataacattgatgttaagtattggtaatattgctgttaagtcattagtttagaacttcaacaatcaagttcattcacttaacaaatacacgttttgtacttgctgtgtgctggccactggggaaactgaattaaatgctgtggcagttgaaatagaggcatggtgattaagagttttcggatctagagtcagacttggattcatatctcagttctaaagcttaactgaacctttggcaaataacagaacttctatttttccttctctgtaatgtgggaatcataaggttattggagaagtaaatgagatagtacatgacaaatccttagcatgatgcctggcatataataaacactgagatgttagcttaaaaaaagttatcagactatattgcagttgactttatgttctgcctccactgtgcttaaagtctaggcctgtgttttgttcacctttgtgtccccaacccataactggcttgcatttagtaaaaaatttgtgatacgatataaaggtatgcagagcatacagtgaaagttcaaagcaggataccttttccatgctggagaaggtgaatctttgaaagtcggtaggagtgattaggtaaaggaggtgaaggagtaaagataattattctagactgagaaattatgttagtatcaggttatgaggttagaagaggtaagtaggcaactggtattgctgtgctgagaatttaaaaatctttattgaaggctttaaaagaaaagtggtaatcgtaagaatcgtgatgataattctctctgttgagagttgacagggcaccaggttggagccattaaattgaaggagtttaatgtagcagtttaggactaaaaattggtcagaagcagggcaatgggaaaggacatgagggggatggttgtaaggtgttagggaagatgtgggtggtgagtaatgagtccagaatatttgagctttctgacttgagtgaatgggtagatgaatagatgctatttcttgaaataggtaatttgaaacatgaaattgagaggcctgggggacatccaagtggacatgtcttgtagggtctcaatactaggaagacatctaggatagaaaataaacattttctgataattgtaaatgtattcatttgtgctttgaatttttatgtttagtaagtgagtttgtgaacagagttgaaggaaattacaataaagtgatttgtgtgaaacttcgttgtccttcaaatatagactgaggtctccagtttctggggtagtactaaaatgtttcctttttttttttttttgagatggagtcttgctctgtcacccaggctatagtgcagtggcgcgatctcagctcattgccagctccgcctcccacgttaacgccattcttctgcctcagcctcccgagtagctgggactacaggcgcccgccaccacacctggctaattttttgtgtttttagtagagcctgggtttcaccgtgttagccaggatggtctcaatctcctgacctcatgatccgcccgccttggcctcccaaagtgctgggattacaggcgtgagccaccgcgcccagccagatgtttacttatttaaaatttcagctggtacgtttcacagcagcagttgcttcagactcagggttatgctagtgtttctttgcaggagtgacattttgtatccttatatattgttattgtccattcagattgtaatgagttaatgagtttttttttttttgagacagaggctcgctctgtcgcccaggctggagtgcagtggtgagacagaggctcactgcaacctccacctccctggttcaagcaattcctctgcctcagcctcccgagtagctgggattacaggcacatgccaccacgcctggctaatttttttgtatttttagtagagacggggtttcaccatgttggccagactggtatcgaactcctgacctgaggcaatctgcccaccttggcctcccaaagtgctgggattacaggcatgagccactgtgcccagccgagttctttcttttgaggaagattttggtatgtattgtccttcagttttagagaatacagtaaatattttgaatgagatcattatttgtgtaagaggaggcaaaattctcataataattttcttagttctttccatttatatatttttttaaaaaataaggagagtaccaccttatttattacatgtaacattttggggtatgaggcgatctatacaaggaaaaattttccagaaactaatgttctctcaaatattaacattttaaagtatttctaataataaaaatttagtatataaacttggtttcttttatgattaacttaaacaaattagccacaaggggaaaaataaattatttcaatcattgtaagttaatttgtattctttctaaatatataggttgtaattaggggtgtattagtggtcctaaaccctggaccagcattggaaacatttctaatgtttaacacagttggagactctataactcactaggtgggaagtggggcttagaagcttgcttattaagaggcgggcatggtggcagtggttctcatcggtaaacccagcattttgggaggtcgaggcgggctgatcacttgaggtcaggagttcgagaccagtctggccaacatggtgaaaccctgtttctactaaaaatacaaaaattaaggctgggcgcggtggctcatgcctgtaatcccagcacttcgggaggccgaggcgggtggatcatgaggtcaggagttcaagaccagcctggccaagaaggtgaaaccctgtctctactaaaaatacaaaaattagcttcctgcagtggcaggtgcctataatcccagctactcgggaggctgaggcaggagaatcgcttgaacgtttcaaaaataaacaaaaaacaaacaaaaaaattagccagacatggtggttggtgcctgtaatcccagttactcaggaggctgaggcaggagaattgcttgaacctaggaggcagaggttgccgtgagccaagatcaagcctctgcactgcctggtgacagaatgatactctgtctccaaaacaaaaaaaaaaaaaacaaaaaaaaaacagtttttagagagatggctaactcaacttcagctgtgggcgaaaaagataactagaatgacttagctggcaagtagacccaccaaaaatacttgtttgtgttagtgcatggtgctgtgctgttagagaggtaattacatagacataggccccacgtcccttccccacccccccattttttttttttaattttggaatagttttggatttgctgaaaagttgaagcccctttctttttgaaagctaaacatgtggtcaacacagaggaaatgcagaaataatgctacagacatgcaaatatagcacgatatatgatataaatgcaccatcaacgttagtactggccagggttaagggaaatgtcaagggaatgggggttttatgcttaatggaaacatcttttatttgaatctgtgttgaaagttttgggaggctccattgctttttaattgaaggatgtgtattctagttctggttggtgggtagtggatttcatttaacaattagaatctagctaagataaacaaaggacctttttcccccgtagggtagtttcctcattgttcttatggcttccagtctcttcccacttcatttaataaataaatcttttaagattactatacctaaaacattacttttacaaaataacttacctattatagtaacataaatatgtctattatttatagtattggcttctagagctcttgttaaaaatattatttcttgggctctatcggcaagattctaattccctacttctagactggggcacagatttctatttttaatcaaaagctccccatattcttctgattatagccaggtttgggaataacttttctgcaagatataagtccggaggccttaataataactatcatctgtagggcaaccactgtaacaactgtcatttattgtacttactgtatgtgaagtgccaaaccctttatgttaattgttttgtatataccttacaaatatcctcatcaagatgttatcccaatctaaggctcagaaaggttatgtaacttacccgcctgaacacaaataagttacagcagatactggaattcagatttctagctagctgtacatatactgccttatgaatcttttatatattaaaaacttttaggtcatcattttagcacctccttggtttgaccttttcctacttacaaatgagtaatattcagtattccttttttttttttggaaagagtctcgctctgtcacccagactggagtgcagtggcatgatctcagctcactgttgcaacctccacctcctgggttcaagcgattctcattctctcctgggttcagctgctggcctccccagtagctgggattacaggcgtgtgccaccatgcctggctaatttttttgtatttttgtaggcatggggttttgccatgttgaccaagctggtctcaaactcctgagctcaggtgatctgcctgcctcagcctcctaaagtgctaagattacaggagtaagccactgcactcggccaatattagtattcttgcttctggttatggtgtttgtacctgccttgaagtcctatcatctgttaaggaaggcccatatcaaaactacccattctgagaagcttttaccaaccatgacatgatgagtaacttgggatattgatcatttcacattcgatagtgtatcagtgcttttgaactctttgaaataagagactatcagttgtagtattgacattaagttcattacatcaataatgtattgatattatattactgtaacattgatgttaactattggtagtattgctgctaagtcattagtttagaacttcaacaacttcattcatttaacaaacacatgttttatacctgctgtgtgctggtcactggggaaactgttaaaagttggagagtattttctttcatgctttttctgtaaacttaaaaaagctgtaatgatagtggctcaacattttatttctctttggtaaattcttggggtaagtaatatggtagatgtatgtttaatttttaaattgcaaaattattttgcaatatattagtaacattttacattttcacccccagtgaataagaattcaggttgttccatgtgctcaccaacacctagaatggtcactgcttttaattttactcattcttatagatttgtagagataacttactgtaattttaatttgtattttcctaatgactaatgatgttgaggatctcctgtgcttatttgccatctgtttgtcacctttggtggtccattgaaatctttggtccatttttaaattaggttatttgtcttaatgaattgtaagggtttttttaatattttaggtactagttttttgttggactgtgcaaatacactatttctcattacacttttacccactaactttagtatcttgtcaatgattcttgcctatggcagttattactgtgctgtttgtgttactggtgattttctgttacatgattttctgtttacatgtacatgatgctacattttaaagctgggattctgaccgggtgtggtggctcatgcctgtaatcccagcactttgggtggccaacgtgggtggatcacgaggtcaggagatcaagaccatcctggctaacacggtgaaaccccgtctctactaaaaatacaaagaattagccgggcatggtagcaggcgcctgtagtcccagctactcgggaggctgaggcaggggaatggcctaaacctggaaggcagggcttgcggtgagccgagatctcgccactgcactccagcctaggcgacagagcgagactccttctcaaaaaaaaaaaaaaaaaaaaaaaaaagctgggattctgttgtaaggaagagctcttttatttattcatcagttcggttatatattaatttttttcattgttcagttgtccattgatagacctttcaggtggctcttgttcatcctttcactgtgtacccatcatttttaggggtacttctttactttctagttcatcttgtatttttcgtgcctaagccttggaatcaaccattgtccaaggagtccagcaacctttttttgagagtagtgattaagaaccaagatctgggcaccagaagtgctcattgctgctggggtgtcactgcctctagtagatgttttgaacagacagaggtaggcaatatatgaatttatatatatacatctgtatttttgtatatgtgtgtaaaaatatttgcatatgtatactaaaaaccatgaatttatactggtacatcgattccaatctattaatgcagagttcaatctagcctttctcttttccttgtaactcttttcttcaacattgagaaacctggctttcatctacaatttatttacatacttggaaaaacctattgtacacatagatgtaacttcagaactatgtaatatgcttacttgctagagtatatttgtgtatgctttttttgtctttagccttatgcagtaccaatactgttagttaatatagtatgctaataccttatgctaatcaaaatacttttttccaaagttagttatattcttttctgttccacccccttcagtgtcttcatgttattcttctgaaatacaattagttttatttgttactatttcttttcacatcctggctgattttgtttttttaatgggaatatatggaaaattactatggtgttaatagacttagtattcttcccacctttcttttaccctgttctcattctccttttttctaccactttcccacacatcgatagaggtaatggatctcatcagtttctgattgattttttgtgagtatttttttgcgcatatgagaagatatgtgtgagaaaggagatataacaatttatgaaaggtagtgtacagtacatgcttgtttttatcacagatttattgagataatttacatgccataaaatataccccttgaaagcgtgattttgtggtttttcgtgtattcagggttgtgcaaccattgtcactgtcaacttttaggacattttcatcagccccaaatgaaactttgcagccattaataatcagtccccatcccttctcttcccttgtcctggcaaccactaatttactttccgtttctatggatttgtctatcttggacattttatataaatgagatcatataatgtgactttttgtgatgggcatctttcacttagcagtgttttcaagttttgtctgtgttgtagcatgtctcagtagtacttcattccattttattgctggatattattctgttgtatatatactaccatatttcatttatccgttagttgatatttgggttgttttctactttttgactattatggataatgctgctgtgaatgttttgagtacaagcttttgtgtggacctatagttttcaattcccttggatatatacctaaggatagaattactgcatcatagtgtagtgtaactctagtttaactctatgaagaactgcctgactgccgaagcagctgccttattttacatttctaccagcagtgtatgagagttccagtttttccacattcttgtccatacttgttattgcctgtgttttaaaactatcctactgggtgtgagctggtatcattgtggttttaatttgcatttccctaatgatgttgaacatcttttcatgtgcttattggcaatttgtacaccttctctggaggaatgtctattaaaatgctttgctgagtttttaatgaagttgtcttactactgttcagttgtaagaattcttcatagattctggatataagtcctttatcatatagaagacttgcaagtagttcctacaattccacaggttttttttttttttacgttcttgatagtgttctgtgaagtacaagcatttttaattttgatgaagtccagtttatctacttattgcatgtgcttttgatgtcatagtcaagaaagcatttctaatccaaggtcatgaaaatatacccctatgttttctaagagttttatagttttagacctttatgtttaggtttttgatccattttgagttaatttttgtgtatggcgtgagataggagtcattcttttgtatgtggctatccagtagtttcatcactcattgttgaaaagactagtctttttccattgtgtggtcttgacaacttctgtgaaaacaactggccataaatgtaagggttttcttgtggattctcatttgtttcttattgatctatatgtccttaatggcagtaccacactgttttgatgactaactttgcagtaagttttgaaactggggagtgtgagtcttccaactttgttctgtttcaaaattgttttggttattctggttcccttgaatgtccgtctgaactataggcttagtttgctaatttctacaagtaggccaacaaggatgttgatagccatggtgttgaacttgtatatcaatttgaagagtattgtcgtcttaacagtattaagtcttccactccattaatgcaaagtatcttctgtttatttaggtcttcagtttttgtgaacaacatttttatagttctcatgtataagacttacatttctttttgttaaatttatttctaggtattttattcttgatgctatcacagatggaattttttcttaatttttttatagaaatgcaattgatttttgtatattgatcttatatcatgcaactttattagttcctgtagtgttttttttttagtggattcttttggattttttatttataagatcatatcgcctgcaaatactacttacattactttacaatctagatacattttatttctttattttaccaaatgccttttctggaacctccagaactgtgttgattaggagtagcaatgatagacatctttgtcttgttcttgattttagagtgaaagcattcagtctttcatcattgtgggttttctgagatgttctttatgaggttgaggttcccttgtatgtctagtttgttaagtgtgtttatcgttgaaagagtgttgaatttttgtcaaatgtgttttctgtgtctactgagatgattatgtgtttgttgtgtgtgggttttaatttagtgtattacattgattaattttcatatgtaaaaccaacatattcattctgggatatatcccattggttatggtgtataacccctttttattgctggatttggtttgctagtactttgttgatgtttttttccatccatataagatattggttggttgtttttactcgatgtgtttggttttggtatcagagtaaaactggcctcataaaatgagttgggaagtatttaatcctcttctatttcttggactagtttttgaaggattgtacaacctttaaacatttgatagaatttactggtgaagacatctgggtatgggctttgtgtaaagttgtgtttttgcctttttggggtgtgtgtgtgttagttattttttgttactaatctattataggtctattcagattttctgtttcttgagtcagttttggtagtttatgtctttctaggaatttttgcatttcctctaggttataatctgatctgttgtcagcatggaattaattgttcataggttcctttttatttctgaaaggttggtagtgatttcccttctttcattcctgattttagtaatttgagtgttctggttttttttttcttggctggtttagctaaggttttgtcaattttgttgatcttttcagtgaactaacttgtggttttgttaatgtttctgttttatgtatttcatttatttctgcttaaataatcatttccttattttgttttccctgttttgggtttagtttattctttttctagtttcttgagatggaaggttatgatgtgagatctttctttttaatataggcatttacagctgtaaatttccttctaagcactgatttagctgcattcaatacattttggtatgttgtgtttttagtttcattcatctcaaagtattttccagtatcccttgtgatttagtttttgacccattgattattaaagaatgtactgtttaattttcacaagtgtgtgaattttccagatttttctctgcagttgatttctaacttcattctctagtggatgaagaatatactttgtatgattttcagcccatttaaattgagacgtgttttgtgatctaacatatggtctcttctggagaatattccatgtgcacttgagaagattgtgttttgctgtttttgggtggaatgttgtacagctatgtgttaggtctagttggtttatagtgttgttgagtcttctgcttctttatcatctgtctagttgttttacccgttattgaaagtagggtgttgaaggtcaggtattactgttcagttgttttttttacctttcattttcttagctttgtgcaatttggggactcttttattagggacatacgtgcttaaaattgttctatcttctcaatggattggtccttcagtcagtataaaatatccttctttgtggtaacaatatgtcttttaagtctgtgttttctgatattagtgtagctacttcagctctctcttgttttctgtccttttttttcaatctgtttgtgtttgtgattctgaaacatgtctcatgtgggcaccacatagttggatcttacttttaaaaatccacatagccattctttaccttttgattggagtcctattatacctgaaacagcaaaatacattagttacatttaatctaagtagtgatatgatttacacctgtaattttgctgttttctacatcttgtcttttttttttttttgagacagggtctcactctcactcaggctggagtgcagtggcaccatcatagctcacttggttgacagtctttttctttcaacattcgaaatatgttatccttttgctttcgggcctccatggtttctgataggatgtcagctattcttatttacagtctcttatacatatagttgcttctcataagctgctttcaagattctctgtttttggtttttaacagtttggttatgtgtgggtctctttgattttatcttattcagtttgttgagctttgatgttgatactaatgtttttcttcaaatttgggaagttttcagttctgtttcttcaaatatacattctgccccttccttcctaaacccaccccttttctccttccctcccttacttcatgtttgattttgttctgtaggtctctggctctgttcatttttctttctttacttaaattggttaatgttatttaacccattttcaggtttggtgattcttttttctgcaagctgcaatccttcgttgagcttctctagtgaatacttttatttattatattttttaactccagaatttttaaaaaattatcttttttgatattatctatttgatgaacattgttttcatacttgacagtttattagacttttctttagttctttgaacatatctaaaatagcaggtttaaagtatttgtttaatgtctgggctttctcagggactgttgcttttttcccctgtacatgggccatgcagttttgagttttttttgcaaggctcatacttttctcttgaatactagacattttaaatatttcaaataatacagtgtggcagctctggaaatcagattctcccttctctgcagggtttattgttgttgctttttgttatttgcttagttccttttcgaactaattctgtgaagttaatttttgccatatgttgtcactgaaatctctgcttggttatcttagtggtcacttgtgagtgggcctttagggactaccagacacatcaaataatgacagcagtttgagagtgaggctttgaaagcattccatgattgttctgtttttttccagttgccactaggctgctggtttttactgtgattgtgtgctgatggttttcaaggctactgtagaggtagagagatgacaatgggcaagttaaaatgcaagagctgctgtttttaccaaggctcagccccttgtcttgaatcagcattacctggattcctgcaagcttttagttaatttccagaattttaagttaagttgatttgaacagtttgtgtcagttttctccttgcttttaatgaagcagaattttctgaagtatttactccaccaatttctttgatgttctcctgtgacaagtgtttaagaatgtttttctagtcaatatatcattatctgtccatgcatatttttctaaaaccttacttttaatggctgcctggtattttaatacatggaggtactgtaatacaattttagtttcacttgtctttagaactcatcaaaaattgttacaattttttactattatgagcagtgctttgttgaatattcttttatcttaatcatgtatgattctcaagactatccatttctggaagtggaatttgttgaatttaagacaataaaaacttcagtttttggtccacatggttaaattgccctttaagtaagtggtttaagtttatattccaaaagtcatgtaggagagtgtctctttttccacatcatcacccagtactgggcactagtactcactttattatttttatttttattttgaaatggagtctcactctgtcatacaggctggagtgcagtggcacgatcttagctcactgcaacatccacctccggggttcagatgattctcctgcctcagcctcctgagtagctgcgattacaggtgcatgcctggctaatttttgtgtttttagtagagacggggtttcactatgttggcaaggctggtctcgaactcctgaccgacctcagatgatccacccgccttggcctcccaaagtgctgggattacaggcgtgagccaccacacctggcctcattttatttttttaacttttggagacagagtctcgctctgtcgcccaggctggagtgctgtagcaccatcctggctcactgcatcctctgcctcccaggttcaagcaattctcgtgcctcagcttcctgaggagctgggactacctggctaattttttgtattttagtagagacaggatttcaccatgttgcccagggtggtcttgaactcctgagctcaggcagtccacccgcctcggactcccaaagtgctaggattacaggagtgagccaccacactcagcctaatacttattttatttttttctttttttaagagatgaggttctatctagaggtgatgggagacagtgacagatcatcaggcattagattctcataaggactgcgcaacctagatcccttgaatgaacagttcacaatagggttcactctccaatgagaatctaatgctgccgctgatctgacaggtgccagagctcaggcggtaatacgagaggctggagatacagataaagcttcagttgcttgcccgccacttacctcctcttgtgcggcccagttcctaacaggccacagaccgctaccagtccatggcctggaagttggggacccctctactgggatatttataattgcatatgtggttacctaatatttccatgatacaacactggtctagattctaggccattctccttcaaaaagaaccctgcttccttacagttttactgtttagcagcaatgttttctaccccttcttaaaattttcagctaccacacccctgttttgttctaatattaaagatgacatctaacactcaatttttctttctgctccaagctccatcatcattctgggacatttttggcccatgtgtaagacactttcagtaagttagcttcagtttcttgactgtgcttgagccatccttttttttctctctctgtctcatctgagagccatccttttaatagccctatggaggaatgggtgggaagaaaaaatatttaaaagtaaaatattaaaaaaagaaataataaccctgtggggctatcatctgcaacttatgttccacttctaaaatcttaattgtatagtccattttaaccataacttacatgtatttatttattttttcgagacagagtttcgctcttgttgcccaggctggagtacaatagcgtgatcttggctcactgcaatctccacctcccaggttcaagggattctcctgcttcagcctcccaagtagctgggatttcaggcatgcatcaccacgcctggctaattttgtatttttagtagagatggggtttctctatgttggtcaggctgatcttgaactcctgacctcaggtgatctgcccgcctcagcctcccaaagtactgggattacaggcatgagccaccgtgcccagcaacttatttttttactgtcttctttacttcctgccttccatccttgatcctctccattttcattcactgaattacttcatctgtatttgtcatctctcttggtcttgtacttttgtgtacccttcctgcaaagcaagtttcaaatgactcctacagccaattttattgtactcaagttatggattgctactggaggaaaagatcacatggcttcagggatacagtcaaagatttatggtcttcagccttaaccaggtggacaaaattgcttggatggctgttacgtattcctagtctctctctctattcttatggttgctgtttcacatctttacttcttaaaatcccctacttctcttctctttttttttgggattttcaagttgttttatatctggtacttagggaaaatcctgtccttcattccataaatgttatctgtgtccttacttaactttgtctgctacttggtgttttctattagcattcacacaaatagaaccatctgcctttttttttttttaagtgcttaaaactcttgaccttgtattttctggctgctatcctgttgttcttctcttcaaagataagcattaaaaaaaattgcttatactcacctcctgtagtttttttttctgcttatttatttccagtctgccttcttcccctatctttccattgatacagctttgagagtggtttccaatgacaataagtagatttttctgtatccttagattgaccaatccagagcatttggtatagttaaccacttcttgagggggctgctacagttgacctcctttgaaatgcttctgggaactctttgattcttcttttctctcagcttttcctaggtttgtttaggtgattatgatgggatgttggtgttgcttcttggcctgcttcctactctgtatgctgtatttggattcatatccatggccttgataccatttaaatgttgattacttaagatattcattatctgtctaacctagatgtttctagcatttctaacctttatatatacaactgcctactagacattgtcttcccaaagtccaccttaactcagatgatttctacttttaacagttggtactcaccattcatcttaattgctcaagcccaaattaagaaatctgaattttatcacccttctacaagttagttacagagatctgtcatttcatgtctttaatatctaacctagcattgtccaatagcaatttgatgcaagccacatatgtaattaagctttcataataaccacatttaaaaagtaaacaggtgaaactaactttagttttatattttatgtaattgggatatctaaaattttatttcaacatgcaatcagtataaaattattaataagatatttttgattcttatactaagtctttaaaatatgatattttacacttacagcacatcttaattcagactagctacatttcgagtactcagtagccacatgtagctagtggctaccttaatggctagtagagttctaacctatatttctctttatccttactacctctatcttggttcaagcctttatttttcccctgagcagctggagcagctcttggggattactaccattttctcctccagttcatcatcaatattcttgtcagtagtaattttctaaagtatgaatgtgactctgcatgtgaattcatgtgattgtgcattcctctttgtatctttagtgttcttcctaagctttcaagatgaagtctaagttcctaagtatggccaacaaagtccttcctcatctgacttttgcttaactttcctaagctatagttccttgatcctaaaaatgagttgtattgaactgtttgtagttcctataaggaaccatacgctcttcttgcttttgggcctttgcagttaataactcaactgactgagacccatattctccagctcccaccctcatctgtcatcaaattaaggtctactagtcagtccttcagtatctaaaggatctgatcccaggataggatgaaacacccttccttgtttgctcttatatatccttctgtgctttcctgtatcagggcatttatcactgaattattttaattgtcctctagcttatctcacctccctattagattcttagcttcttgagcagggatcttgtttttattagcttttatattcctgtttactagaacacacatatatgcttggcatattgtaagtatgttgaatgaatgagtgaaggaatgaggtaagtctaggaagttaagatctgaactctaagttcagagcaaagaaaaattgatttaaattttaagttatctcattcttgtatgtatttatagagttaaatattagaatctttttaacagattaactgagaatccagaataggattaagaaaataaaagttggttctgtcagtacccagttgttcatatcagtaaaaagaggagagctgggggcatgctaaataggttatgaacctttaaaatagttgagggatgaggaacataaaaactgatatttaggacatgcctatgtaatcttgtaatattttagttttcatattatattaaatctagaatctaggcatttttagaccagttatacttaaaatatttaaaacatttaaatggcaaatgaatttctttaacttttcccttaggctgtatgagagatggtaggaatttgactaagcaagtaccagacacatatctgtgtatgatataaggcttttgttaggaatactaaggagttgagaagtaaacttctgcattaatatcttttccttttgtagtctgtggttgtttttcatatttagaattacttacactttaggagaaacatacttcgtcagtgtgtaaaacaatatgctatatatatgtatatttatatatatatatattttttaaaatccaaagggaggcagattggagttatttagaaaagatcaatggctatttttgaaatacaaagttactaatgtaaaccttggatttttgtagcttgatgtttaaactgcaaatagaatttgggtgtgttaaggtaatttgaggtgcgcattataatccctagtcattttagttttttattaaacatctcattttgtaatgatattgggaagttgaaggtttgtagttccttctagggttgtttttctcaaattctgatttttattaggcatccattctgttacaaactccccttgatcaattttttgttactaaaaagcatatttaatagttttcaaaataagttgctgctttttcctattggaaaatttttatctactggaaaatttgttgaaaattagtattcagagttttaaaaatggtaatggcattttagatagcaagatttgggtaactttggaataggaacaaatggcaagagaacgtaaagaattcttaaagaatttcagtaatctatctattagaacttgtttgaagcgtgctgttacttgaatatatttgtgctgaactaatgtaaccttagaaggaaggttagaactaagttaccggatattgtatttaagttgatttttccatcaaacagtggagttaccgtagtttgatttttcttaactatgcttttaacatacagatttaacatctaaaagattttgtaaagcatatctagcagatacgcttttagaaaagattatttgataaatgtttcttcttaaatgactaatgtttgaaatcaaggaatactttaaagacctaggggtatttttgtagaagcttgggtgaatatgcttttatttatacatacttataaatgccacaattgtatcactcacatctataaataatgttccttatcccgagatatttcacactggcactgtgaacatttgtgcaggaaaagaatcagtgggtggttaagtcttttgaattacagactatggttgattttagaatttagggtatggaaaaattcttatgagatatgacaagtctatatgttttaatcgaccagtattaaattttttattttttttgagacagagtcttgctctgtcatccaggttggagtgcagtggcgcgatctccactcactgcaacctttgcctcccaggttcaagtgattctcctgcctcagcctccagagtagctgggactacaggtgtgcgccactatgcccagctaatttatgtatttttagtagagacagggtttcaccatgttggccaggcaggtctcgaactcctgacttcaagagacctgcctgcctcggtctcccaaaatgctaggattacaggctggagccattatgcctggccaaattattagtatattttctaaatagtatttgtgctaggtagcttcagagccatatttttgtatctgataggacacttctatacgaattttgggatgatatgtttttagccaaacccatgttttatctttgtacagagtttcttcctcagaagatgttttcctgaaagagtagtcattcagatttttaaaatatctactgtgtgtcagcactttgctaagaacatagagatgaatatgacatggttctctccctctgggaaatcagtcatatgggggaactgacaaaatgtttaaaataattttattttaaaaaatatttattataataattacatgcaaataattgtctactgtaaatcatcctagttactcttctttgtcaccatgttactgagactgctcttattttttaagttaccagtgaccttatttccaaattttatcagtatgtctgtttctgtaatggtatctttctctgtagcattcagcatagttaagtgaatcctccatccctgagatgatcttggttttcttcctgtctccactgactgatctttctctgctccagggctttgcctcgacccccttcttcttttttttgagactggagtttctctcttgttgcccaggctggagtgcagtggcacgatctcagctcactgcaacctctgcctcccaggttcaagcgattcttgtgcctcagcatcccaagtagctgggactgctacaggcacatgccaccaagtccggcccatttttgtatttttagtagagatggggtttcaccatgttggccaagatgttctcgatctcctgaccttgtgatccacccgccttggtctcccaaagtgctaggattacaggcatgagccaccgtgccctgccgacctcctgtttatctatagtctgtctttgggaatccaatcctgtttcaatagtatctgcatggcgatgattcctaaatctatattttcagcaccaaccaaccatgaaatttctcactctgttgtccaggctggagtgtagtggcatgatcacagctcactgaagcctcaacctcctgggctaaagcaatcctctcgccttggcctcccaaagtttggaattacaagcatgaaccgctctggatggctgagagctatctttaaaacagtaatcaggtcacttgcctatgaaaaactctctagtgtcttcctatcatgcctaaaataacatccatatacttcctactttggctgagtcccaaatgatcaggcccctgcttgcctccctgacctcatttcctatcactcatccccttgtccactacttcacttcattatagttcatggaccttcttttttttttttttttttttttttggagacggagtctcgctctgtcatccaggcaggagtgcaatggcacgatctcggctcactgcagcttccaccccctaggcaggttcaggccattctcctgcctcagcctcccgaatggctgggattacaggcacacattgtcagtcccggctaattttttgtattttttagtagagacggggtttcaccatgttgcccaggctggtctcaaactcctgacctcaggcaatccacctgtctcggctttctttttactcttggaaataccaagttcatccccactttagggcctacccctttgcctggaatggtttcccgctttccacaattttaaaataatactgtgtgccaaagactgttcttgttgctaaggataaagcagtgaataagagacaagggcagaccctgagtcatttttgttatacctcttatctgatgagttccttcaaggtgcagtctaaaatactgtattctttgaaactactggtgcaacttgctctcagtagcttccttttttgatgtaccatttatgtaattcattcaatctctgcgttgatggagcttacattgcgggcagggtggaggtcacagtaaacaagttgggtaaaatgtgtgttggataatggcaagagctaagaagaagcatacagcaggcagcaaagtgctaaggtgaggagtggggtcgtaattttaaataaggtgattagggcaggcctttttgaaggtgacatttgagtaataaaaataatctgtggctgggctcggtggcttacgcctgtaatcccagcactttgggaggccaaggcgggtggatcatgaggtcaggagttcaagaccagcctggccaagatggtgaaaccccatctctactaaaaatacaaaaattagccgggtgtggtggcacatgcctgtaatcccagctacttgggaggctgaggcagggaattgcttgaacctcggaaagaggttgcagtgagccgagatcgcgccactgccccccagcctgggcaacacagtgaaattctgtctcaaaaaaaaaaaaactattccaaataaaaaaagcaacaagtgcaaaagccatgaagtgatagtatgcactgtatgtttggggggtagttagggattcagtgttggggaaagtgaagtgagcaaggggaggaagtgtagcaggagatgaggccagaagtaagagtagagccagatcttgctaggctttgttggctagtggctttcattggtacacattggaactacttgaggagctttaaaaaatactgatggatgggtttcgcttgcagagattaatgtaattgatctggaggtgcagctgagacattaggattttataaaagctcccccaagtgattctaagatgctgctaaggtagagaaacactgtaggccatcattgggacttcggcttttacttttgaggaagttcggaagtcattggatgattttgtcatggaataattttgtaattaactttaaaactggggttttgtttattacatttaattaccttaactataaaacggactccagttgtttgaagtgggttgtgatataactcatagatttgtatcagtataaaaatgcacacttttcacagtttggccaaggattatctattttattttctgtgcttcattagttgccttttagttttcacagttcacatatgtctcctctttccatctgtttctgcttatcatctttagcttccttccttttcctgtatctaaatgtctacatttctttaaattctggacttcagtttaattaatagaacttgaaatacagcattgtataaaaaggttttaaccaaaacatttgcatttgtctgatctgagctgtcttaatccagtgactgacaaagcaaaattgcatgaaatttacattttttttcttcttgtaatttaaaacttggttcctgtataccttcctggatctttatacttttgtatcttttctaccatttctgtaaaacctcaactgcagggtgcaataatgggccttattttctatatttcagcaggacagttgctgaaaatgggtttaaactcactggcattatatcccacacaaaaatatattactttgacatgtttagaaaaaagtctgcctttaatttctttgtaatttacctctaatttgttgagttacatgtaagtaacttttttttcccctctgtcttgctgtgtttcaatggatttgcctctcctgtttggactgaatatgtcattacaattcttggaattctttgtttactgttcctctgtggatttcttctgttggaatctggaacactggaatgatggaaatgtgttctttacaaagtagctgtgagtatactacataatttatagagtttttttcagtctcagttaacttaaatttaatttatagttggatgaaatatgagccaaggaaaccttaggtttaatgcatatttctaactccactcatagcagactttcaaatatttgacttaaaaatgttagattctgattagtctcctaattattatgtttatagttagcttttcattttaatgggcttcgtttttaaaatttggcttaagaattagttttatgaaatgaacaaaagagccaaagattatggatggaatatttagctacatgactagtaaacattgtagacttctgttctttgttaaatccaaatgtattgaattgatgttttgatcccatgattgctttttaaatgagaatttaaatgtggcagaaacttttaagagaatgtgtgcctctttttgctattttttaatgttgagataagactgcctccaaagtaaaattaaccaatgagactctgcttattcaaatagtcttaactacggacagcatttctcacccatgggtaagttagaagtcagacttatttactacaccaatttggaagtagatttctttcagttactcacgaaactattgttgaggtcatctaggaataaaaaaccaatagaaaatgaagttataagttactttaaaacctggataaacctgaagataaaggcagtaggatcatgtgaaaccttgaagtgacaaaattggacctggcataacagcttgaatgatactgtagctggttgacactgatcacaagagccttcaagagtttattttttaaaattgctttaaattcaacattttgatttcatttcatgaataagaagacaaatttcaagaatctcatgcctgtggtataattagtcagtgtgatcaaaggagataattaaaaaggattcttaatatgatatgaaggggatttgaatttttttattgtgaagaatcctttgttattttgcttttttagttggttggtcaatcatcttgttactaactactgtcaattgaaatctttgctctgaggcaggttttctaaatttttatttcattcccttggatttttataattaaccattatattgtcagtcaactcatgctcaaataattttgtccatttaagaattgatagttttattgataatgccatgaaagtagtttgatttgctgtgaataatagtataattttctaaaataggttaatgaagggaatttgaaagtgtgattgaatagtactgttgatacatgaataacttggccctttttgcttttgtcagcaacagaagaaccttgaaggctatgtgggatttgccaatctcccaaatcaagtatacagaaaatcggtgaagagaggttttgaattcacgcttatggtagtgggtaagatatgatttcttactaaaatggaactttggtttaagttttaaacgttagtcaactctgaatagatttaagaaaacactggcacagatatctacagtgatcatatctttgttgtattttctcttatgtgcatacattttaaaatttaactcagtggcataatgggatttatgtcttgcctcttattttaaggtagaaactacaagttgagaaatggtgggtgatagtgttggagtggaactctagagaagttatcttcaattcatagtgctacaaaagaaaatagcatctggtggttacttactactccaggatagttttgttttctggcttatatgctatagtggagtatcatataagcatttaacttaatgtgctctgaattttgaaaagaaaggtaggatagaggatcataataatgtagttgattacccttggaattcattaattgaatgtaagcactggaatgagtaaaatatgactctcctggttctctaattcagtctgagttttcttttgtgtgttattccatgaacacattaccctgcctatagtccatttgaaaatactgttaaggataattttgactgtaggttggtagcatcattattaaatatgaagaaacacactgtgtctttcccatctataagattagttatcttcaataacagtcttactcttaaatgactatacagtattttcacctcatataggctgactttagaacctaagttacgaatattgtatagtgtaactttgttgtatttctgttatttaagaaggtgaattgcagggtagtggattagctatccttaacaaagaaagttgagttgatgcttgactttttaggtagtatacatttttgttaactatgtttcaacatctagtatttttattttggtgctgaattaggttaattgaactagctgtgaaatactcctttattgggaggtagaatattttatctactgactgcaatattttacctgttggtcagtttttggctctttggaagttgtatacatcgtcagagttcacagttaaaacaggtacagaatatgcaaatttgatactttatagcattggttaccttgtctatgtatctcttgttgagtagaagtatggtatatctagcttgcaaactgctgctgtggagtagagatgggtctagatagagggataaaataatgcagagcataccttttcttcggtaggttggtaacatcatcattatatgaagaaacactgtatcttacctttacatatgtaatattaataatctcaagtgacaaactgtagacaaatacaattttttcacttacgggaaaacctcctaggtccattaggagaactgtaacaattaaaaaaatttcctttgactttagaatttttgtttaaagaattactttttaaactatacttagtaggataatgtctggtgatcaaggccagagagttgatttaaaatctctgtggcatttttccaaatgaaaaaaatcaaataatcatctgattttgatttttagaggaaatattcagtctctagatgtatattacttattagcttttctaattaatccctttgtgaaatgcagcttttcttttttctcttcctaatgataagacttcaactgaggccaaagaaaaataggtgttaatatccttactttcaagtgttaatatccttattctgttttcccactgagccttgaacattgtttaattaactacatttgaatagatatattgagtgcaggtattaaatattttcatctatataggtgtagtgccttatacatagtcacttactaagtatctaatcacttagtatctaatatgttgatttatttttcagattttaggctgactctaacagcatcatttgcaaatcatagaaagctgaaaccaaccttgctttaatattcttgacttaaaaactttcagctattccttatgagctaaatcctcatttttgggatctaaactcagaataaatttggctcccacattacgacagttcatttacaacttacacattgatatcaactgagaatctgtaacagattttttttttattaaactctttgtactttgttggaaaacctttaataatcttgcttcataagcaatgtttattgagtacttgcttgagtgacttatttgtatcaaagaagcatgctgtgtattcccatattttctgtcttaaaggagcttctgatttatatgacaagataaaccacatagaaatatgagtcagtagaatcatacaaaagttaagagccatagaagtttaagggtataggacagtttgcctcagttggagattattattgccttcttttgaaaagggaggcattaggacaaatttttgaaggatagaattggggccaagattgaaggagcagtcctgttggcggaaataatagccatcatttacataacttttttatgtgccaggtaatgttttcagtactttatgggcattatctgctaacttacgattcttacaacagccctatgaagtaggtattgttatcccattttggagctgaagaaactgaggcatagcgagattaggttacttgcccatggttacattgctaggagatggcagaaccaaacccagtctactgctcagttagtctgggatgttcttaaccaccatgcagaggctaatctggggatactgggtatagtgcagtgtttataagagtacatccaatatgccttgaacttagatgaattcagtgaaagagagaatgaatgagaatgagaactagagaacttaaatagtacaagtaatttttcctgttattccactggaatgagcatctggcctagagtgggtgtgaagtgggagaggtgcatttgctattctcctagtcattattagcttccacatagtttgatagtgtgaactcctcactttgctgaatgttatagtctagggacaacagggcacctaagtacaaattggtcactttttatgtgttcaaagaaacagttacctattttagtggaggaggaagataggttgttagcttgtatgtaattgtgctttatggatgatataaggaatttttcaagatttttttcacagcacactgactttaggatctgacccctaaggtgtaactttacaattaaaattaagctggaaaggtagactagccaggattttggagaccctgattgacaatttgatggggagattagaattcttgattttgaatctttaaaaatttaggcatatcaaataatgaagacatgtagatctctattcagtgaagttgtctaacctgtttggcttggaacttgactatcattagtgtgctccctaattagacttaactgtgatagagaataaatttttaattgtaatatcctgtttttactagaattcttcaaggaggcagaactcagaaaactgtagtttgctttatttaacttgaaatagtttttaaaacaggtagtattaaacctattattctgaatcctaggaagatagaatccaaaattcagtcatttctgtaatcttgaactttgcaaaatttttgtgataacagaattttaaacatttaatgatatgtcaataatgtatttgacctatgccacatgtgtttagtggcagattggcacttctatttttttttccagtgggagagagcttagaatatgttggtttggccattttttgggattcagagtttatcctaatttttttttggtatatgccttatcagagaaagtttaggagttacttagttagtgataggatatacgatgactatcctagttgtcattttcctccactgcctgttgatgtttgaattgataaaataacatctatatcagtttatcaggttatttgaaaaaattgaaagataatattggctcaaaattttgtatctaggctgttgagcattttgtggtatttttaagatatgttaattccgtgaaatgttttgagttatgattttaagatttttccttgagctctgtatttttattttgcttttattaatagaagtaacttaactgataatgacttcacaacattggggatatactaaaaaccattgaattatacactttaaaatggtgaattttatcttagaaaaagtaattcaaaaagaaagtttagaagaaaaaaatcacataattccacatgtccactattttaattttgtacattccttctagctgttaaatctgaatattctttaaagcacttaaaaaataaagttaatatatttcattgcagaaattgggaaatgcagaaaagcaaaacgaaaataaatattgtcatctgtcacctattgataataactcttaagtataggaacatttagtattcttatgtgtatctgtaatgttctatgattgccttttaaatgtgtagttaaattgtgattatcttgtgatatcgtacgttctttcataacctatctattggtcaaattgtagactttaatggcctgtataggttagatatatcattcttggtcatattgtcaggatagttaaaattgctagctagtattaatactataataacatcgttatagttatacctttgcttcaatttttatttattttcttagaataataaagctttggaagtttgaattgctgttaagattgatgcattgatttaagggttttgatacataataccaaattgctctaaaacaagttgtgtaccattttgtatgctcatcaagtgttgacagcactgtttttcctgaatactgccaacattggatattaatctgattcctaaaacgtggtatcttattttcatctgtattttattgttgctagttattttatttatttattttttgagatggagtcttgctctgttgtccaggctggagtgcagtggtgcagtgttggtccactgcaacctccacctcccaggttcaggcagttctcctgcttcagcctccctgggactacaggtgtgcaccaccacccccagctaattgtgtatttttagtagagatagggtttcaccatgttggccaggctggtcttgaacacctatattgacctcaggtgatccacttgcctcggcctcccaaagtactgggattacaggtgtgagccaccacacctggccgtcgcaagttattgtttatttatctttgatattcttttataaatggtgtgttccagtttatttttaaaaactttttttttcttaagtttaggtaggtaggtactctgagggcattattattattttgttgttggtaggcattgacatttttttccagaattttttgtgtgttgtgttttctattagcttgatttttatattatccaaacttccttccttccttccttccttccttccttccttccttccttccttccttccttccttccttccttccctccctccctccctccctccctccctccctccctccctccctccctccctccctccctcctccctccctccctccctccctccctacagggtcttgctttgtcacccaggctggagtgtagtgtcacactcttggctcactgcagtctctgcctcctgggttcaagtcatcctctcccctcagcctcccaagtagctgggactacaattgtgtgccaccgtgcccagctaattttttgtttttgtattttttttgtagaggtgatgtttcaccatgttgcccgtggctaatcttgaactcctgggctcaagcgatccatccgccttggcctcccaaagtgctaggattacaggtgtgagccattatgcccgacctcagtctttttctttgtggtttacttaatgtcttcttgcttgattcaaggttattagaagttttactacatattaaatataaagactaaatgactaattaaagactaattttttattttgaaatcttaaatccgtatggttttttgatctaagttgtgaggcaggaatctgatgtttattttttaaatggttgagtagccctaccaaaaccgtttgttacaagcttaatttttaaaagtgtatatgcttggtttgttttctttcttaccctttggtttagttcattggtcttcctatataaatactacattcttggagttataaatttccagcaattatgttgttgatttatgtaggaagattaccagagtttatgttaatttagggagataggcaaacagtaagtcaaatgattacaaactgctattttctagaaagaaataaacatggtgagacttatttggagtcatcaaggaggacctgcctttttgaaaaggatattttttcatgctaattcctgaattacatgacagttaggaaatactaaaaagagaaaaaaaggaaaataaagacttagcagcaagagataataatcattaatatatgctgtgtttatcttccatattttactttgaccactgtgtaatgtttccagctgtggctatctgatattttaccattgcttcatcatttgacatttgaatgatttgttttgtttaatctcataataatgctgcaataaaaattttacagaatggaaattttggtcaacattttaacgataatgcttaatggctatatgtgtattctaatctgagatggaatatgctataatttttgtaatttatgttatgttatgttatgttatgttatgttatgttatgttatttttgagacagagtcttgctctgttgaccaggctggagtacagtgcgctatctcggctcactgcaacctccacctcccaggttcaagcaattctctgcctcagcctccccagtagctgggattataggcgcctgccaccatcacgctcagctaatttttgtatttttagtagagatggggtttcaccatcttggccaggctggtcttgaactcctgaccttgtgatccacttgcctcggcctcccaaaatgctgggattacaggcgtgagccattgcgcctgacctgtaatttatttttttactgatggacactaggtttgtttttacccctacccttgttacaaatagcatggcaatgaagatctttaaacacacagagttttgttatatgtatgttggcagacagagggcagtatcatttttatttatttgttaataattcctgaagtaggattattagatcaaagtatttgaacattttgtggctcttggcacatactggcaaattgttcctttcttttctttcccttttcctttttctttttttaccttccctttttccccttcccccttcctccttcccccttcccccatccttcctcctccctccccctcctcctcccccttccccctcccccctttcccctccccccttcccccctttcccctccccttccccttccccttcccttttcttcttttctttttgaaacaaggtcttgttctggtgcccaagctggagcccagtggtataatcagagctccctgcagccttgagcccctggactcaagtgatcgtcccacctcagcctcccaagtacctgggactacaggcacacaccactatgcccagctaattaaaaaaataaaaataaaacaaaatttgttttgtagagatggggtctcactgtgttgcccaggctaaccttgaactcctggcctaaagcagtcctctctccttggcttcctagagtgctgggattacaggtgtgagtcatcatgcctggccagcaaaattgttttttaaaagtttatgctactaaagattatatattaagaaaaaaggaaattttttttttctgaatttgaagagatttatggtgtatttgaaggttaggctattcattccatggatgttatgactgttttagatgcttgagagggattttaaaggtacatgaatacactataatagtagaggaggaaaacagtatacacataactataccatgaatcataatgtgttaagtggcataagaaatgtgtaaaccaaatgttatggaagtttagagaaaggagactttacagctaaaaagcatgccattatcttaatcatttactaattcttgagaaaaaatggtactttttttcagtaattcgtatattcatgttttgtttgcttaattcttaatctgaattaatggcttaaatccagtgtcttaatcatggaacagtgtagttaggaaaaatacttggaaaatcagtcttacagattgcagtctattagccagatgtagcggtgtgcacctgtaatcctagctactcaggaggctgaggcaggagaattgcttgaacccgggaggcaggggttgcagtgagccgagatcgtgccactacacttcagcttgggcgacagagtgagtgagattctgtctcaaacgtaaaaaaaaaaatgtggttctgtaacaagagcactatctggattgacatatgtaagaaatgtaatcttgataatatcccagtttcatttagcagtcttttaaaaagtcatcagtgtgattttaaaaatataagcaagtcattgaattatgattcttaatctgtttttgcttctcatacatatactatcctaatatggtctttgaaaataatacaagaaactccagtgtcgaaaaacacagctatcctttcttttgacagaccgagaggcctaagataaacttcatagtatataggctgaattagttaaggatggtcatgtttgtcagacctagagaaactgttctcttggtattgaatacactcaagattgattggataggtggactgaagtaaaaatggtatcacatttgttaattttaattagctagatgttgggacagaaatatgaaggccgcatagtctgtcagtattttaaaagaactcagtactgaacggaaggcaaggacatgaagggagcacatgttagtgtaacttctttacagatagaaatgtaattctcacatagaagactcatttagtatgtagttttcatcttggcaaggaagactgctctttctttctccataatgggtaatttctaaatctttcctagtctaggtcatggaggccaaatactattgtgggtcaggtgggtccatcgttttcttaggtgactgtatcacataagtctgaaatgtaattttaaatatgagataataatatcaccttctgcttagctatgactacagtctagcaccaaaggaggtcagaatttccccctttatatttagtccatctttctgttgaaagcatttgtagattgagtgttttttgtattatgaatcgggtttagtctctcccaaggcaggaagttttcaagtattacattttttaatacacagcaggtggattttgtctgaaagatagttttatgccaggatattgtacttgtttcactattgaactacagaaccttagaattattttaaagattggaaaggtataacctgtctcccatgaaagacctttgtagtggtaaatttgccaaccttgttaattttactcaaactttgtttttgaaaaaaaaaaaaccctcattttaagtaataattttcatgtatttatatctaggtcttggggttttttggtctgttttactatataggagtatatagccatttaaagcagtggctaaggtactgaaggctgtggatcaaatttttagcagggaaggggaatgctgaatgggttcactgacttgccaaactttctgaaatataattgagatttttatcatgtctttatattctggagacagattgcatgtttagaatctcaaaaaggtcatctacctaaaatactgaaaattataggtacaaagtattttatataattagaagtgtacgtcattatttactgcacatgattactgtgctgaaaataatgtgttaattttaaattttgaaacaattctaaacaaaagttacaagtacagtacataacttttttcctaggatatttgagatggatgcttctcttttgtccccctaaatactttagtatatctctcttcctcaaggatattctgctatatagccataatataccatcaaaatcagaaagtaacaagtgtatgttatacacacacagacacacacatttatatatatatgtgtgtgtgtatgtatgtattgaaaaatataagtgcacacttaaatctccaatttcattccatcactgtaggggtcctaattttcatctctcccatatttgtattgtcctctgatggtgaaaataccattatcttccatatgtgtacttatttgatcaatccccctgtaattaatccatcacctccttcaggttcttccctttcttctctgaaaaatattagggaagaaccagagggaggtaatggattagttaattgcagggggattagtgtaattaagggggaggcagtggccctgcttacctctcttgtgctgtgatgtcttatgcaaggccattcttctcatgtggatgccccctcatcctatttaactcagacatctcatgctagtccattcgtatgctctattagaaacttttcctcattccgtaggctctaataccctaataccctgttctgggccactgtggatttctctccagcatggacacctacctctgtcagtctcacgtaatgacttttggactgaatttttaggaagaaatatggaaaagatagagctgaaataattttgaagtgttcaaaagccagtatttgactgtattatagaattaattggtatgtgaatagaatagttttttcgatgcctaaaaatgtagaaaaattagtaaaattgttattttggactgccatagaaaaaaatggtggagataaaaagctctggaaaaatttagctgggaaattaaaattatctgcatatgcctacaagtgttgcagagttataatatttacatatattttgataaagtagcatgtcccccaaatttactaacagttgaaacaaataggctgatatttagaaggaagaaagttttagactttggggcttctgtttcttgtactgcccagaaccctaagtaagcagatgataaatacaaggtaattatgcatatcaaagaatcaaatgtgaagatttgattgtgaagagttcattcttaactcaagtttttaatgatcaaaggctataaattgtttattatgttacagatggaaataattacagcaataacataaaggatgagctctttcatagcatgcttgtcctggttcagagggtaaattttaattgaatgattagtaattaagtttatgtacatcagcagtgtaagtgctaagaattactgatgaagcggatgacatgaaaatgaaaatgattacttctaccctcaaaggaatttccagggaaatgcacactactaattacatttagttgaataaaggttatagtaatgtacatttaaagtgccatgtagtcaggagtttttatttagatttatgtggtaactttattagtctgataggatcgattagaatcttgaaactagtaactcactattgtgtttaaatttggaatttacaatttattttggcaattttgtaaaattttattcatgtttttgacttatgtttttgtcacaccatgaaaataagccttctgtatttaactttatatctactttgtaaaagtgcagcagctgttacactgaaaagaatatcatacttagtccagtttaaaacttcaatttctgtcacagacaagctgtatgaccctggacagatcactttgaatctcactttccttttcacaacaaatatttacctagtcttttttttttgagacggagtctcactctgttgcccaggctagagtgcaatggcgtgatctcggctcactgcaacctccgttcccctgggttcaagcagtcttctcctgcctcagcctcccgagtagctgggactacaggcgtgcaccaccacaccaggctaatttttgtatttttagtaaagacaggatttcaccatgttggccaggctgatttccaactcctgactacaagtgatccacccaccttagctgggattacaggtatgagccattgctccaaaccttaccttgtcttttctaatccaagcattgtgttgtgattacaaaaagtaaacgaaggccaggctcattgatgtgtgtaatcccagcactttggaaggcccaggtaggaggattgcttgagcctaggggttcgagacgaccctgggcaacagagtgagaccccatttctaaaaaaatataaaaaataaaaataaaagagctgtggtagggttccttaagaacttgtgggtgtaggatggtggtagagtggagatacttacacaggaatgctgtgtactgtgagtgaccacccctgcctcacagagggcttgagataattgtgtatatgagtgtactacatatatatattatatatgtaaaatacctagtacatctgtaaattgaataaatgttaattttaaacatatttttattcgtgcattttcatgacttagttttaagatccaaaacgaggaatgaagaaaagggaaagcagggatggtagacaatgatatgcagttaataagctaaatatttgattaatccttactttgtacttctgttttggttgaactcttttgattataaacattcggggcaaatgtgtgctctttgtaattcagtatagattgctgggcaaagctgttttctggtgagagtcagatttaaaagatggttgagaatttattcttttccttcttaaaacatggtttagctgagtagcttagattcttaaaaacacaatatgactttttacctgtctattctgtgcaggtaaatatcgtgctcaagttttttatgtgatatgactatttagtctgaagggtgcacttgctttatggttgctgaatattaatgctaccccttgcaaacctttcgagtatcttgttttccctggactgtgtcaggtatttaatgttagtgataggaagactcttaggaattgattttttttaaagttaataaactttaaaaaaagttttactttgagattttggacctgattttatatatgtggatgtttgcctttgttgttgaatcaacatgaattatatatttgtttgaaatgtggttggatatttagataactcctgttttttttttgatataacagatattcagatatatggcttgaaattttcttcctataaaaactaggacttgttacaaaatggtttttgattagaaaagtaatatgaaggaagtatatggcattttaagagagaggacatcaccattgttaaattttgttatttttctgcatcttaggcatagctgtaataccatatttattttgtatactttcttcatctaatgctgtggcaagcatttctctatgtcagatttttaaaagctaattttcaatggctgaataatatttttataggtgtatcataatacgcttagcctgcctcccattgttggacctggaaggtctccctctgccaccacacacacactttttttattgttaaaatattattgcagtgtttttctctgtgtgtttcattcctagaagtaaatggcatggtaaaggatgttaactgaaaatgtcgtaccaactaatacagtttctataggtgtgtgaatgctcatatgtgtctcatccttgccaatattgagtggaaatctcttttattttcctggagaagttggttctttagcacgagggaagcatttgagagtgtcttcaggatggctcaactttgcagtgtcttcaataaataacttcccataacttcccactctgtaatttgcccacctgtattaccccacccccaagcctcagactttaggaaatggcatcaggcctgtatctggagagttcagagttctgtgaggtagagcattccttccaatgggacctagaattcctagagttgcaaaattctactgattagacccaggaggtctcaggagtccagagttgcttggagcttggctcagaattccaagggggcccataactccatgaggcccagagttcctggcttgggaacactgggaggcctgggatactgtggcttagactcaagcagaaaggtgaacacagatctttattagcagataccaaatttgacatttaaaggagatttctgagcagctgcagacctcgccaagaccatgcagattccactgactattcccatgccagtgctccagctgctcaggcttgaaggtatgtgaaataatgtcactacattagagcagtgtctctgcacacttacgggagtctgcagctgtgacacatagaagttggccgtgtccagattggtggctccgaagtgggcagccttgtgcacacagtcgtgcagtgtgaagctcacctgtcgacgcactgtagccagcatgctgcagaggtaacattcccgaagggcagctcgagcccactgctccagggattcctgcgattcttgaactatgggaccactcttggatttcaggaacctctggcttcaagggccccagcatccatcaggggcaatgccatggctgaagccatcagggcccccgggtaactggaacacaggcacaggaatagtcagtggagtctgcattgtcttggtgaggtccacagctgctcggaaatctcttttaaatgtcaaatttggtatttgctaatttggtattagaggttttacattttattttacttgcctttgattatttatttgaaatttttaaaaaagtactgttctttatttggaaattttgtacttgcaacttttttaatgtcaaaagtcttctttttgaaactttttttgcctagctttttattaagtatagtcacaccactaatgacaatttcattgttatatttcttgtgaatgttgtaacttaaaaataaatgagtacagtactcttttatttttaaagaaatatagtgagatataattcacataatcatggtatgattcaaatacttcatccctggtccttaggggatacgttttggtatatgagatttataaaaagtaagaacttaaaagaatctataggttatctaattcaaagagttaaaaactacccacttctgctttgaaagctacttcttagaaccactgtatagaacatgctacctgatgaagaataaatcaacaccttgcttcccgtcttctatccattagatatccaggtaaaataatatctgttttcctgatatttctcctttacttacactccagcatgccacgtggccagctgtaagttgccctctacttttgtagagccctttgctgtgtttctgcaaaatctactttttctgattcgtgtaactcaaaactagctctattttcttccaaattaaaactcttattttcttaattaatgctggcccaaaatagaaattagagggaaagtcttattccaggatctgaaagactaatagtattcacaagaatacttgattttttttttgagatggagtctcgctctgtcgcccaggctggagtacagtggtgtgatctcggctcactgcaagctccgcctcccgggttcacgccattctcctgcctcagcctcccgagtagctgggaccacaggcgcccaccaccatgcccagctaattttttggtttttttttagtagagacggggtttcagcatgttagccaggatggtcttgatctcctgacctcgtgatccacccatttttaaggaggaatgtgtattgaatgatcaattagaatttcaggtaatgggaagaatttagaggagcattgagggacagctcatagactgtatttaaaccgtcaatttcaactgttttcagtttagcaaaagaacttacagaaatttggtatatatcttatgaaactttgcagaccctaacctaacctaggtcaggcagtatcttttactacaaaattgggataatcattttctaaataatcatgaagaaaatgttctgagtaggcagtaaggatttctctggtaacatgatgatttaaaaatgtaattgtccacttgaactgggttgtataaagaatgcttctatttctgagtatagcaagaaagatcctaacatacctcttagcgcctcccagcctcagacgtgtagcaagtgaaagctgtttgaattggcaaatgaggtaattattgagtagctggttggaatgtttgctactagctatccagcagaattgttagttcttagtactggtgtaattacagtaattagaataagtaaacttcttttaagataattgcagggccaggttatatagagcttgtttagcttgccttttagtattagcatgtacatcagtgtgtatgttaaaggataccctaatagattttgtggaaatggaattgtcttatagtaaattccagatcaacatatgtatggaatgtatctaatgtagtctagaccagtggctcccagtttttttggcaccagggactggtttcgtggaagacaatttttctgccagggtgtgtgtgtgtgggaggggagcaggatggtttcgggatgaaactgatcatcaggcattatattcttataaggaggacgcaacctagatccctcacatgtgcagtgtgcaatagggcttgcattcctttgagaatctgatgctgccgctggtctgacaggaggcggagctctggcagtagtgttcactaccactcacctcctgctgtgtggcctggttcctaacaggccacggactgtgggttggggatgcctggtctagattgttcttcacagattaaatctttaccagattaagtttattaaaaagtaaaacaaagaatagcgccctcccttggcaaaacatcttggtgtggtatcttttcttcattttacagccagatgtaaagaaaaaataaacctctacttttaaatttcccatccagtacttaatttctcaccatttggcttctctccttaacacaaaactacttttattaaagatcagtaaaaggccttctggttgtctttttctttaacttatttggcattactgaccattttttccttgaaactcttcctcactttttgtgatattgcctcctggtttacctggttgtgttgaagcctgctttattaggatcctttcctgtggggccatctttaaatgttaatgtaatctggcatattgccctatgtcatccttatttactagaatttcttaattttctttttagggacaggacaacatgaacataagaatttcttaatttcatctacctttcaaatcatttgggaagcttcttcaaagtattcttggaaacacttgcctagatattctgggctttgggtctaggatggaatatgatcatctattttgaaatacctcctgagatgacactaatatgtattttggttaagaactatagtttgttgctgtctcacctcttaataggtttcatttgaggtgctttttaaaatgtcaagccctgtgcatttaattaataaagtaggtatcttgatcaaggtcatatacttgtaggtgattgaactaggatttgaatttgaacaaaattgatttcaaaacccaggagaaaaatgaaggaaggagttagaggaacaaggtagaaaagctccacagtgtgatcaccagctcctctcaggctttcctcttgcctctactctaacatggtaaaacattctgaaaggacttaaagattctgtttctaaaaatcctttgctttcttttctatacaattgctataaaatggtaaaagtggctccttgaatctacagatatcccagaaagttgaaatgcttattgaaatgatactccatctttcaaagcctcattgaaatgtgacctcctttccaggctggtgtgatttctcagttttctgaaattctgtcgctttggggtatctcattcatgattttgataaaattctgccttgtttgtacattgtttgcatatcttacctcttgtagcatactaagatttttaagatcaaggactacatcttatctttgcattcctcgttcatttatttgataaaaatttaatgatcacttataaaatgtcaggtactactttagtctcagaaaatctagagattaataagaaatgtatatgaagttgagatgctgagtaaaacaaagataagcgagcatctttaaagcaggacttctcagattcttttattataaatactgtgggatcccaatcccaaagacctgaagaaacctgacgttagctattataaacaaatattattgtgactttcttcaaaaccttataaacaaataggtgatgaatgttttatttttaggcttgaaatttaacattcttgagtagtgatagaatatgtggctttcatggacaagtcctcaaagataagaaggacatgggttattttaacatgcttattaggttgaagtacatgtgttgtattactgactctagttactcttgtttcttaattttcatagagtaacaccttaaattgtaaatattatgttttgttttaataaggacaaaaaaatttaaaatccagttatttccccttaaactgcagtaaaatgagggaatgataatgacattgttgcaaaacatgtataatgcatttcaaagtcagaataaatgtaaaataggcattaatttggaacattcagaaatttatttggatttattaaaatattagtttgaagaaatatgaaatgttacagatattctttttatcttgagtaatttttttcttaagccagtatatatattattctgaactctattcttaaatgttttctaaataatgcagaagtacacttgatttgggttgtttccacagatcttgtgtttaagtagagtttgatttgataggactgattatagttctctattgttttgcattaatgatactacttccttccctttagtaaagccaatgaacaaggatcaattgtagttataagtcactttgagattattagacaaggctgctatattttgtcttgtaattataggccacttgacattttggtatggaagtaaatattactctactaaatgtgagtagaaattaatattaatgttcaaactcaggcatagcctcactgctttcaacattcctttttacttattttgaggccagtaccctttagtgtcaataaattgccaaccttactcttctactttacccccctgcatccctgtttcaaatgtttattcccttcttaaggctgtctacttcacctttgacccttattcttagtagttgcactagggtcctttctttttctgtgagaaaatgtgaatagtaataaaatacatttcattgcaactacctattactgatattcaggtgtccactgtgccaaggtatgattctaatgagatcacttattcctcacaccaactctgtgttgttgtaggtactgcttttatctgcatttcataggtgagggcactgacacacagaagtatggtttgcccaaggtcacaagaaaagtttattgatggaactgagataagagatttcaaggaaattttaagctctaatggactactataacctttgcccctagacttttccaaagttacacaactactttcttacaattattggtacttttgaaaaaaaaaaatgagataacttggattaagggtatgtgatacttaaggaaacacagaaaaatttggaatacacttaatttacaccttcagggtacttcttaggaaaaatttccagggaagaataatagtattaccaaactatttttgtatttgtcaggtgctatattttactctgctaccaagtaaaaggactgctcactcattacaaaatagcttgtttttagagctcccagtcacaatgatttgagtaaggtgactttgcttatgggaaataaactattttatcaggcttatttgaatgacattttggtaacctctgtgtcacgataatagaatcattaagacaatacaataagctacaaatacctcatttatatgaggtacttgacttgagtcaatacaataacctacaaatacctcatttgtatgaggtactcgattgagtactttaggagaatattcactgaatcagtgttattcttgaaaggacgtagatctattattgtatcttgtaaaatgttcttttttccatctttctcagcctgctaaagaggttatgatttagtttcaggacagatgtggaatttgatactaggggtatcaaattaaagatttgacaagcctttaatgacaagattaaaggctgttgaacttagtttctctcttcttcctgttctaaatttttaattgctttatcctttacttttccatttgaagctcattgtggttagtgcagtaaaagcagtggccctggtgctcaagcatgtaatcccagccctttgggaggccgaggtgggaagattgcttgaatccaggcgtttgagaccagcctgggcaacatagtgagacctcatctcttaaaaaaatatttgctggatgtggtggcatgcacctgtagtctcagctactcgggaggctgaggtgggaggatcacttgagcccagcaggcagaaattgcagtaagccatgattgtgcctctcacttaaacctgcacgacagagtgagactctcctcggggctgggcgggggaagtgggtcaggacatagaggtcaagaagcatgttcctttcgcctgctcagagtctgggaagtatagtatgattaaggacatgagatttgccattcagattgagctgtagctctgctacttggtagaggtatttgtcattggcaagttactttcagaggtttcatttacttagctgtaaaattgtttaaagaatcttatgtagagttttgtaattattgaagtcattgaatgcatgtaaagtgcctagctcaatgtctttcttatagttattgaataaaaatattaagtgttattgttaatgaagatactggtaaaatatcccatgtcagatatggtccaacctggttaaccagattggaaggtagttgggaattttggcacagagtctttaatggataaatgagagtgggtatttagaaaggcagtagaacatactgcctggtgtcaaatactgattactgcttattaactctttggcactagtaagttatttcacttttgtttctgttttttcaccttaaaatggtattgataatgatgcagattgagtatccctaatccaaaaatctgaaatctcagatactccaaagtttgaaactttgagtgctgacgtgatgctcaaaggaaatgctcattgaaccagtttttggattttggattttcagattagggatgctgaactgatgagcaatgcaaatattctaaaatttgaaaaagccccaaatccaacacgcttctggtcccaagcattttggataagtgatacacaacctgtagcatctatctcatggtattataaaggttaactaagtcaatgcttgtaaaatactggcacacagaagaatttataacttactggctgtcactgtcattatttttgatgcatagtggtatcagtgctagaggatttggggattcaaattttgaaaaatgccccccaggggacatctctcaacgtctggaagcatttttggttgccacagctggggaggagggatgctaactggcttctaatgggtaaaggccagggatgctgccaagcatccttcaatgaacaaggcactcctcacaataaagaattatccaacccaaaatgtcagtagtgccaagattgagaattcctgtagtacagctgtctggagctgtagttgccagcatctgcagcaacctgtgcctgatgcctgcctctcatttactctgtagtctcttactggactcaataatcatttttctcttaacttttatcccagtactcccaatcactatatttgcaggtagcctcttctcaggcattcttgacttctttgtagtataacatattatcaacccctttaaatattaaaagttaaaattaaatattatataatttatggttcttgtagaaaaactgatatacaaagaagaaaaatttaaatgtttcataacctttcccatctagaaataaacactgttacaaagttggtatattcacttttattattaccctccccttggcttcccaaagaaagaaaagcttataaaatatacattttattttttaaaaactaaattctaaagatatttagtaaaaagcaagtttccttttttctctcacctgcatttccagtcctgtctctagaaataagcattaaattggtgcaagtcttttggcatttttttatacttttatatacaccaggcattcctacgtcaattttttttgtgtgtgtaaacagtaccatgctataagtactattctgtgaatgtgttttccctatcactgaatatactgtgtgtgtatatacactgaatattcctgtcagtatattcttagcaattatgtggtattctgtaatatctttatcatgatttatacagtcagctattaatgaagatggatgttcgtagttacaaacagtgcttaggttccttggatttctaggcacacatataaatgcttctgtaatgtacatttctgaaagtgaaatcctgggtcaaaaggcatgtagatttaaattttgatagattaccaaattattcttcagaaaagctgtagcagtttacagtttcaccaagaaccacccctgatggttgacttactttctttaggcttattttaagcatgagtttttctccaaatactttagtcagatctcttagatttttatgtgtaatactcattttgtttgtatttgagtaattttcacataggaagagttaaggagagatatctaagtaggtggatggattgtgttattttttattaatttttaatttcactacagagaattcagagaatatgatctgtaggttccagcattgatttatttttctgtgtagccttacataggattagcttatttaagtattccataggtttcaaaaatgtgtttattctctgggtagaaatttgtgtatatatatttgacaattaagcatattatttaaatcatttttattttttcagcgcttgatttatccatatccaaaagacctattagtcttttaatgtggaacttgctaacttgctgttgtttccaagtttttgccttaagtatttttaacattttgttatttatattcttctgtcatatcaaacttccatgtgtttctaatttccttaaatgaatcacagaaataatacaactacttattgagcacttaatgtgtaccaggcactgtgcttagatttcacatatattacctaatttagtcctcatagttcatactcttatactaatttgatatgtaagaaaacagaaaatgcaagtatcttgctcactgtaattatagaattataataatggaattatacagtatgtattctttttagattggcttctttcgctcaccagcgtacattggtctctgtcttttcatggtttgggagctgatttctttttggtgctgagtgatattccattttctggatataccacagtgtatttatccattcaactactgaaggacattgtggttgcttccacgtcttggcaattataaataaagctgctgcaaatacctgtgtgtaagactttgtttttaacttagctgggtaaacatcaagaagggcaattgctggatcattgccttgtgtcctcactgctcttaaagatcagatttgttcagctttttacttcttagaatggagtggcgacttccaagctccttatgtatggaaccagaaaaagcagactgagttctcaactactttttggtacccattttttctgcctccttaccctgaatgagactgggctctttgaggatcatttcccctgtggcatatagctcaagggggagcttttgtttcaccttatgagcctcaaggtggggagatggtcttggttactttccttatttctcatcgaggtttgtgttaaagctttctgtttctttgggatcttccaatttataaggaaatagaaatcactttagttcagaataaattcttctaaaagttaaatataaagttctcaattataggaaaaaataattaaggtctctttgatttggcttttctaattgaattcgattctaggggaagaagtgttttgattttcctccttccttgattctaagataagatctactctgaaacatataatcagatttgatttgagggaggtaaatagtacagtcaattacattttgattatgagacatttgtttttagaaatattgggggggcaaaattgtgtcttagaattgaggaaattgaacacttatcaatctgttaagaaagatttgctttgcccagagccaacttaaaaagaaaactacaactaacagaaataactcaagaataaatgtggagttgagaactagagaaacacattacacaggagcaatgttgaattggaatcagaaattatttttttcttggccaaatgataccctttatttgcagtgtttactttgatggagatcacccagttagtgtagctatggttcacattgtaattggtcttaaaaaaaaaggaaacctaatcatttatctttaaattgcagttttcccacacatttgataagtttttaaactttcataaccatgggtaaagtttcttgaaatacaaaacagcttggttttaatgccacttgggaattgaattagaaagctttggtccataatttcagtgttaagtagtctaggaattgatggaagttaatttattatttatgtatcccctgatatgttaaatatctcatagctgagttcagggtatacagcgtattgcttcacatagtcaatgttaagaatttaaaagataaagaaaaaatccaatgggaaaaagtattatcttaactgaaagtataattaggtatttgctaatttttaaagagtattaaaaaagcagaaaccatttagaaatttgatagtagatagtagtatgaggtgtacatactgtttagaataaagggagaaaccttcatcactgtttccaaaaaggaaagttactcaaaaaaaggggggtggggtggtggcaaatagtctagtccttaactaggaaaaccatgaaccacttttatttctttttttttgggacagagtcttgctctgtcaccctggctggagtgcagtggtgtcatctcagctcactgcagcctcttcctcctggttcaggcagttctcttgcttcagcctcctgagtagatgggattaccaggcatgtgccaccgggacagggtaatgtttttgtatttttaatagagacagggttttgccatgttgcccaggcctgtcttgaactcctgagctgaagtgatccctccgcctcggcctcccaaaattctgagattacaggcattagccaccacgcccaacccccacttttatttctgattttagtaatttgagtctctctcttttattctcaatctagtttatggtttgtcagttttgtttattcttttgaagaaccaacaattggttttgctgatttctgttctttttttgagacagagtctagctctgtcgccaggctggcgtgcagtagtgcgatcttggctcactgcaacctccgcctcccagattcaagcaattctcctgcctaagcctcctgagtagctgggattacaggcatgccctgccacgcccaactaatttttgtatttttagtagagacgtggtttcacattgttggccaggattatctcaatctcctgacctcatgatctgcccacctcagcttcccaaagtgctgggattacaggcatgagccaccgcacctggccgatttctattcttttggttttctttttcttttttttttttttttgagacagagtttcgctcttgttgcccaggctggagtgccaatgcacgatctcggctcactgcaacctccgcctcctgggttcaagcgattctcctgcctcagcctcccaagtagctgagattacaggcatgcgccaccacacccagctaattttgtatttttagtagagacggggttttaccatgttggtcaggctggtcttgaactcctgacctcaggtgatctaccctcctcagcctcccaaaatgctgggattacaggcgtgagccaccacaccctgccgtttctattcttaaaatctcttttatttatctccgctctaatctttgttttttcttgtttttgctagctttgagtttagtttgctcttctttttctagttccttatggtgtaaacataggttgtttttttaaaatcttcatttttatataagtgtttacaactataaatttccttctcagcactgctttttctgtattccgtaagtttcggcatgttgggtttttatttttattttgtctcagggtgtattctaatttcccttgtgatttctttgattcattggttgataagaatatgttgttagatttccaaatatttgtcagttttcctagtttccctccattactgatttttagttttgttttattataatgggaaaaaatgctttgtttgatttcacttctttaaaatttattaagacttgtttcttttagtcattcctgaaaaatgttttacatgtccttgagaaaagtgtgtagactgctgttgttggatgcagtgttttgtctatgtctgttagcttcagttgatttacagttttcttcatatcctgtatttccttgtttattttccgtctagttgttccgtccgttattgaaactggagtattgaagtctccaactattattatagaactgtctgtttctcccattaattctaccaatctttgcgttacataatttaaagttctgatgtttggtgtatgtttttaattgttacatcatcttggcaaagtgacccatttatcaacatttgaagtcctttgtctttgatgatagtttttgacttgagactattttgtctgatattagtgtggcttctctacctttctggttactatttgcatgaagtatctttttccaaccttttactttgaacctatgtgttttcttagatctacaatgtgtcttttacagatacgcagttgggtcatgtcattttatctattatgacattctgtgcctttaattgggagagtttaatcaatttacatataaatacttataaggaagaactaacttgccattttgttttctgtatgtcttttagctgttttgtccttcatttcttccattactgcctttgtttgtgtttacttgattttttgtagtgacacaatttgattcccttctctttttttttttggtatattttatagaaattttctttggttattatagggataatatataatatcctaaagttattacagtctcaattttttataccaatctaacttaaatcacattgaacaactacacgtccactgctctgtccctcttttatgttattgatgtcgtaaattacattattatacattatgtacctattaacacagattcatgattttttaatgcattcgcctttaaaaactcatagaaaatataaggtgaacttgcaaaccaaaattataataatactggtttttatatttgcccttgcatttacctttacgggatctttatatctttatattgctttgagttactgtctagagtccttctatttcaacctgaaggactaccttcagtatttcttgtagtacatgtgtagtgataatgaacctccctcaggttttgtttactggggaatgtctttatttctaccttgtttttaatggtcagttttgccagatacagaagttgcatttgacatttattttcttgtagcactttaaatgtatcattgcactgccttcaggcctccaaggtttctgccaaaaagttggcttatagtcttatttgaggattctgtctatgcagtgagttgcttctcttttgccactttcaagattctgtcttggcttttgacagtttgattgtaatcgtgttggtattggttgtgagtttttcttatttggagtttgttgagatccttggatttgtagattcatcagttacatcacctttgggaagttttttccttcatgtaatctctgttcatttctcttcctctgaaacatccattgagtatatattggtccaattgatttatttcataatctcttgggctctgtttaattttcttctttcttttttctttctgctcagatttgataatttctgttgtcttcagatttgctgagttttttcttttgcctactcagttctgctattgaacctatatagtgaaattttcaattattgtatttttcagctctacagtttgtttttataatttctctttattgatattctcattttgctcattattttcctgatttcccttcacttttttctttagctctttgggcatagttcagacagctgctttaaagtctgtctaataaatctaatatctgtatttcttcaggaatggtttctggaaatttttgttccttggaatgggctatgttttcctataccttgttgcatgccttgtgatgttttttgaaaactgagtatttgaaagagtcacctctcttcagttgcacactggctgtgtactactggggcatttctctgctgattagttgagcatgcccttaacgtagtgatcaccctaaggtgaaagcttaaggtcttcttttctgagcatttgtgttgcctaggcctgtgggtcgctttctcaattcctcctgtatgcatggctgcttttgaatgtcttaatttcccaaagagtctcacctggatactcagatggtctattgtatctacccactgtaatcttatgccccaaacatctattgtgtccccttgcagctttcataaatggtgcccattgcttctctcacccaatgaggtcccagttaggcaaaacaggaatcagttcttctggcagaccagagaggttaaaatgttacaagttaggtctgcactcttgccgctcatttgaagggaatgaattgggaattggtttgctgcctccttgagacccagataaactgcagaaggggtgggacaagatcacagaaaaatgtcacaaaagttttgcatattttttttcttaattgggcatttgcttcattctgtagacctttgtttttcacaggtcctgtaaggttaattcaactaatttctggttgtttttggtgtttctgtgagggaatgaggctttgagctttttagtttgccgttttgctgatgccactcaataatactttttaaattatgaaaatagcagaatcatattgaaggaagtttacagcacccagaagtataacaaactaagaaaaatcatccgtattgtactatccacagagtagccactatttacattttggtgtgttacctttcagacttctatttttcttcctctctcttttccctttgtcctctgtcatcttgttcccccactcctcaccacaaataaaaaggggtaaaaaactaaaaaaaacctctaaacacaatttattgagtacagtgttaattttttaattagcatacttttgtttttaatttcccaaaacattattgtatatactaaaattatcatttatatttccaaaaagaaatattgtagatatttctgataacatccaaatgcttgggttttattctaatctttctgctttcaaggtataagagttaagaaagaatcgagtgtggccaacccatgttactttcctgtgacttagacatttttgcatttttacatctagtaaaaattggcacgctctcagtcaaaggggtaagcccagaccacgtggaaaggatcttacctcttttgagagctaatataaaaagaattcctcctagacataaaaatattgtgacatcagttacttaggctaagcatgcctattattctaagtgaattattaacaataaatactttaactctgtgccgtgttgtcataatatggtttataatttattttaaccttaggttatatataccttgaagccatttatattttcatatacttgtaatagttactatatactagactatgtatgttagactagacatggagagtcaaaaaagagtacgtgatcagagtacaaatcatgccctagcttcccttcatgtctacctcctacctcgagtagaagcaatataaaaagtaattacctaagattttttggattctggtttgggagaagcacccttatatttaggctgatgggtggctgaattagaaagtatgttttgtgatttagaattttatacggagatgttcattgtgattaattctttgtattagcagatttttgctttttatagttgcatgatttcttgttttgatcattcattattgtctattagtaaagaaaaactttatttcactcaagcagcgacatataatccaacttggattttttaataatgacatttttctttgggaataacattactgttaaaaatgtagattattagatacattacttttaatgaatataagtggtataattagaagactgaaaagaatccctggaaacatgagtctgatttgatagctaagcaactgaggacaagatacttattctctgtagcatattttctaatgtcatttcattgtctcaccaagaagtacttgcataaggcaagtttgattatagcatctgttgaatatttaagattgcgtaaagtgggtgagtttaacagatattttcccttatttcttttaggtgaatctggattgggaaagtcgacattaatcaactcattattcctcacagatttgtattctccagagtatccaggtccttctcatagaattaaaaagactgtacaggtatggatattagtattgttaattgataagctggaataatattaatacacacaaagcacatgttgtaacttttattaggcttccttagaggtaagatgcaaatttgtccttagccagtgtatgatggtaaatatgacttcataaaatttaaaaaaaaaagtacagttcatcagaagaattatcttggctagaacttcccaaatttgtctagaggactctcctagagatgacactgtgacatagtaaccaattcccctggagttgtgctatctagtatggtagtcatttgccacatgtttaaataaattaaaattagttaaattaaaaatgcaatttctcatttgctccagatacatttcaagtgctcaacagcccatgtggcaagtggctgccattttttgcagcacgtatatgaagattttcatcattgcagaaaattgcattagatggtgtagagaaaacgtgatttatagaaaagctattgtgatttaaatatagtgttctatattagtcagtgggataataccatatcatagttgaatggcaatagcgattctgtaagactcccaaggtatatgtgatctgatttactagttctcagtctttgctatgcattccaatcctcggtatcctgttaaatttagttcttctagtaggtctgagatgggctgcaatttctacatttctaacaagatcacaggtgatgctgatgctgctggatggtagatcacactttatagagcaaggggctagattctagatatgtactttttattaaatagtacagcagcctgtagccacatgtggctattaatctttgaaatgtaggtggtctgaattgtgatgttctgcaaatataaaatataccacagatgtctaagactgagcatggaaaaaaaaatctcaataattttttatattgattgtatactgcagtgataatattttggatgtatcaggttaaataaaattgattgatttcacctttttcctattttaaaagtggctaagaaaattataaattatatgattgatatggtatttttgtttgtcagcactgctctaaactgttgattaaaaatattgttggtgagctctgcttatgtgatatataggacatgagcagagaggaggcaagtgaacagttctggctggagttggcttcattcaggcagtgatgcttttagctggatttgaagaagtggtagtgatcatcccagtgcacaggatggagggacagtctgtatattctgggcagtaactcatatatcaaactataagatgcagtttagtaactagatcccaaaggagtaattttgtgaagtgaatttcttatttctccttctcaatgtttctattttaggattttttttttttttggtaacctttatagggcttgagatttaaaattacctgcaaaattatgctctaaaaacttgttcctacatgcttatttattttgtgataaatattggaaattttaatcctaagcaagaaaatgaactttgaactttcttaatttgggtatctattaggaataccttaatttaggtatttatgaatttagatatgcaagataaaactaaccactacccaaattaatgtacagttcatttccagaaccctagtttcttctgtgtgctcactgtcattcagtattacaccccccaaagatacacaccttaactgactgctttctccatagataaatttgcctgttcttgaatgttacatacatatacttttttatatctgttttctttcagtgaagattacgtctgtattatttactcatgttgggtgtagttctttttcatcgtcatcgtatgctactccattgtgtgaatgtatcagtatatcatttattgtttattttagataagcctttgggtttcagttttttactaataggaacattcttgtgtatgtcttggtggacttaggcactcattgctgttgtgtgtgcataaagatataaaggtatttgagtctattttctttgatttctagtgaggttgaacatgtcttttgtactcattaactgttatttcatgaaagtgttttgataatattttctgtcattttattcctgatttataggagttttaaaaatctaactaataatcccctacattttagatattgcagacattttctccccaggcaagcatctgttaaagatgtgacatgccctcaatttattagaattcttacattggcctagcttcaaaataaattgtctaaacccattttaccttcctttaaaataacacttcaaaaatatcctcttctgttgtgaatatcttcccagaaactctctttatcttgaaaacaaaggggtaatggaggtaagaatatctctaggaggatttttaagacagaagcctgtgcaccactgttaaatatcttttctttaccaaaaggaagacctgtaacatttgagaaccagattgatccttactagaatcctgtagaagtcctctttcctgattgaaccatggaggtgtattcttttatatactggaaaccagttgaagatcatctaaactcttttgcccacttactcaggaaagaacatgccatattacagacagggtcagagtcattcaagaagcctgaatgtagttagaaaatgagaatgtaatctttttgatagttggctggctccttaccaagcccagtagtctagcagatgatctgcccttggaagctaataaactctcacagtagaggggagtggtcaccagtattgtatctcagtccagacatattagactggtaaacatacaatcctgagtttcagaagacaaacgtttatgaaaatggggagaaaaactgtctcctattatgtggctgaataaggagcaagatattaataaagaccatgatctcatattctcatccctgggcattatctatttataagagacttgtatcttaaaggagatattcattcacattcacagtcttggaaggaatgggaagctgtgtacactgaacagagagctgatttttagcctcctgtgtgtaaaatagcagttctgattcaagtgaagttttcagtattgatagaagctcattaagattaattcttaacctcttatcttggacctcaggaccctgagttatatctgtgcatttccagatgcgagctgacaccagtcctggaattctttataccagtgcttctcaaacttgagcgcacatcacaatcacctggaaggcttgtcgaaacacagattgctgagtccctttcttcatggtttgctatatagcaggtttgaggcagggcccaactaatttgtatttctatttagttctcagaatgtattactgccagtctgggtactacattttgagaacaactgctctgctgcaaactggttttatcctgtgtctgtcagggtgaaaggaggagagggaagtgttttaccttagttctttcagaatgtttcaagtggaatgaaatggtaccatgttacctccattttttacttatatatatatttttccaaaagattgatgaaaatgaagtgaaaaaaattgaacatttgagctctacttcatgtttcagtatcaaatatagatacccagattaacaaaattttttggaaaaatattgcttacaatgttgtatgtatgttaacagttaaccgttattttataattttgtaccatttgaaaatttttatatttatttatttatttttgagatggagccctgctctttcacccagctggagtatagtggcgcgatctcggttcactacaacctccacctccaaagttcaagtgtttctcctgcctcagcctcctgagtacctgggattataggcgtgtgccaccacgcctggctaatttttgtatttttagtagagatggggttttgccttgttggccaggctggtctcgaactcctgacctcacgtgatccgcccgcctcggcctcccaaagtgccgggattacaggcgtgagccaccacgcctggcctgcatttgaaaatttttaaatcatacttcatgtcactgaaagggtatcatctgtcttttcttgggaagaaattatcctttcttctgagattgaagtccattttaattttctcttaatgtattaagataattcttttgtgcaatgacactgttagattttttaaagttcttagttggaaactacgctgctcccctttgaaacattttattggtccatgaagtgttttttttttttctttccgagatggagtcttgctctgttgcccaggctggagtgcagtggtgtgatctcaagcttactgcaacctctgcttcctgggctcaagcaattctcctgccttagcctcccgggtagctgggattacaggcgcgtactacacctggctaatttttgtatttttagtagagatggggtttcaccatgttggccaggctggtctcgaactcccgacctcaactgatccttccacctcagcctccgaaagcgctgggattacaggtgtgagccaccgcacccagctggtccctgaagttttgtaaatcaaactctgtagatgaagtgggtgcaaaattttgaaagtgagaaaaggtgaaagcagtatgtacttctctggggtaacatacttgatagactccttgaaaaattttcacagagccctatcaggagagtctcctgttgacagctggtccagttttgatagtttttgagccattcacataacatatttgaatgcttgtcttaaactaagttttggggctacaatgatgatagacaaaaagttctcaaagatctcacaattgtgggaaaaatatggacaaacaattatgacttagtgagaaagatgcttttgtaaggtgctgtagaggtgaccttggcaaggtaaattttaatgaagtggtagcaagatggcagtgggttgagaagtgagtggtgagtcagtgaagatgggtgatggctattaaggaagggatgaaaagggatacctaggagtgagtatagaggactcagagagtggtttgatgatttccaaaagagacctgagaatggttatatcctgtggcaagtcattctctaagaaatgagagattgacgatagaggggaaatagtgtaaacggttgtcaagatgaatctaaaatggaaattaatcagttccctagaacatattgagaaattagctttaggaaaaagatatatttcacacacactgtaccatggaaggtacagtgctgattcagacagactgggaatggtctcatttttaagtggagatatgaggtacttcactgagcattgtgacagacatgggcttgggaagagcctactgggaaatgggagaggcatgagactaaggagcacataagaggaatattagcagggaaattcttgttgaggttgaaagtcatgaattttatggtataggaatagaaagatgggttaatccagagtgggatttgagttggaaagggaaagaaataaaggttttgggaaggaggttgctaatagaaaatgagaggggcaagggatttgaggtctcagtgtaaggagacagggatatgagaggtagagaggttcagaatagaaggccaagttagagttttgggatcaactttcttagtaaagtagttctgggtcttgatgagaaggaggtattctttaagcataactgttttactattggtcacttcctctttcattttcttgtggaacacgatgaaacatgtaagatgatatttgtcttttgagccagtaaataagcaaaatagatagtttttgtgtttgagctaagtggagtatctcaggccattccaatgtcttcagagttttggctgtaatgctacctcttgagcaagtgaaggtagaggtaggctcttgacagaaaattttaaccctctcttcaaaatgttatgttcttaattaaataacattttttatttaccttaataagtggcatgtaaacattaagttaggttagtttatatgacactgtataataaacattgtttgactttttttcctcagatggtaaaactgaaaactcagtatactggaactcttgtatactgtatacactcagtattagaaaatgagtaccttggatttctggaatctcagatgccaaaagaggtctcaatagatgaattatacatagatgatacatggacgatagctttagttttatttatttttcagggaaaaacagttgaaaatgcccttgattcattcttttggtattaaatgatgcagctaatcttagagaaccctgagtgatgccataaagatgttgatgtgacctgcttaaggaaagtgcgtgggaaagtggccatttggaatagatttgttagaaaagtttgaaattcttggacttcaactaatttgttttccatggatcccatgaggatacttgtaaaagcagatgataggatacagtcggatcctgtgaatggcactagtttagttgtgttttctggatctcttccatatgtcgctgacttctttgtatttgaccgtgtatggatacacagaattttgtaggccagagaagaaaagaagctttataaacattccttaaagtgtgtaaaatacaaatcttcatttgtcttagcaagtcaataagtaattaagttgttgaactgattttttttaaaaaacagggaaatatcttaaaatttaagctgttaagttaaaatgtgtaattggtatacagcatattactgaaggtagaatgggcttcgtttggtaataaaggaaccagaaatagtttgaagtaaaattgggagatgattcatgtagatttactatattgttgtatcactttctagtgtgtagtactatgttatttaaaagagtaagtaggtaaaggagtggtatgattactttggatatttctgcttcagccacagttaccatgaataaatgatctgtctttataaaggagatggaagtgaattcaagatattgagatgttagatttgactgggttgtcctttggctagaagatcaccagataaaatgtaaacctcctaaactagatgagatgataccattaaacattttttttggcccagcactttgggaggctgaaatgggaagatcgcttgaacccaggagtgaggctgcagtaagctataatctgccatgcactccagcctgagcaacagagtgagaccctgactaaaaaaaaaaaaaaaaaaaaatgtttttcctttggttctcatgatctcacactgatgaatctgattgttttctctgagttattttgcctctctcatgttattagggtaacctgataatagacatgttatcttagttgtgtggtatgtgacagtgatctcctaaatgatgtgcatcaatcattgatactgaggatgatcagaaaatattacaactgttattgatgtttacttttttaatctacagattaatgataatgcatattaatacttaatattcagattgccaatagtatatatttggtggataaatatcttttggatctgcaaaattttcacttgatagtttatatcaggatcaaagcagtttaaagaacattaaaagataagaatttggcatctcatttctctaaaagataagtcatgtgtgtccacatctcaggcaatttttttcagttttaataagttttattcctcataataaaatttttttaacagaaaactcttgattgctgtagacctctgctgtgtattcggtagtcactagccatatgtggctatttaagttaattcaaattaaataaaattaaatatcagctcctcatttgcagtagtcagatttcaaggactaagtagccacatggacaagtggaaggtggtgttcagttgctgctcataatagttgataccctaggatttggagatgcagtgtggatacacaacaattccatcatctcagaaagtgttattggatagtgtggctacagacttttcttgctcagcaatcttagtctccgcatgttagtctcttcatgcatcaggtagcatctataaaacatgccaaaaggaagtaggctatctctaaaagtgtcccaaactttttgtcttgtaaattagcttatcagcatacttggagcctctagccttaataaggacttgttatccttattaaatgtgttatcaggagaaagcctgtctttttctggaggaattattcccttttcatttgaatccgtgtttgctttatcttgggttcctgaaaactgatattttgcatttaacagcagcatatgcccaggatgaatgataatacatcttctgatacagagcttgagattacagaatgtcttaaattgttccaggaactgttgttatcatttaagtccaataatcagttagtaaggtttcaccctaccagaatacacttttttttaaaataaaaactgtctggacttttgctgattacattgtccagaatgtggagtatcacatttgagaaaaggattggatcctagccataacataaatacaagggtaatacatccatgctgagaaagattaaggaatgatagtaagtttatttgagtgagtggttggggccaaacttgatagagaatagtccaggaagacatttactgtaaatggtagattagatgttcttctctgattaattacatttgaactctgtgaattattaaatcactcaaactgcttatttgtattattagatgcacatttaagttatataagtattacatgtctttagtggtgatcactattttatcagttcctctgtctgtctttataccaagtatgagtcataaacccagtatgaatttgccaagagattggcagactatttgtatatatgcttttctttcaaataatctggatttccaatgcccgctatcatcaattctaaaggtaatgtggtagtaggtagatttagtttgctaacagtttcccagttggttttgataaactcgaacgtccctaccatcaccccttgtaggaaatcactgatgtaatgtatgatattaacatctgcaccaattactcttacaggtggaacaatccaaagttttaatcaaagaaggtggtgttcagttgctgctcacaatagttgataccccaggatttggagatgcagtggataatagtaattggtaagaagggtttgtcctcacaactttgcagtgcatttggggtactggggtggttaaactttttcttcttaacattttaaaacttctcatcttagcaaaggtcaccaaacttcaagcaacatgacttgggtttgtataccaactttgccacttatctgacaaagttgtttaacttctttgaacccatttacttttctataaaatggagataatacctatcataaaattgtttttaagacatattctaaaataacataggtaaatagaagaattctcattattgtaagaaatttaaaactgttcactttaattttattcatttgtataaattctatctcaatcctaatttaaacctgatatttagactttcagtttttctgtaagtcctaagtgaagaaaacaactatgaaattttagtctgaagtaattatcttagtattttataaataatacttttatttttgtttgaattcacattgtttttgaggtaattttctgtcaactcttaaaactcccaagttcaccatgaagtttttttattatttaaagtaatctctcatttgaaattttaaactgcatataattgttttcatattatgaagtgtgttattaatacacttattagtgcaaataatatgctaatatttagctgtgtttcgacagtaaatagtttattttctttcatttggaaagttttgaataatgaatatttattcaacataatttatatttttgaatatatagaataacttgacatatcttctactggtaaattcattttgcccatttgaaaatactgattattgtcctttaacagtcatcagttaattcatatgtagaattgcagcttgttttgtttatttgcgttctatagctggcagcctgttatcgactacattgatagtaaatttgaggactacctaaatgcagaatcacgagtgaacagacgtcagatgcctgataacagggtgcagtgttgtttatacttcattgctccttcaggacatgggtcagtaccttgatacttctgattccttttttgttgttgttgcttactgttacctttatgtgcatactttagtaatctttaagtttgtgaagtacacacaactatagccattatgaagtactaaatttcatgtagaaatgtcttagttgaaaagccattttaagtcctatataagctaacagtgattttactccttagttcttcattcataaggattttccctgcttcatgaaataaacagtgttgccaccatggtttgaggtctcaatgtggcaaatttagctttcatgttgaccactctgctactaatagaaataccaaataaagagaagcagccataccagttagacatattcaaaataaatccaaagatgctatttattataagtttcatagaaatgattatcaaaaacacttgcatgccaatgttttcttgtgccatttctttctacaataaatctatttggcttctgtttcaccttagctgtcatagacgtgttgttcaggtatcatattgtcagtactaatcttttgtttattaggacttaagacctaagaatctagacattaatctaatctgattgttctgtttgttatagttagcctgtactccctttttttgttttttgtacttctgctgtcattttgagtacatatatgtgttattgacaactgcagaattttccagttattcttcctcagtcttttcctttgggtaagtaactcagtatatataattcagccacctgatgattataactccaccatctctccaccaaaagaactgtagtagcatcaggctaaatagcattaagttatctaacactcacattacagtagtgtaaaccaattccttcaagtatacctttctcttctatttttggcttcttgctctcttttacttttttatagataggtcaatgcccattatcactctagatggataagggagccttaattatatacttatatgtttgcactgccagattgtagtggagtaaagatgtttcttcttttatgtctaatattcttttacagtactctcagtttacatgtttaaatcactaaactgactctgacttaaaaggctcaaaaaaagtaatctcaaaaatacaacatattatataaccttttatgagtatttgtgtagctacttgaatttgtatttttaagtcattctcgtttaacttgtcagggctttttcctttaagccagcagagtgaaatcttaacctgcatttaagtcaataaaacttgtcagcttataaccaattttattattttagatcttctggactctctccaagtttagtaattctcatgaagtcacattccttccatccccttggggaaaattttatttcctaaaattgcatgggaaatgagagcttttttaaaagaacaaatttttatattcaaatgatatgtagtggctttgtgccatttcttatttgtcacaaggggtaagatgtttaaaattgctatttcttatatataaaaatgtacctttgaacaatttctcagtttatttttagaaatggagcaaagttttgccctttggtacatgatattgtggattaagtgaaggaatatgacacagaattttatgtatagagttccagatatcctgctcactacagactgaaattccatgcagtctaatagatgaatcagagcgtttccgtcttgtctgggtagtccctgggttccctttttggagggatttgtttttagataattataaattggtccaacagtgtactttcagtgcctcctacctccctctaccaagtatgaactgcatgcatggctaatgtatgatttcagctattattgcttcatttgcattgttcagtattttgtaattgttattaaaataaaaaactgacttggaacatgaattttaaaatggtgttttatccttctagtattgattaccacttttagaaaaattggtgtcatccagtgagttttatacagaaggattttttctcttatacatacatacatacatacatacaaaaaaaatttgtcatttgccctgtggttgttcattatgctgtagactttgaggttaaatagtcttttctctctagtatgggtttatcttctagaaacgataaaggattttctgttgcttaaaaacaagatttaaaaactaaatttgttgatgaaaagaccagccaatataaaactaaatggacagaggaaaaaattcaaccagaatgtaatatacatgtgaactaaatgttttctgttgctgacattttgtaggcttctgaaatttaatgggacttttacaaggtttaccttttttcctaaagtttaatttttaaactgacttaaatgttctttgaccctttggttatatttaagaagttgacttccctaatttccttgttatgtttatttttaaatatctttctttctagaagttgggatattataataaatactcagcaagtattgttttgcatttaaatataaaatcttgttatttggattttaatagtttatattaaatgcccttaagatttattaaaattttggattaactgaactctgcttttttgtcactggattgataagcaggcttatatctgacataacagcttaataaggtagtggcagtttaaatttgtcatgaatatgaattgaaaaaccataacaatttagaaatctgagattgaatatttcatggcatttatatttagtgttttatataatgattaatgaaaagaagcaaaacttaaaattttttttcaaaaatggataggttcaggccagatgcaatggcttacgcctgtaatcccagcactttggggaccaaggcaggaggaccattgcttgaggccacagactaggcaacatagtgagatcccatctctacaaaaaattaaaaagttagttgaggctgggcgcagtggctcacacctgtaattctagcactttgagaggctgaggcaggtggatcacctgaggtcaggagttcaagaccagcctggccaacatggtgaaacctcgtctctactaaaaatacaaaaattagccaggcttggtggtggatgcctgtaatcccagctactcaggaggctgaggcaggagaattgcttgaacccgggaggcggagattgcagtgagccaagattgtgccactgcactccagactgagcaataagagtgaaactaaaaaaagaaaaaaaaattagctgggcctgggggtgcactctgtagtcctagctacccaggagtcaaagtggaagaattggaggctatggtgagctatgactacaccactgcactccagcctgggtgacagagcaagaccctgtcaaaaaaataaataaataaaaatggataggttcttttagttaacactagtgaggcaagaacacagtttacagataatataaacagggttattccatctacacacacttttttcgttgtgctccctattctctgaatgccagtgtcaattttcaggggatttaagacaaggagaattagaataggaggcagctatcttaattctccatgtttgctttctccccctcactgtctctgtctttctgcctgtcagccttactactacagtaaagtatatacagtaatctttgttagtaaaaaggactggactatcttattagtcttagggccctaatccccccagttttaatatatatgtttctctttctttattttaaaatgtcagtcaattcaattattagtatgtcaataaaattattaacagaatgagacctttatttcatttttctcatgtttttataaaagttaaagaataccactttagaatggtagtcctttgcaaaatatttctagtatcttcatttattcttgtgaaacattcaattttagtccacaatatattccagatttgaggacttcggttctcatttagaattactaaaggacataacgaaaatcacagcagcttactttttttgtcaacaaatatttgggcaccttcttgagtgttagataccacgctgggtgctgaggatacagataaattgagataaggccctcgctgtagagggtatttcagtgagaagatgggagaaacaaatacagatgctcctcaacttgggacagggttacctgttgaagttgaagatacgtttaatagcgtagcctacatttgggcaaaatcatctaacataaaacctattttgtaataatgtgttgaatatctcatgtaatttattgaatactgtactgaaagtaaaaagcagaatggttgtatggtttctattctatgcgtattgcttgcacactatcagaaagttgaaaaattgttaagtggaaccatagttagtgaggacccatctgtatgcaggcaggcagttatggtacagcacactaagtgttgtcagcacatagaaatatgcctagtctcaaggttagagaaggattcccagtggaaattggatcataagccagtgtcctaaaggatgaataggaattagccaggccaaggagaaggaggatgagaatggaggagggtgttccagctaaggtagtagcctgtggccagatgtcaaagtatgatgctttcaaggaattgtaagaaattcagaaaggctggcacattggaagtaggaggcgaaagaaaggccaggaatgctaagagatgaggttagcttgagaatctatgtcttcacaagctttgtgggccattctagttaaggcatctggcctttagtaagatttttggtcaggtcataactccataagatttggatttagaaagaccactctgacttcagtatggatgattcatgttatagttattcattccaaaggacttggtggcctagactaaagtaatggaaatggagatatacatacatcatgcatacacacatctatacacatactatatataggaataggattagaggaggggaggaatcctaggtttcacacttgagtaatggggaagattgtaatgccattcactgagataggaagcgtagaagagggaaaatgggggttcagatgagcttttgattttaaggagcccatggaacacccaggtagcatatccactgggtaaacacaaacctggaacttaacagtgagatatgagctgtctatgaagatttggaagtcagttgaccaattgaagataattgaaatctattgtagtcataataattgtactgaatgtagagtaagaagagaaagcctggtagggaattctaaagaatgtacttcttaagggactagcttactaagaggatcctgaaaagtatcctaaggaagaagagcttgtgagagaataagtaatggtaagcaccatgatagaagtatttagtcaccttcttgaaagtacagaggcaaactggaggcagcagccagattgtaatgaataaaagggatgttgaagattatcttgtgagcatcttgtcagagaaagatagttggtagcaagaactgaatgtggagttggaagaggactaccatttttcatttttaaaaaatcctccagcctgggcaacctggcgagacattgtgtctacaaaaaatacaaaaattaggcaggcatggtggtgtgcacctgtagtcccagctactcaggaggctgagatgggaggatctgagcctgggaggtgggttgcagtgagctgagattacaccactgcactccacccagggcaacagagtgagaccctgtcttaaaaaattaaataaaaaaaaaaaaattaaaaaccttgtaaattttgagtaataaatatagagataattctaggaaattctattaggagcctttctggtttttccaattcctctttagggccaaaaccctgtgaccagggttcaagggcaggagtcaaagccttagccactccaatgcttcttgaagtcctgttctacctaacttttgctggcctaatacatcttcagagtgtttctgataagtaagtaaagtagttacattgtatttaactagcattggggatgtgaagaatcttgttctcccaaactgatcaattcagtcaaattaaatactgtgtatttcagacttaaaccattggatattgagtttatgaagcgtttgcatgaaaaagtgaatatcatcccacttattgccaaagcagacacactcacaccagaggaatgccaacagtttaaaaaacaggtgagcaggatgtgttaacccaggtttcttataccgttctcataatttgcagtttttactatttttagtataatgtgttgcaatccattcctcttactgctttactatattgtcatttatactgtattagaaataactcttcaatcttctgcctttgtcagtttttaaatatggctgttttaagtgttctgtaataacacccccacacagacaatttctccccatactctttagaattattttcttttttcttttctcttttcttttctttttttttcttttcttttttttttttttttttttgaattattttcttagaatgaattcccaggaagtggattattctttcaaaggctatgattgtttttatgggtctttatctccccactccccattttgtcatggtgctttcccaataaaacaaatttgtacatctgtttcactgtgactttgccagcattgttatttttattttgaaaacttttttggaatgaagtggtaaccaatcatttctttgtcttttccttttattttcccgaaaggctgaacattttaaaaacaaagtcatttttttccccctttttgtaaacatctgctcaaatcctttgtctttttgaccagtagtacttggtattacccgtatttattgatatgggttctttttattctggatatttagttctctctcattttcacaatattttttctgttttctcttttgctgcttatttttgttttcagtgcactaattttgttttcagtgcactttacgggatatttatagtttaagttattgttcaaacctatgaccctaagattaagagtctcatgctgtatgactgagctagctggaaggccactaaactgtttttctagactcacgtctagttgtctcaataatattgagttacacagtcacacatatttctaatttaattgtgtttggttcgttatatattacattttatgaaatgtaaggtcaattctggaacctttctctattccagtagtccaaaggccagtagtatattgtttaaaccacagcagctttatataatatttaaaagtagattgtaattatctctattgtccatatagtcctattgtaacaaaatactttgtttttcacctttttcaatatgaatttcagaataccttgaaacctgttataaaaagcctgttaaaatttgctttgaagttgtgctaaattcatactaattttcagaaagttttagtacattgtttttactgtatctagtatttttgtgttttacacttacccattcccatttttgttttgtaatgtgctatttctaagtttcaaacactatcatataatacatttctttttgtttattatgtgtttcgatttggatttttactgataaaggtaaaaaagatgaatatgaagtgacctcttctttcaaattggtcacatcctggtggttgtactcaggtcattttaatatacaacctctgactaaaaccattgcttttagagctagctactattactcatttttctcgtcatcatgtatttgtcaattccttgtttattctttttttttttttaaatataggtacgtaccctaattgtaaaagaagtgtggtcctattttttttcagtgacaattttacttctgtttacttctgtctactatagtaaccatgtaacacaatttgttcagggtccttttatagctgctgggaacctttgccaagaaagttgcaccaaaatataagtatagacagggaagctaggtttaggtatattagccattggtttgttatgggttcaaataaggataggtagttgaaaattatttggatgtctgtattctgtttagaattggagtgattttgaacatgataatttaatttgaactaggtcatttctgatgttaataataagttgtcttctctaggtttctgcattctccttattaattcttgagcttcttaatttctaggatgtgttttctccctgtgtccttccctaatcttacacctgttgctcctcaatttgtgtgtatgcacatgtacatgtaaggatttttctgatgaatgttcagggagcagtgctgtacttagttttaccttacttttgccagattctactaaaaattttacgtgagtttagccctgtttattcaactaaataagatacttgggaatttatatctaaaggaagaatctcagtcattgtaaataaatgacctaaagtcattattgtggaaatcaatcagagaaatccctttctggagttttacatcctttttggaactcttttggtatgacagctatatgactttaacacttcggaagtaattggatttggtgtttatatatcaacttcatagttaaaaaaaaaaaaaagactagcgtagtactttaattttagattacaactttgcatcattaaaaaacagtaaaggatctggaaccaaggacccatataggaatcgaagaggcatgtaatgaacataagactaatatactaattatgtatggtgctcttttgctgactacttcttccattttagataatgaaagaaatccaagaacataaaattaaaatatacgaatttccagaaacagatgatgaagaagaaaataaacttgttaaaaagataaaggtaggttcatccctgtacacacgctaaagtaatctgaggccttaaaaacatactacagcgtccacaggaaagatcaaaagtatcagtgttttaagtagttggcttacaaaatacctagggagatttaatgttgaattcaactttatagttaactttgaagattagctagtatatataataaggaattgtataaactactgaggtgaataacacaattcttatttcaaagtgtttttaattaactggctttcatattatgtaatttttttctcttaaaaaacaagtgatgagaaaggagagaattcgttctgttatgttttaattgccagacaaaaatgtatttattttgtctctataaaagccaaccaaaattacagctagataggaggagtaagttctagcgttctgtagcattgtagggtggctgtagttaacagtaatttagtctatattttcagatagctagaagaggattatgaatgttcccaatacagaaaaataagtttgaattgataaatatgctaattaccctaattcaatcattacatatttgtataaagttatcagaataccatactgtaccccacaaatgtgtacaattatgtttcaattaaaaacaataaaaaccaaccaaaaattcacatcaacatattttctgtattttatcatggttttctatgtactttggccctaaaaatggtatactgaataatggcattatgtaggcaaatatcttggaataatgaaattcttatacattgcctgtgaagaatttctgcagttgtaaatagctgcttaggtatttctgggagccacagaattgtgaagggctgaacatggatgaacacaaatccagtcaccaggatttgaatttccaaagttagagcttaacaaatatactattacctggtttaggtactgttatagttggtttgtgatcaagtaggcaagctagtcattagccccccgctttttttcccccaaatgccaatatagtttttaccttttatccccccccaggtatgggacaactttctgtagtgatttttagtaaataatttgaccagtatatgcttgaatattcttaacattaaagagaaaatttaattttatttattgtttaccttggtggcaataccatgtgatggcagtttactaaatatttgttaaatggcctataaaaactaatgcagaaactatcgaaagtaaattttttttttttttggctaacctgttgagtaatgtaactttttttatttttgaatttgtgaggactacagagatgtatttgaacaagaatactttgttttataggaccgtttacctcttgctgtggtaggtagtaatactatcattgaagttaatggcaaaagggtcagaggaaggcagtatccttggggtgttgctgaaggtaagattttcttcagtgaatgactttctaaaatatctcaaaactgattaaaaatttgtatttatagtaagtagtacagtatgcacactgtattgatatagtctagattttcaaggataatactgatttcaggttcttgtagtctcaattttctctttaagtacattggtatttttcaaacctgtatcctaccaagtcaggcaagtgtgtgttaagtcctaaagttgtagtataggttgaacattcttaaagagaaaattcaaaatgtgaattgctccaaaataaaacgttttgagcactgacatgctgctcaaaggaagcgctcactggagcattctgaattttggatttttggattaaggatgctcgaccagtaagtatagcacagatattccaaaattccaaaaaaattcaaaacacttctggtcccaagcatttcaaataagagatactcaacttgccccaccctggctggcatcctgcctcatcattaagtctatttctgttttcatatttgaaaacataactaaaattgaggggttctttacctggggcccaaagtttgctcccagggaatctaatgaaccacctggaatcaaacatttggagagaaggccagtcacttttatcggaacgtcagatggtcatggaccctcaagaatgattgaagaaatttgtaagcccagttaaaacatccacagtcttctttcctcagtgcaaaagttgccctttttgatatctcatatttagagtaaaaaaatttcgttaataagagatcctctttactagttttgtaaggagttttttgttttcttttttaacctgctatcttaaattattaagggttaagtaaggagttttaaataccaataaaatcttagttataacaccaagcctcagaagtacttcctcttggcaataggtttattgtattggtttaatctgatacttaatcttctgtattatagtaagctgaaaccaaaattgagatttgattgttttatctgtttgttgctattatttttgaacttcgtttttttttttaagagacaaggtcttgctatgttgcccaactggcctcagaatcctgagctcaaagtgatcctcccacatcatgctcctcccacatcacgtcactataagcacacaccactgcccctggtttattttgaacaattctttaatttttaggatattgtttcaggtaactgtccttattggcaattttcccatcagtgacctgtgtaccttgttcccagctctctctatcatgcccaggcaacttttacttgctgagctggggctttagaacttaccccttaaaaatacgcaccggagaaattgatttgcatctctcttttgtagtttacccctctactcccaagtaatattcctatttgtgatacattctttaaaaataaaagtaaagaacctgaaagttcttggctccctttttcattttggttaccttaagattttttctaaagtgattctcccttcactcacaccactgaattttttaaatgtattatagaataaatatattttttaccaataataagatttcccctttcagaatttcaaagttgtttctggagagttcatttgttaggtttacatatctatttctgaggattaaactacaataaggcaataatagagtacacttctctgtcatgccctcacattgagtgtactatgttagtgttaaatctcaaaaaaattgatctgttttgcatttcctcttcttgtttttacaccccaagttcctgtgaaatattttttgaaaagactaggtttagtggaaatataacatatgcggtctgcttttttcttacagttgaaaatggtgaacattgtgattttacaatcctaagaaatatgttgataaggtaagtgcaagcaatgatggaaatagcataagattttctttccctaagtaagagttggacagatttactttttgccttctataaatgtagctaatttaaatttatatcttcagtctagccatgaagtaaacactacatatagatgattctttctccaaggttttgaagtcatgagcaaaagttgcaaagtaatttgtctagggatacataggaaaattagtctctttatcattatactttgtgtcgagatttaatactgaaataactatggaaagtgaagtagaagaggctcttttttcttaatgtgaaaaccttgtgaaaactatataagagaaggctagtttttgagtccaaagctagaatttgaatgttaaaaggtgcacagcctggtagctggtgagtagggcacattttatgtactggaacatagtgaataaaaccagtattcctaccaggtgagaaatccctaaattgtgtcttacacacctgctgaaagagaaggaaagcctatgggagcaggacatcgaggccatcctgattagaggaccaggactgtaaagaggatctcttactaatgaattagaaaagcagcagcagagaggaaatcatgaagaaaaagtgtaataggactagagatgttagtagacaaggaacagaaagggcatcaaaatgatcctcagtattttcatgttgagacacattcattcccctccctacctgactccgcatttcccacttttctctcttgcttctctacacctttaccacatactctctttaaccttcagttttagatgtctgtctttagttgatatctattaattttcatacctctacccactttcccaaaacataagaatctcttttgctgtgtaaagaaaggtagttacataaatatggataatagttggaaatcatggaataacaagaggtcattctcaaggtgagaagtgagggggaaaatttaagacagtcaaactgctacctcaagaaatacaatagaggtgagagtgaattttgaaattaaataaatggcatgtaattgatctttattttcaaaggagcaggtgttcttggtaggaactacatgataggtttaattcagcagttgaggttgccaggcctcacttagtggagaagagcaaaagcacgagaaggtcatcttctgggttttgagaatacaacacttcaggctctattatgaaccattcccttcctcttccattcttaaggtgtgacttcaaaagaatacatattaataatataatctgctatgacagtatataagtagagaatgtttaataaatactaatttaccattgcattcctcttgtttttaaatcttctatggtacttgcctagtgcttgacacaatggcattctataactttttcttgtgtattttaaaagtatacaatcaataatttcctacatacctaaaacactgtagaggggaaagctagttactgagccagaggctactttgttgagatggagtctcactttcttgcccaggctggagtgcagtggcacgatcttggctcgctgcagcctccacccaggttcaagtaattctcctgcctcagcttcctgagtagctgggattataggcatgcaccactacacctgactaatttttgtatttttagtagagacagggtttcaccgtgttggccaggctggtctcaaactcctgacctcaagtaaaccacctgcctcagcctcccacagtgctgggattacgggcttgagccaccacacccacccagcccagaggctactttgaatattcgaaggttcacagcctggcggctagtgagggacctccctagtataagcattacagagcaaattgaccatgcctgcaggaagatttaatacagcagagcagcaagacttttatgcctaaaaattctaaagttattattaaaaagatgtgtatttaatttagctcatgtctttaagacaaagccatctagtggatatttaataaatacttgaaggaaggaaataaaataccaataccaatattacagatgtctgtaaatcccaaataattgaaatcttgcaggtcaaaggaatagtgattgcttctaagaaagaggcaagttcaaagaagttctcttgctaattaagagaactaacttactccaggcaaaccaaggaagacgatggaaaggaggaaaactatacaaatattttcagggtgtggatatgggtgtttcagaaatcaaatggggaaagaaaacaaaaggagaacagaaagagttacgatatcagcaatgggaaatggaagagacaaattcctgaaactgtggggaaactattgctaattaacaaattattttgagaatggaggagtgggttgaatcataaaatgataaagtatatttaaatggaaataaagactttcataacctgaaaaaatcagaattatgtagtcgtatagaagactttagtgattttagtgaaaagaaaaattattcattatctaaaatattagatgacactaacaaaaataacttaacaattagtaaattcaccttacttttatcttacacattcatgcaaacatttcatgtaagttttcttccttaggacctttaacgatttttcagtgatgcagtgatgatatgtaatatataataaataaaatcaggccaggtgcagtggttcacacctgtaatcccagcattttggcaggcgaaggtgggagaattgcttgagctcaggagttcaagactggcctgggcaacatggtgaaacctcgtccctactaaaaatacaagaaatagtcgggcgtggtggtgcatgcctgtagtcccagctactcaggaggctgaggtgggaggatggtttgagcctgaaaggcagagattgtagtgagctgagatcgtaccactgcattccatccagcctgggcaacagagcgagaccctgtatcaaaaaaaaaaaaaaaaaaaaaacggaaaagaaaaattaaataaacattgttttatattggcataggtatttgttatttttctccacttagagaaactggttccaaaaagtgtttatcatatctcagcttcaatcttgagttatgaattctgttaaaattcctatcatctgctatctgcattgggatgcaaaaggtaatggcatgttccttgtaaaggggatcttacagttgaagagatatgatgtcacctgtgacgtatacttgtaccaaaaatgaatgacaaccaaggaggaaatggtcatggttggaatgctttgatgtcaaggctgggaaaaaggtttccaaagcaattaagtctttgacgagagattgacaaattagcatgaactgttcagtgtcagccgccagatatgccaggagtagggagctgcctgacttgcctgaagtggagtggtagaacttcagaagtaactattgtggctataagagaacgtgaatttattgagggacagagtctgggagatgagatttttggaaaaaccagacttaggactaaggggagtcaactatcagagaattgcatggaaatgtcagtacgaaatgaatcagagtaattgaatatcacattttgttcccaaagggggagattcaagaagctggattgtgaagtaacagtaaaggttctctggttgtaaggaatgataaaaacagtacaacaatacactttttttttctttttaagacggtctcttgctcatgtactcaggatggagtgcaatgcgtgatcttggctcactgcaacctccacttcctgggttcaagcgattctcctgcctcagcctcccaagtagctgggattataggtgcttgccaccacgcccaactgatttttgtatttttagtagagatggggttccaccatgttggccaggctggtctcgaacccctgagctcaggcaatctgcccgccccggcctctcaaagtgttgggattacaggtgtgagccagcgtgcccagccaacaatacacctttgtgtttgtctcccagaagggagttttagtaaagtggtgaagatgaatgatggcagatataggaagtttgagatagaatggatgatgagaagagagaggactgacaatacggtattgccacaccatgtatatccaagaacactacattggtaaaggatatccatagagcagctaaggatatcttcagtgtcttgaattattaaataatgatgacatcatctcatatgtattgtagacttatatatattgattttatatatgatagaaatgctgtaagcaaaaatttgtttaaccgaaataccactttcactagacagtttgaagaaacagaaaattactctaaaatttccttgtttgaaaacaacttgatatgtgatctgaaatttattattatgtattaataaaaactcatatattaccttagtaatattgctaaaaggcagtgtcttttagattttatgagcttcagtagtggccaatctgcactctgttgtctagtatttaaatagataatataaagatgaatactctttcatagaaaggtcatccttcagtaactgtttttggggatttataggtcttaaaatgtcactggaatctaaatttggtgtcaagttagcttattttttgttggtttactttgagtgtaaatgaaaacagatgaatgccaccttccttaacaatagtcttttgttcattttaaatctgaaatttttgttttggtaaaattttgaattcatattaaaactttttaagcttttttccccctagctattaatagaagcaaactcttgctgtttgtttatgacagaacacacatgcaggacttgaaagatgttactaataatgtccactatgagaactacagaagcagaaaacttgcagctgtgacttataatggagttgataacaacaagaataaagggcagctgactaagtaagtatatatttttttctccaaaaaggtattatttctgtagtcaataatcatattgtttcattttcattaaatttcttctggctactcagtagaaaatttggataatgttctttatgcacagcagcataaatttatattgttatgctttgttaatagtagaagcttttttgaatgaaccattttgatagttttcacttacaaattatgtggaaacaaaggacaggctttaacaaaaggaatatttagatgaatttgttcttggttaccttctctattcctattccagggagtaaattagctggagtttcgttttcttcttttggttgttagagtggtgtaagtgactaccaagtgtgtagctttgccctgttgagcttatatctcaagctgtggtggtttcatgttgggttcgaaaaaagagatgtgtgaggaagctggtaaccatgtctgtgccctactttttaaaaatctgtcattattgaaaatcataattacatcatatgtcacttaacagtggggatacatttctgagaaatgtgtcattgggctattttgtcattttgtaaacatcatagagtatctacacaaacctagatggtagagccttctacacacctaggttatgtggtctagctattccttgcaggctataaacctatacagcatgttactgtactgaatgttatagacagttgtaacataatgtcaagtatttgtgtatctaaacatagaaaaggtgcagtaaaaatacagtgtaaaagattaaaaatggtatatctgtatagggcacttggtttgaatggagtttgcaggactggagattgattgctctggatgagtcagtgagtgtgcagtgagtgaacgtgaagacctaggacattactgtacactactgtggactttatgaacactgtacacttaggctatactaaatttattttttaaatttctcttcaataatcttactttgctgtaactttattttataataacttaaattttaaaaaactttttggttcttttgtagtaacacttagcttaaaacacaaacacattgaacagatgtagaaagatattatctttataatctttataagcttttttctattttaaaagttctttcttttttcatttatacctttttttgttgttgttaaaaacaaagacataaacttacacattagcctaggcctactcagggtcaagatcatcaagatgccactgggcagtaggaatctatgggccaccatcatatatgccatcccttgtttactgaaatgtcattatgcagtacatagctatattgcaaaaccattttaaataatgtgcatttgtagctaggtgttatctacaattagacgataatcctgaaggatcaactatataaatacgaaagacaagttctcaaaatagctatagtattttccatagtggttaacatgccttataatggaatagaaaaatgtcccttcttaaatatttaaaatacaagattctgtttgaggtaagcctcaatatgtgaacaaaaggaaggctttttatctcttttgagcaaaatgtttattgagtaactttggcacaaaaatgtaaggacccatcatagtgaatattgttcataaaatcctaattcactttaaacttatcattaacgatgcactttttaactcattaaaagaaacgcatacacaaagctactgataattttgtatgttaaagtactagtacatattttttgttaaatatatgtacttattcaatatattttttaaaacatttgttaagttgtagataaaaggaattatttatttgttcccatgtctcaaatataaggctttttaaagtagtgctgttggatgcaggtaagataattcatggaaaaatagaaaactttacagtatcattaagtttctttctgcatatacaaaattctactgtgtggatacatgagttaaactatatcccaggtgaaaacataattagtagaattctactggaaatatatctcttaaagagaggaatcatgaccatactttgcctatgcaaataaaaaaagaaatgtttgcattgctaaaaagcaaattggcccaggagctagcataatattttattttatgttaataataaataggaattagactgttactacttcattgaataacgcatactgaacctgaaagaaatcgcttagaagttttatctattagttgtatctgacattgtcttgaaaatgttagcaatttcaaaaaatatttttgttaaatttttctttaaaagtcattaacaacttatggtgctttagctgatgtaaggtgcttttcctcatagctcagtacatatccatgaataactgaaaagaaagactaatgtttaaataagtgaagtaggtgtgagtttaggcttcttttaatgttctttttgtattgctctcatgtgactctatagcaacgtattctttgacagtggtagtggggaggggttgagagttgcaagaattttggaatggaaggtgaacctattgaaaatttatagttaaattgatctttggcaatgtatgtttcacaaagtgctaatcacactttggttttagaatataagctaaactttttaaagatgttagacattgaatagtaaaatacattcatgtgccacataatgatgtttcagtcaatgaccgactgcatatacaagatcccataatatcgtgtgtctataccatagagcctaagtgtgtagtaggttatactatctaaggttgtgtaagtacactatgttgttgaaccgatgacaagtgaatttctcagaatgtatccccgttgttaagcagtgcatgactgtgaatcaatttatcttatatttaattttctgaggtagttttgggcacactgtagagtctattgaaacatgaagtaaacattaaaaatacatgtgtagatgtctgaaaatgtgcctttctgttacgtcaatagccctagaacaattctatttcagagggacttaaaacaagaaatagattgtgtggtttaaatctgaagaatagctgaacttgtccagtcagctataatttgtctcaaggttagatctggagaagtggatgctgttcttagcagctatccagtaattacctgtttctgacaaagtatggagccatccaagtacttcttgcatccctgtatggagggtaatgggtggttgaaagccacagaaagggtaacctctcaaatcaaagaaaattcagcaagggtttgtaaaggaaaggggagaagagttggtcatatgcagattgctgatctcttaaaggaagtgtgatccccaataagaggagggccgtctttttttttttttttttctaaacttccttcttgaagttttgtctgcctcctttttccttgatcttccttgtaccctttacttaaaatcacattttattggtgactctttttcagaactgatgtctatcattggtaccaattgtgacaatagataccttgctccaagttggggcacacccttgtctctctttcccttatgttaatttatttttctgttctctatagccttctccatcagtcatcttgggaaaactttataagtgaatgactaaaaatacaagtttcaaaggcagattctcagaattcttgatacatgacagagttttcattgatctaaatagaaataaagacaatttgctgaaaatttcaagttgtttcaaaaaattaaacttagttatatcttttactctttattcaagtgtcctttcatgaaattataatgatagtagttggaagttttgtttatgtttggttttaatactctcacatggcaaaacaaaatgttggcaaccattattactcaaaatttttagaaatttttattgaactttgaaattatttaagtgaaattcctttggaaaattttgcacatagtgacctactaaccactggagcaaaagtatgtaaatctacttgcttaatttgttctttaggaaagaccacacacataatttaaatgaaacatgattgtcttttattatactccaaatgtgggtcatatgtaatgcagcaaagtagaacttgactaggtcatccttatgtggcatggtggctataattctcttattggtcacatgaagggatgtggcttgcaggaattttaaccttataaagacaaccctagaaggagctaaatcattgggggtttagtttcatattccggttatgttgtaatcattttctttttcttgttttactaggctttcttcatttctttgtctgggtttttaatttcactgataggtttataagctttactactatatgggggtgggtaagagtttcctattaaaaagcaggcaggcaataatacaacttaaatggtttttccagccatttaataaaaggttttacttggaaaaaaatagtaaatgtgaagataaaaagtgatctccctacattttctacattataagcacaattttttgtttcgattttctaaaaataaagatgactagaagtgaggtgttaatataaaaattaaaaatttgaaagatcatttttactggtgagagacttcaataattcattttaaatatgcatgaacattttttcacagtatttgagtatatttggtcagattatttttacaagactaaaaaacttacagtatcttaactgttaaataattgcaaatttcttttagaaacacacatttgcaggtttaaaactttcaagactttcagaagataattgcacagcatatttatttttatagtgatttagtgtaatgattatgaacataatttgggaaataaattagctttagcgaattttactgtaaattttttatttagggcacataccttaataatttgtgaaagctatgcatttgcctttaattgcagcttttagcatgctttactttaaatgtgccaaatcactaattttttttcctttaggtatgatacagttgaaggcatgtaaggcaggggattttaaatacttaaattttgaatttaaatgaagatatttttttcttcgagatggactcctgctctgtcagccaggctggagtacagtggcacgatcttggctcactgcaacctctgcctcctgggttcaagcaattctcctgtctcagcctcccaagtagctggaattacaggcgtgtgccaccacgcccggctaatttttgtatttttagtaaagatggagtttcaccatgttggccacgctggtttcaaactcgtgactttgtgatctgcctgccttggcctcccaaactgctagcattacaggtgtgaaccaccgtgcccggcttaaaagatttgaaacatcattgcatgttttatccgcagtctcttattttcccccctagagttatttaaataataatttaggtggcaaaaatacttgctctttcccaaggataagataaacattttatagatgagttgtataagtaggaatagatatttctctctgatttctaatttaatatatttacaatcataattgttggaagttgcttaaatacacattcagttacttaaggttagcaatcacaaaattgtttttagattgtttcttttttagagactaaaaaagatttttggggtgttaggggacagtgggaattatagactctttgaaaatctaacaaaagctttggaccctttcaccggaagaatcctggcaaacacaaacacacatttggtatgctgtttcagggcagtcattgacactgtgtgtgctcaagagatcagaggcaactgtattaaaaacacctgccattaatatgaggagtatattattaagaagcatctcaacttttaacaaaaaaagatgatatttacacttgaaaatgtttttcagctgactccacttttaaaatgcaggttcttgttctaagttaatatgtctggttagtttcattttcagaacttttgattcattgtttaattggaaaaatatatgtcaggttagcatgtagaagttttcttttagtgaagaaatatccttgatttaaacaacattttattctaatttacgcaattgcgaaaacagatcatcttaattcatagcattatatcacatctttgttcttgcctttttgttaagaaaaactggtagccaatattctgtcctttttgttttgtttctaacattttctatctagctcttttgcctgcttccctgttagaaaagaaaattgctgtgatggtcagaaatatttagcctaataaggagaaaagtcaccataataagagtgtgtcaaatcagggttaaaatgactagccttaaagttacgggtgaaatccaaggtctggttttcgtttttaagccatgagttaattttttaaaaaaaattagcgtattacagtaaaatttacccatttaaaatataaacctcaatcaatggtcaaagcctgtttttatggaggcaaaacaagcatgctttattaacaaagccaaagaaggacctatctctttagtttgtcccagggtattgaataattttcagagattctcaaagcaaagagcccacttcctgctcctgggctgaaagcactaggtactttggcattctcttgtgtctctgtgtaagtatattagccttaacataaagcccacctgtaaatatatctcagtgtgaaaattttgaacacaattctacaaagagatttgagtccatggacttcaacgtcaacagagtgaacatttttttttttaatttaactatgcttatgtctatttttttggcatttaaaaataattattaacaaaatatttgcttctgattatctctgaagtatgtgtgtgtgttttaaatcactgaacatctttaaaacttaagacagtgaaatatttgagttaagtagaatgaattttcaagagcattgaagttatcataaggggcctagaaatattctgtatgcctaaatagtgctctaggtattgactagtagttgtttccaacgtatcagttcagttaccaaaataaataataatttttgtgttgttagtagctgtcttggaagagattgtaacacttgaaattctggtaaaactaaaaatattctacatatgttaacttcattactcattttctatttttcatggtaaaatgttgtttgaagaacaaaattaaattattttcttctaatgtttcattctgtgaatgtattttgggaatttttttcccattttccttctacagtttatttggtatgtcatccttaggtttgatatgcagtaggtttagagaacatctttgttttttagatttttttcataaataatcaagttttatatatgaaatatggaaagaagttctaggttataaatatattaatagtgacatatagcatctgatttgttttcatcagctgtttcatagttctgtattataatttttattcacagacatttaatgattacccttaatattcgtgacaggagccctctggcacaaatggaagaagaaagaagggagcatgtagctaaaatgaagaagatggagatggagatggagcaggtgtttgagatgaaggtcaaagaaaaagttcaaaaactgaaggactctgaagctgaggtaatcagtctaatatcccatctcttagcagacattgtgttcctttttaagtagtatcttcagtaaaatttatagataatataacctttttatacatattttttcaaaattaataccctagtgtaacaaaacggataaatttctagaagcaagcaccgtgtttataataaaataatacatacttcaatatgcaagtgcttggacgtagtatattaggtaggacagtgtaatagaatacttataatgaattattagttataatgaacaagtttgagttgtgaaaaataaaattacaaaccattccatacaggtggcataagaacactaaagatgagagtttgggggtggatttatgcacacaaactgtgttaggataataataattgaccatatttatttgtgtatgagtgaaaaagagggaaataacctttattgaactaaagacatgcctggataaattccacacaattaaagaagagaaaattagggaatgtgatatttttgttaacaggttaggccttctttatttataatgtagtgtcaaggtagttcctggtgttacaacattgggcagggtaatgacaaaacatcccagaagacatacctactatcttgaaacccttctagatgttgagttatacatttagtttctattaatcaaaaagaccttggagacatttccttcaataggtggcaagaaagaaaagttggagaaaaagataaactgaacattaaaaatccatagagcagttagtttgatagatgtctgagaatagtagaaaaaaaactatgggtaatcccaaaataacagtggtttcagtatgaagttttcttcacataaatttgttataattaaaaattataaaatagcctgggcatggtggctcatgcctgtaacgccagcactttgggaggctgaggcacacagatcacttgagttcagaagttcgagactagcctggccaacatggtgaaacctcatctctattaaaaatacaaaaattagctggatgtggtggtgagtgcctgtaatcccagctacttgggaggctgaggctggagaatcgcttgaacctgggaggcggaggttgcactgaactgagatcacgtcactgcactcccgcctgggcgacagatcaagactttgcctcaaaaaacaaacagacaaacaaaaagccctataaaataataaattattttaaaatatgtgagatgaggtccaggtgtggtggctcacatctgtaatcccagcagtttgggaggccaaagaagaaggattgcttgagtccaggagtttgagaccagcctgggcaacatggcaagacccaatccctataaaaaatttttaaaaatagttgggcatgatggcctgcacctatggtcccaactactcaggaggctgagacaggaagattacttgagcctgggagatagaggctgtagtgagccatgattgtgccactgcatcccagcctgggtgacagagctagaccttgtctcaaaattatatacatatatatatatggatgacagtaatataaaatagttttaaaacaatctttaatgataaaatttagtaagatccctgttttatgtggcttcactaatatttgtatctaagtgtatgaagaagagattcagatctctcgttatattcttacagttgatctcattgcttttgtaattaccgcataaaatatggaaaccttttttgactaaaggcataacaaaagtatgctaatccattgagtaaatagaatgcacggaatgagaaagtattaaataatttcgaggaaatgtttttattccacatcatttctcttacattattgggcttttcttgtaatttcttattaaaatctttcactgttgttatatttgttgtgagtttaatttagcaggggtatggaataattcctcctggtttcagacgctgagcactacaggattagcatccctggcactgccactaaatgctaatagcagtgccctcctatcatagggcaaaccaaaatgtgcatacacacacacccctaatcaaaagtcactgtcttagctattgctgttgtattataaatgaataattaaagttcttaacatgacattttggagattaatttatcagcatgttgtaaatatatgcattgagtctctacctcttcagtaattcacatataatctggaaaatctatatccaaaagggggaaaaaaacaggaataatcaagagtctactacattatctccacacttagattccattgagaatctaaaagtagtttaacttatatttgaggcagatgtattttaggacatgttgctaaaagtaaatattacgaacaagtaattgtgaacctgtagccaaggaaccctttgggaattttaatgattactgtgaatggtgaagacagttttgaagaactattctttgaaggatggaatgttaacatttcaaggacctgtgaagagctctgggccaaggttcccaccagatactctaagccattagagaattaggcatgctcattctagattctttgtcttttatgaaaccacatctagagtgtatttaccaacatccctgtgataatgagtttgcaaatcatcatgtatatgatacatgatatatattgtgtaaatatacgtgtgaatacataaataggtaaagaaacccttttagccttgtttaatacagtctctccttaaatccattatgctggaaatacttgtttggggcacagctagcagcacagtacatcagccacagcaccaagcaactttcatttattgtgttgtctagtgcacaccacagccctacaaggtagatattattgcccatctctcctttatagataagaaggataaattaacttagtatgccagcatttgaacccagttaatttttaagttaagctagataggtccacagtcctgtttttcacaatttcagaatggaaaaaactctgaaaactgcaaaacctaacatgaactaagttttaatcctacatattgtgaatatttatatattttactgaaacaaataaaaagtaatgtgtttgattatacttgttgccccagatagcccaggaggtattttataaatatagtgtatactcctttctaagcggtgttgtcgttttaataactgaaaaatgttgaacttcaaaaggcatctgaccccatgggtttcttaagagtgagattgtgacctgtacctttatctacatgcagttaacacaaaagataattacttatatgtaacaagttaaagaatgatgaacactgtaagcctactacctggcttaaaaaaatagaatgttatcaactcatttgaagatgctgtgtgcctgtcccctattgtatccctctctctcattcccagaggtaactactattccgaattgtgtatatgtgactcttttcatttaaaaaaaataactagagacattttcttatgttcctactttctgacatttcttagtaacttgtttgctgtcatcaggaagatatcacctcagatttgattcatgtttgcttaagtgtgtcttaggtgattttgttttgtaggaattgcatgaaataattgaaataggaataaatctgaagtcacttcgggcttgcaaaaaaaaattgtatgcaaaattatagtaacatatataatatgtatataatatataatacatataatagttatatattaacattatgttaatgttaactcaccagtgtagtaaaatctgtaacagaacataattcctggataactgaaggttttgaatagtccttgggtatttggcatagaaggatttaatctgatttttaaaatttgttgacttttttttttttcagaaatggattgacttgcacctaaatgaaattacttatctaatgatctcttggacttaaagcactttgtttctgcagttacttcgcatgagtgtttactgcctctcagtcagcattctttacagtattaatacacagagaaggaaggaccagctgcattagaatcactgtaacttgttgaaaatccacatttccagacttaacacccagatattctaattcagtacgtctgagtgaggtccaggattctatatttttaacaaacatcccaggtgatttgcatgaagaccaatgtctgagaaccactgcttacaggaatcagagtactttgctggcatctttgagctcttagggtcctaaactacctgctttcttttcacttgtcttagctttctaaacttggaattaggaggcttattcaagtcctggttcttccactttctggctagcaatcttgggcaagtcacttaaattctgcaactgtttcctcatctgtacaatgagaacagtgatgtgttcactgcccagcctccaacatatttgtgattaaagaaaaacgagataagatagtaattttccattataaagtactccacactgttaagtttgttgctttttttttttttcctgtttcccaagattattgtcttgggtcactggccttttgggtggcaggtcctaaaggaggaggagtccttgaccagagtacttccaggtagtactctgaatttacaacagggctattcaaatagtgctcatactccttatcattagggtgtctggatgaaacatacctctgcttctgatttcttaaatagttttgttttatatattgtgctatgatttagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaaggtaactaatagcagattactaagaaatgtgtgtattaatgttttaaagaattgttttcctacttatttaaaaaacattagaataacacttaaaaagtcatcacccattatcatgcattccaaacacaatggttttcatagataaatatttttatatggatggatacagtctgtgtccattagcagtattttttcagtacatctttcatgacttaatattcataattatgatttagcaacttcataacattctccccagttaacttaccttcattggatttcttacctcctccccccagttgttggacataagggttgttttcaatttttggcacacaaagggaacattcttcaaaatctattacatatttaggggtatgttttaactgttgaattatgtttttacgataaaattcttaagacaaaatgttagatatttgatttccaatacaactaatcaattactttctcttaatttatacaaaattcaataatatttgtaccttggttttcttttccttaatagtttcacttaaaactgaaaagtggcattcctataaggattatatagtttatcctcattactaaacattttcagatttgacatttgttctactacactaccctactgttaacattttccccaaagaagaggaaaatagatttgtgaaagcaattgcacttcaaaatgcaaatgacagtgggggaaaaagaataccctgtttgctgccagttgatactttttagtttgtgctgtttcatttgggaagaattgttcttgtatattaaaatggagttttgccttatttttttactgcttatcctggagttttgtcaaatatttgattgtctaagaaaatgctattatagattaacattgtcttagctgtttacttctaaatcttttaatttttttcagtgaaaaagtagtatctgaaaatcccaacattgttgtaattgggttagctgttgttatcatgttgtctatcatgtttataaaatggttactcatcttgcttattttccttttatcctttagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgt

SEQ ID NO: 37860 - DNA, 2175 bp, Homo sapiens
ggatgttgcccaggtacaaggccaggatcttcggggcctggcttcatttggagttcagctaccaaaaggaaaccttcctctgggtcctggagtatttggcctgaaattgggaactcggaagttgctgctccagggcgctccctgcggagctccgccgcccgcctctccgcccggcctttcccggcgtccccacgcggggcgcaaccgcgagaaagaaacgcaggtcgcaccgtcagcgcccagagcagcgccagtttccgggcccgggctgctctcggagccatgagctgcggccgcccccctcccgacgtggacggcatgatcaccctcaaggtggacaacctgacctaccgcacctctcccgacagcttgaggcgcgtgttcgagaagtacgggcgcgtgggcgacgtgtacatcccgcgggagccccacaccaaggcgccccggggcttcgctttcgtccgctttcacgaccggcgcgacgcccaagacgccgaggccgccatggacggggcggagctggacggacgcgagctgcgggtgcaggtggcgcgctatggccgccgggacctgccccgcagccgccagggagagccacgcggcaggtccagaggcggcggctacggacggcggagccgcagctacgggcggcggagccgcagccccaggcggcgacaccgcagccgatcccggggtcccagctgctccaggtcccgcagccgatctcgctataggggttctcgctatagccggtctccctacagccgatctccttacagccggtcgcgctacagcgctctccctacagcagatctcgctacagggaatctcgctacggcggatctcactacagctcatctggttacagtaactctcgctacagccgatatcacagcagccggtctcactcgaagtctgggtcctccactagctctcgctctgcatcaacctccaaatcgagctctgcgcgacgatccaagtcctcctcggtctccaggtctcgctcgcggtccaggtcttcatctatgaccaggagtcctccccgggtatccaagaggaaatccaagtcaaggtcgcgatccaagaggccccccaagtctcctgaagaggaaggacagatgtcctcttaagaaaatgatgcatcaggaagcaacgtgatggaggacttgggggaaaaggatcacatactcagtctatggaagcaacgtccctggaagaagaggctgcctattgaaaaggttgtgtcacacttttctacctttttgccagtttgaagctttgcatcaggtggcaaaattcattctatgtgccgttttgttgttattcacattttattgtaacttaggaggtgaacgacctaagattacgttattgggtttggatatttgaggcaaaaatttatttttatttctatagtgatgactgttttggtttgaaatgaacagattggtaacctaatttgtggcctcctgacttttaaggaaacgtgtgcagccattacacacagcctaacgctgtcaagacatgcttcaacattgccttcattccttaaaaacctacaaaaggtggtgtaaattaatatggataattttatttacctccaggtctaaaaggtagtgtgacccaaatttgtataaagatttttcatgtgaaaggactggggttttagcaaacacaggtctaatctcttttgtgtttttgtgcaccaggcccggctgcgtagcagttgagtgatgctggttagctattaaggtggcctgttgcagtgcagagtgctgagctgcttcctgttttcttctgattgctcctggggaaaacacgccttgtcctgaagaacaaatggctgtccagtttattaaaatgcctgtcaactgcacttccagtcacccaggccttgcagataaataatggagcatgcagtgagcacatctagctgacgataatcacaccttttcccccgtcttttctgaaaaattgtaaatctgatcatatcaacatgtatgaacttaaaatatggagaatgttatggaagaaatagtttataagtttgttaagtacttataacatggtttatctttttgattattaattttttacgctaaccattgtttctgtagttaaaattgttttcttggtgttatcttttctcagaataaaattagaaacttttgatgg

SEQ ID NO: 37861 - DNA, 53439 bp, Homo sapiens; identical to SEQ ID NO: 37172

SEQ ID NO: 37862 - DNA, 8569 bp, Homo sapiens
atgacgccgaggaggcggccccgtccccgcgctcccgccgctcccgccagggcagcccgggaggccagacgctggcgctgcagggagagggcggtgggcgcatccgctagggggcgcggcggggcggggcgcacctttcggcgggcctcgcggatggcggcgcagggcgtagggcctgggccggggtcggcggcgcccccggggctggaggcggcccggcagaagctggcgctgcggcgcaagaaggtgctgagcaccgaggagatggagctgtacgagctggctcaggcggcgggcggcggtatcgaccccgacgtgttcaagtgagcggggcgggtgggggccgcatgctcgccagacacccccgacctctgctctccgggtacgcccggcccgctggtcgggaggagcccccgctgcccccgcccccgtccttgtccggtcttcagggaggtggccgcgccgggcggagagggctcaccggccccgcgtctgtccccgccaggatcctggtggacctgctgaagctgaacgtggcccccctcgccgtcttccagatgctcaagtccatgtgtgccgggcagaggctagcgagcgagccccaggaccctgcggccgtgtctctgcccacgtcgagcgtgcccgagacccgaggtcagagctgggcccgctgtccctgccccagtggcgggggtggcgggcggggagggggcaggcgcggcacagcggcggcgtggccctgagtggccaggcctgtctgtcggtcggtctaggcccagcacctgcagggcccatccgtgggctctgctcctgggcttcgctgccagccttaggaggcacgtccaggtcaggtggacgcagagtgcgtgccccagggtggtccaggctgggtagggctcctccgcttagctcctccccacctcttcactcaggccttcatcctacaaagtcgggaatcaagacggtttggggctgggcgccgtggctcacgcctataatctttgggaccccacggcgggaggatcctttgaggccatgagtttgagaccagtctgggtgacagggtgagatcctgtctctaaatgtttttcaaaagacagtctcgatctctgtcctgtggtatacagcatccagggaagtgcccagggagcagggcaggcagacgtcttcctgcctttaccccacctgggcccagttcctgcctctgatgattgcaggaagagagttagacgcggaactcccagggtgcagaggcctgcggggtctgaagggcctcctccctctccagtgtggtgactgggctgaggagatgctgggactgagagtgtcatggtggagcctccgtccctgctcatcctctccgcatgttgcttctgctcccgatggctctctctgaaatgcagcacaacctcccaggccaatggaaggaggcccagagctggctccctgcctggaagcaggaggagaccctcacaggcatcatgagaaggcgtggaaagcaggctgccttcatgggggaagtgccagggcctgggcacccacgcccgctgacccaagagggcccgggcacctgcgtgctggcctcttcactgaccctcgctctgtctgctctctttgtgtctctctctgacctccagaggcctcctttctctctgccaggaacagtagcccccctgcaaggccctcgttttcctccagcccgcagcctgcggcctctctggttatgctccacagcccagctgccacacactcacctctctctccaggccccccgggttccctccgcctctcttgctgcctgttctctccttttgcaggttgcgtttattggcttatctctgggggttggtgctcttccttgttttcatggaaactgcatggccccaagaggcccaagcagctttgagctgcaagggcaggatcatgcaggccaccgctgccctgccgcttagccacagggcactatttctgactcggtttattagagacatggtgtggcagtctctagaccccacagtcgggctggcatccggggacaggaccaacatccccacaccccagaggcgaactagtggtgagtgtaaagagcccctctccaggggaagacagccagccgggtgcagtgtgctctgctggagagcacagccccaggcgtgacaaacgcctcggcctcttagaagttgtcccctacctggacaggaagtctggaggctgaaacagagactcccaccttcccagagtctgccaggcagtgccacacagatgccatgtgctggtcccatggccacactccagcactcagcccccttgcccgcctcactcctgagttgggacactttccaggtgtcaccaggtgtgatcaggggcctgtgagagcccaggggtctttggtcgcgcctcctgcatgagcctcctgacagcggccacctcactgccacccagagctcaggcccaagagagggtggagagggcctgaaggacaggcctggagtaggggtgtatggactgcaggctgagatgagcaattgaggggcaagtgtccagcaggagggagaaactgggaacagagttcttgtcactccaggagatgttgctgctcacttagcactcactcagggctctgggtgccaggcctagctctcagggcagagggcgtggcagggaagtgagatgatcacactcagtccagtgagaggcagtgaggaaaaccaccagtgagaccagtgtgctggctcacacctgtaatcccagcacttcgggaagtcaaggcaggtggattccttgagctcaggagttcaagatcagcctgggcaacatagcaagaccccatctctacaaaaaatacaaaaactagccaggcagggcccggcgcggtggctcacgcctgtaatcccagcactttgggaggctgaggcgggcggatctcgagctcaggagatcgagaccatcctggctaacacggtgaaaccccatctctactaaaaatacaaaaaaaaaattagccaggcatggtggcaggtgcctttagtcccagctacttgggaggctgaggcaggagaatggcgtgaacctgggaggtggagcttacagtgagccaagattgcgccactgcactccagcctgggtgacagagcgagactccatctcaaaaaaaaaaaaaactagccaggtgggcgtggtggtggcgcccatctgtattcccagctacttgggaggctgaggtgggaggattgcctgagcctgagggggatgttgcagtgagccaagagcttgtgactggactccagcctgggcaacagagcaagaccctgtctcaaaaaaaaaaaaagaaaagaaaggaaaagaaaaaccactagcaatggagttgggaggaggcttcagagcccagagagcagcaagggttacacagggtggagcaggaagggtcagcagagccccacacgtgtgagctggggcagtgggagggcatgggagaggcagagcgctgtccaggtgctggtaggcccagggcaggaggaggcaggtgggggggcacagtcaagatgtatgtgggggttgtggcactggaaatgcaggcatagaggggccaggaggattagggggtgccatgtgagcgaatgggggctccaagagaatttacccgaggacaggagtggcctggagtgctgggcccctcagggtcatttgtttctcgagggctgtgtcctggaagcatagcccaggtcctgtaggctgggtggcagaaagccacgacatgagggcaccgaggccccatggggatagagtggaacctgaggaggaggtggaggggaatggggcagacgtgtgctgctgagtgagaggcagaggccacagatggaatgctgagagctctctgaggcccacatattacagcttctgaccacacagagctccagctgccctggtaatggcagaatctggggtggaggattctgtcaccccatatggcaggggggttgtcggagtaatccggggggaggggcatggaggccataggtttcccacaggactcgggtgttgagttctccaggctatgggccaggccctctcgagcttgcctctgtgagctgcagcaggcaccctgggtcctctggatgcctgtcccccagccatgcagacggcctgtgggaacaaccaccaccagattcactcatacccacagggaaggggaaatagaaaaccccagaagcacagagggtcgatgcttgtcttggtgagagtctggagtcattgagggaaaaataaattcagtcaagcgttatatttaagtttagggaaactatacgttttaaaagttgtccagagcatgcgtgtaagatgacgtttggagtgtggaagccgtgagtctcacctgagctgtgctgcctgatacaggaacttcgagccacacatggctggcgtggtcattgcactgcgtgtggtatgcgcagcagatgccaaaggaccggtacaaaagggaatgcaaaaaacccaccacaccttgggaggccgaggctgctggatctcttgagctcagcagttcaggactagccagggcaacacagggagacccaatctctacaaaacatacaaaaattagcagggcatggtggcacacatctgtagttccaactacttgggaggctgaggttggaggattgcttgagcctgggaggttgaggttgcagtgagctgtgactgcaccactgcactccagcctgggtgagagagtgagaccctgtctcaaaaataaacaaaaaaccccaaagtgaatgaggctgggcattggttcacacctgtaatcccaacatttttggaggctgaggcaggagcatcacttgaagctcggagtttgagaccagcctgggcaacatagcaagaccccacccatttctacaaagaaacaagaaaaagaacaaaggtgaatgcaacatcttatgaataatttatgtactgactacatattgaaataatacgttggatattttagattaattaaagtatttgagctaattgtgcattttcttttactttttatttatttatttatttttgagacagtcttgctctgtcacccaggctggagtgcagtggcacactcatagctcactgcagcctcaacctcgtgggctcaggcaatcctcccacctcctcttgagtagctgggactacaggtgcacactaccacacctggctaatttttaaattttttgtggagatggaggtctcactatgttgtcccagctggtctctagctcctggcctcaaaggatcctcccaccttggcctcccaaagcactggaattacaggcacgagccactgacccctgctgagccaggctgtttttaacattcagtggtcattgactgtttttggcgtttaggagggccctccagggaccaggtgtaggggcatcagtcaccctgccctcacaccccaacctgcagccacacttggttcaatcccactgtctagcccgtctgactcagtagcccctcccgagggagcagggctaagcaaagctggtttccccactgcaaggcactgcaggccattctattctgggccttctcatccttcataaagtgaggaggcctgaacagggctccccactagccccgagagcacgcaattcctgaagatttccaggattttcttaatatcagttatggcttacggttatgttggtttcacatttccagggtttgtcaaccctgtcagatttaaagataagcattattagccaggtgtggccccatgcttgtagtcccagctacatcgaggctgaggcaggaagatccctcgaggccatgggttccgggcagcaatgaactgtgattgcatcactgtgctctagaccaggtgacagagcaagactcagtctctaaacccccctcccccaccactcttaaaaaaaaaaaaagcattatttgctcttttctgcttcgctgtcatccttgtttccagaagggactgggtcactactgaggggaggagaggaagctcagatggcggcaaactgaagggaagccgactctgagtcaggcctaggtgcacggcctgccatgctgcgtgctgtggggagctgagagcgcatgggcacctaagcacccagattaggctgcggctacagaagatctgactgtctggcctggcctgcagagggactgtggcctcagaggaggatgctggcccagtgtgggagctgctgcagggtggtgggtcccgtctgctcatggaagacagaatccttgccccttgaccagtcagtggggactagaattatggcagtttgtaccacaagagatgcgtggtggctattgtctgctttgtgcctttttcactagtcactgctgggctgaggtggccaatcatcacccaccacgtgttcctgactgcgctcctccttggctcagggcaaccctgactccatctttgttcagccaagtgtgacaagctgacagagttcccagcatgacaccgctgtaaccctcaccaccaccaggcaagaatgagcaaagatctcattctctgaggaagaactccccggaaactcataaggagggccgtcctatccctgcagggtatggggagaattttgtggtattagcatagaaagggagctggaggtacctctggaagagcgggggtccacggcatctcagacacaggagtctctgcttgttcagggtgacagatggtgaaacaaatgacctaatgggtccctagacacccggttgcatcttttctccaggaatccagtttccctttgcagggtatttgactacacttgataagaggccagggaaggaccaggattgaggctgggtgttctgttggctgaacccttgtctggagtcaccctaaaagtgatggcaggggagttcccacacgggactgccccaaacctttccaagatgagagccagttgggattccaaaggaagaaacacttaatgccagggtggtcagtccaaagcatttgttagggagcttatatacagagggggctgcagcgtgccctcacgagggacagccaggaaagaggttgtgcctaggcacaccgcactgagggggtggggtgtggagtttctatgagggtgcaaggaatttggctggggtgggaccagtttccacgtgcttagcaacacgtcagatctttcagtgttccaggcaacaacctaaacgtgtatcagtgtctgggaacatgcaagccccagccagggtttgagcctgcagggggaacatgtagctgattaggtcagagtggtcaaggcactccctcagtcaggacaaaggaaatgctggggggatgaaatgggggacccaacactgagtcaggcaggggacacacgccctgtttagagcccacgggtcagaccccaccaggccagagcaggggagagccctggccaaggcactccgcatggggggctgtgaccccacgggcaagcctgctacccgggcacgtttgtaccttggagggtcctctcagtcttgccgatgctgtcaacaccctgagcccagggaaatgcatcccattaaaataaagctctggcccgagtgtggttgcagatttttcttggctatcttaaagagtaaagtaagcaaattacaaatcaaagaaactctgaacctgtggtcttcatccgagagagcctctggtgttcagaaggaaagtctcaagcgttcagactgtggcaggaaccctgtcatggaatctggcagctaaacccgaaagcaagaggcttgaccactgcagaacactcgggtaggtaggaaacaatgaaagagcttccaaaatcaaaatcagaaacccaattccaggacttggtgactgcagtacttcctgcctgtcaccatctggggcagctcagatgtgcagtccagcgtgaacacaccttgaggatgaggcagcgcgtccctgctgctgctgctgccgctgatggcacgatcagggcagactaggtttgctgaccaggctaggtgtggaccaccacacctacctttccctaaatgggcccgtggcatgtgtcctttcaaaatgttcccttggcagtgtgctccttgcgtggcttcgctcctaggacacatcctaaagggtcccctgcacactgccaagggcttctggggcgtgacctgtctttagtggttctgagtctcaggacttggggctgatgcagggcctctagctgaagcgactttgatggaaatgtgtagacacaaatgttgcccaaggagcacgagtacagcaggtgctgcatttatggggcgcgtccattcctaatcattgtgctttgtgtctccttagggagagacaaaggcagcgctgccctcgggggagtattggccctggcggaacgcagcaaccacgagggatccagccagaggatgccacgccagcccagcgctaccaggctgcccaaggggggcgggcctgggaagagccctacgcagggcagcacctaggatggggcagagacttgtcacatctttgtccccagcaaaggctacatgttacctccttcagttgataataaacctttctgagatgcagagggtccaggtc

SEQ ID NO: 37863 - DNA, 6679 bp, Homo sapiens
tctttgccctcgcgacgccgccacctccggaacaagccatggtggcggcgacggtggcagcggcgtggctgctcctgtgggctgcggcctgcgcgcagcaggagcaggacttctacgacttcaaggcggtcaacatccggggcaaactggtgtcgctggagaagtaccgcggatcggtgagtgcgcggggtctggcggcgccgctgggcccggcctcgccctggcggggcctgctggggacgccccgcagcccggtcccccgcgcggtgtggctccgaggacgctccagccgcgcggccgccaaaccccggcccccgccccgctcggccgtgacctctggcgcggcgcccccatcccgcgcccggcccggcccggcccgcggctacgtggcacggccttggcgcggaggaacccgaagcgctcgcagtcggcgcccacttcgctaccggcacctttgggcagcggggtccagaccttcgccgggaggccgggcaccactgcccagcctttgccattcacgggtgaaaaaagtaaccgtagcatcgtgcggcctttccctctcccgtcctcattttctgcatctggaacggggagtggctgattcggagtccagtgaagaacactgtggagatcaatgtgcagggcagagagagagttatttcagatgcacggagacctcacacggatcatccctgggagagggcacaaaggcccagagagggcaggcattcgcacaaggtcacactacactagaaagacggggcctggaagagaaccccaccgccacatccggggtcctctctaggccaagtccttagatggcagctcaggggcacacataagagtcatccaggctaattgccccctcattaccaagagggaatctaagctcagagaagacttcggagaggaagggtatctgggttgagtctttgaatacgagtggattttagcaagactaagaagcaaacagcaagaagggggtgggggggcgcggggccaggagttccagctgttgtgcttcaaagagtctaaagctggaggctacgagtggtggaagatgaggctgaaacgactggcaagggagcaggcgggaccttgaacactacattgagaggcctgcatgtcacattatgtgcagtgaagaactcccagagtggacctcttcaggatggacctggggactggtgtgaaatggctggggagttgaaatctaatgaacaggtgggccagcgtccagttttggatgaaccacacaaaaatagatgtcaacatttttctcctgggagcaacaccatctttagtgaagaccagtactctataagccttgaaattttcgattatgctgggagtcttggggacagtaatccctgcttgattgtcccccagagtgtcgtgagtttcaaatcagatgaaggcgtggatgcacttagtaaactgtagagtgctttgcacctgtgtttggtggatcccagcaggaacttcatttagaactctgggcaaagaaccaagaacagggcccgctccaattcaggcctcctgttctctctagggcagctcaccagagagccccaggtttagcgtctgaccagctctgctacttattaattcgttgttcattattgaacacctactgtatactaactagatactaggtcaggccctggggatacagtggtgaacaaaacagatacatttccactaaatggagcttacatggggtaaggagaagaaagacaataaacaaggaactgagaaatgcacgaggtaattcctagtagtagtaagtgctaagacaaaaatagaacaaggtcacacagctagtaagacagtaagaatttgaacccagacagtccagctccagagtctatgctcttagttgccaagttcagcagtaaaccagggaacagggagtccagaaaagctgtaattggtgctgagttaacccaggctaggcttgctgcttgggcaatatgctcattccttcacctgcaaacatttactggctcctactacatgtctgacactgggtccagctctgatgacatagtcatgagcaagattgacatggttgatgccctcaggctaattgggaccatagtcatttagaccagtatggatgaatgggtgaccacttgggaatgtgtggggttatgtgtagtgtgtgcctttgtgaatggtttacttcttctgtgtacaaatctgagtctgtgtctgtgcttgtatatgtacatatgtaaattaactgtgtgtacttgggtgtgtctgtctgtgttttggtttctaaggaccaagctttttggtttcagggatggaactagaagccagattttcccccttccaaaagagcgggcagacatgcaagttgtgagttaaaaataagcaagctttggccggacgcagtggctcacgcctgtaatcccagcacttcaggaggctgaggcgggtggatcacaaggtgaggagttcgaggctagcctggccaacatggtgaaactccgtctgtacttaaaaaatacaaaaattagctgggcatggtggcgtgtgcctgtaatcccagctactcaggaggctgaggcaggagaattgcttgaacccgggaggtggaggttgcagtgagccaagatcgcgccactgcactccagccttggtaacagagcaagactctgtctttaaaaaaaaaaaaaaaaaaaaaaaagctttaatgttctcattgcccagggatccagcagggggaaaaaaaggaagaaccctaactgaggaagggagttaacagtcccagtttctcaccattccaggcacagtatggtgtatgctgacctcaaattgaggaggttgttctaatagccagtggccccaggcatgggtcctttctcacctggtggaggtagggtacaggaggtacagctcagtggttcaatcatctagcccagtagttctcaactaggagtgattattccctttagggcacaattggcaatgtctggagacattgttgattgtcaagactgggcatctagtgggtagaggccagggatgctgccaaacatctgataataaataaacaggacatccccccgacaacaaagaattatctgacccaaatgtcaattatggaggatagggctaggctgcctaggcaccggctagggttttaaatccattaataatatatacctagaagctaaaaacatagcatttgagccaaaattctaatcaaagtcttataatcaagttccattagccagctttgtatttattgcctaaaggctttaataaatttaaggattagtctaatgataaaagaaagtggtaggctgggcatggtggttcatgactgtaatcctagcactttgagaggcttagctggtaggattgcctgaggctaagagtttttgagtccagcctggacaacatggcgagaactgtctctaccaaaagtaaaaattaaaaaattagccaggtgtgatggcacgtgcctgtagtcctagctatttgagaggctgaggtgggaggatcacttcagctcagaagtttgagactgcaaacggttggggggatgtcctgttatgattatgccattgctccagcagcaacaacaacaaaagtggtgttagttctctggagaggagggggacaaaaaggtgattgccctggagttatgagggttcttttctcaagaaaacctgtgtctatgttcccatgcaggcgtttgtgtttgtgtgcacacttactcattcatctgaaacttactgagactttttcatatgccaggcccagagatgaagtggacatagctcctgccctcagtaggttcacattctagaagggagactgacacagtgcagagtggcgagtgctagctgactgagccaaaaattgagcccaggtctccctttgtaccccctcttatcagttctcagtatgtgctcaccagtatgtgtgccccagtctgtggatgtgctgtgtgtgtgggcatgtgtggtgtttgctaacatgtttgtatcgtggtgcatgtgcatacctatttatgtatgttgtatacttatgttcacagatgttcatgtatgtgtgcacacatctgtaagctcctgaatgtttgatttcatatgtgcctgtctgtgtgcatgtgtttgtgtatgtgtgagagcactggacacacatttacatatgtgtacacagtgttcttgtatgtgtgaggcagtattaactgttgagggagtcacatatgtggatgtgtcagggcatgtacaggttcatgcctcttcactggcttgtctgggctttgttttgttttgtttctgtcatacaggtgtccctggtggtgaatgtggccagcgagtgcggcttcacagaccagcactaccgagccctgcagcagctgcagcgagacctgggcccccaccactttaacgtgctcgccttcccctgcaaccagtttggccaacaggagcctgacagcaacaaggagattgagagctttgcccgccgcacctacagtgtctcattccccatgtttagcaagattgcagtcaccggtactggtgcccatcctgccttcaagtacctggcccgtaagtcctggtctcttcatcccctcacacctcccttagctggctgaggccatggctccctgggcagcagaagccactggctggttgggtgacctggggccccttccccttcctgatcatctcaggtggactgatgctttgttccagcactaatctttgaggagagtggaggcaggtagaagctgaggggtattcctgcctaagaatatctccatacctgctgcctctcacttgtccctcagaagtcactcttttggacttttctgggatcctgttttcacattcaggggctcctagaaggagacatttaagtcagtgtgaactagatgagtttatggacatatgatggagaaaccaaggcatagacaggggaggccacctgcttggagaaagctgaccaagatagtagacaggcatcttcaccctgagtcagtggcggagtctgtaggccatggagggagaccttctaagctaaaataccagatcttagtatttgagaacaagatcccttctccagctgcagaagcctcagagccacagaatgggctcatgggctaagcttgccattctgaccatttcttccctcaggccttctcctctggaggccccatttttgccttttctgattccgtgcttctggtggcctttgtatcccttgccaccaccccaccctgcaacccattcacctggaggagtaaatgagaagcaagagtgcagcaaacaaaaggtcccttactgcggcaggtttgtgttttgctctgtggctcagtcctaatgttgatttttttctctgtgttcttttattagttccttcccagttctcacagttatagatcaaacccggccttgcttttagaagcacctggggagctcttaaaaatgcacaaggctgagacctactgaagcagggcccaagaatctttattttaagcactcccctgacccccagtgattctgatgaaaccagtccatggactaacatttggaaaccattaaaactgaactagagaatagggtgtagactattcagtagttcgaagtcattaataaaggaggatttgataccactttatcaagcacgtcacagaatcctacagcagtcgttctcaacctcggccccactttggaatctcccagggggcttttgaaaaatgctgatgcctgagcctcaccctcagagattctggttggagtggtctggggtgtggactgggcatcaggattagctgccaccagggaaagatggacactgagagtgaagtcccaggagagggtacgcagggtagcacgctttgctctccttcctttttctctagagacttctgggaaggagcccacctggaacttctggaagtacctagtagccccagatggaaaggtggtaggggcttgggacccaactgtgtcagtggaggaggtcagaccccagatcacagcgctcgtgaggaagctcatcctactgaagcgagaagacttataaccaccgcgtctcctcctccaccacctcatcccgcccacctgtgtggggctgaccaatgcaaactcaaatggtgcttcaaagggagagacccactgactctccttcctttactcttatgccattggtcccatcattcttgtgggggaaaaattctagtattttgattatttgaatcttacagcaacaaataggaactcctggccaatgagagctcttgaccagtgaatcaccagccgatacgaacgtcttgccaacaaaaatgtgtggcaaatagaagtatatcaagcaataatctcccacccaaggcttctgtaaactgggaccaatgattacctcatagggctgttgtgaggattaggatgaaatacctgtgaaagtgcctaggcagtgccagccaaataggaggcattcaatgaacattttttgcatataaaccaaaaaataacttgttatcaataaaaacttgcatccaacatgaatttccagccgatgataatccaggccaaaggtttagttgttgttatttcctctgtattattttcttcattacaaaagaaatgcaagttcattgtaacaatccaaacaatacctcacgatataaaataaaaatgaaagtatcctcctc

SEQ ID NO: 37864 - DNA, 9219 bp, Homo sapiens; identical to SEQ ID NO: 37075

SEQ ID NO: 37865 - DNA, 36652 bp, Homo sapiens; identical to SEQ ID NO: 36608

SEQ ID NO: 37866 - DNA, 34818 bp, Homo sapiens
cgctcgtatcaggcttcatggcggcgcggccactgtcccggatgctgcggcggcttctgaggtccagcgcccggagctgcagctcaggggctccggtgacccagccctgccccggggagtccgcgcgagctgcctcggaggtgagcccaccccgcctgcgtccacagcttcccggggcaggagtggccccggcacactgcccttttcccccagtagctcccggcctatctgcttgaccgcttctgggagggacccgttggcactcctcagtggagcgatgttctccagatggaccgcccggtctcacccgctagcccagcgggagaggttcctgggagtcccgcttcagaacctccctgccccccagccacgccaccccttctagccctgagcttggccagaaattcgggtaagcagaggactgggactttgggtccagtgaggtgtcttagtacctttcagccttgccttgcacccaccctctttcttaaacattttccctccctatcccaagagctgagagatcaggtgtccctgtgacacctgcttcatagtgcgactgactaaacatgtcacctcggtgtcaccaacgatgagttgttactgtagtcccagggctctgtaacccatcctttgctgactctccttgtcttttttattaaccttgggagggttcagccttatcctagagcagaacagggcaggacgtggcttcttccaggtgagaaattaattcctctgtctttagggttttgggtaagatccctcagtccttgccagcacccctcagagtgtttcaagtcattaaaagttttaggttttggttgttcttctgctcaggtggttagggaataatttggggggaaaagtacctcttttcatttagtgaaacctcttttcggtacctatctaggcgtttttttccccgtctcccagaactaggcttcctgtcctgggattcataagatcactgctccctcctcccctatattgctcaatgacttccgccaaatttgctttccccaaatctaagcccctctgggatcctcagataagcaggcccatggttgggaagtgaagactttttagtatcctcaaactctgaacatcattgaggaagagataggaaagcaaagatggctgagagatctttaaagaattcaagaaaagggacttttcttctccagccccccaccccctagtttattttgtactggtctttcatgagagaacctgtgttgagtgactcacatgtggaagcatttagtcctcactaagccatgtgaggtgagtagagtttgtatgttcagatgagggggctaatctaagttaactttcctccagtcgcagagctgtagagggcaggaactcaactctaatgcttttccgtcctccctgtgtggaggccagggagagagcctgctcctatccatccctttacactgtgaagggaggggtaatgtggcagaaaggagaacatagactctggggcagccccatcccttattagggattcaccaagtccccttacctctcagtgtctgttttctcatctgcaaagtaagaataaaagtgtctacttcataggatgtcacagggattaaaagagttaacgtatgttaacgtatatacttagaacaaagcttagcccatgtaagtgctgtgttatgtaaatgttggtggtaattactattatccatgctgccactggcacatgctctgtcctgtgagtcccctcccatctggacttgttggatagctattctgtcaactcacattgaatcctggacatctcattaggattatcttcagcagactgggagttcctgagggctgggtgcacctccgcctttctatccccacaagcgcttaacgcagggttgtgcaggcagtggattcagccaataattgtagctgcttgaaacttaactagtgaggagtcacgtggcatagtagaccacactggacagggagtcccatgttttcacccgccagtttcgcctccaatttcacctggctcctggggctgtcacttccctttgcttcatgtttataaaatgagaggactgggccagcccatcataagatgggggagggcacagaaacttgtcttgaggagactctaaggggaggtgagtctggaaatggatatgttctgctcatctccagagcttgccagttggggtggggacaccttgaaccccttcttgcagggtctgtctcccccaacacgcccacacagggctctggtagtctggtttgggatgggaggtgcttggagagctaggatggaaagccactgggcattgtttgtgtggcaggatgagggtgtgagggagagaagtgaggttaagtgggagctggctgtgaggattgcggaaagggggctgtgggctgagtccaagaacaggtcgagtagcttctagctatggaaaggagtagtgtgtgggtcaatggggaggtgggtgggggagacacagcaacctgccagcctgcatctggggtggcccagacaatctttgtagggttcagcctagcctgggagtgctgtatccctctttctccctctgaggctccatgcaggctttgttgggcaacaatgaagcctgctgcctgtggcgggggaagcagggagggtgagtctaggcaaggcaaaggcacccatctgttcagggggccagaaaaaacaaatgctggctaggggttaggctgcaaggaagtgggtgtgggtgaaggtagaaggagtacagcaggcactggtgagggagaatgagggggaggagggaaagagggctttcaggaggtcatcttgacttccaatctgcccagctcctcaaaatccatgtttcagcgaaatgtgactgtcctcctcagaagctataggtgtaaagacctcacacttagggtgggaatgaggggagggggaaggagaatcgagctaggctaggctctttgttgggtcctctcatttaaaagagattaattttaagagacccttagtatacatcatcccaatagcagggtaaatcagggccacgatacttagatttggaatgtgctttttttcctctcgaataaccctgctgctctgtttagactttggagctatttgagggctagcctttagcagtcaaatcagatgcctaagatgagtgactagtagaggagggcaccttgagggcagggtcccgctttaactcttttgtcccacccttccccacccccttcaccctaatctgcattgggtagacatgagatgaccagtagtgtctggcaggctgcttagtgcctgctgatgcacaccagtattggtggtcctggggatgctcagaccccacttgggtggtgtggcagcagctttgaaaccctgcctctggccatctgctgttagtagggttggaaggccagggtcttggaagggaagggaagctgacaaactagaaaaactgatcacagcacacaacagtgttcctccatggatcactgaatgaaaacctcggtgccaggaactcctccaactgagttaggttggattattatttccactgcatagatgaggaaactaaggtttcgagaatttaggtgacttgctcaacagctagagccaggcttgtaatataggctcacctactccaaatcctgtgctcagaaccacaacaacttgccctggattaaaatagcacctggcacttggtgtcactaggccgatggttctcagccctggctgcacagctgaggcactagattgagctagaatctttgggacagattctagctccttcttgaaactagaatccttcttgaagctccttgagtgattttgatgggctgccagggtttcaaaccactataccaggttaaaccattttgacagtagagaccagccgggaaatgattacccccatgtaactggcttttgcatatacgacctttctgcttacattagggacaggactatttgttcatgtgattcaaaatgtaccaacatcctgtgctagacactggggatactgaatcaggcagaatgacttctcacggagaggaaacagcccaggccagcctgggaccctgggaatatgatccgttgagtgcttcctactacttctggcatgtcccagccctcctgagcaagcagggttgctgtctactctgtcctataattccctctgaatcttgggctcctttgactggtgctgatatttttttcctccaggagacttaagggacagggaaaaaagtagaagaatgaaagtagggcatgcagtgttagaggagagaagatgcaggaatggggctcgttaatatctgagtaatgagtttgcattgctggcagggtgagagtgtgtgtgtttaggaggctgggttcagaacgggtggtgcagtctgcataagtctagacaaggtcacagaagttcttaaaagtgaaatctgaccagcctctcccattgccagaacaaaagcaccaaattccatttttttttttttttttttttttgagagaatctcgctctgttgcccaggctggagtacagtggtgcgatcttggctgactgccacatctgccttctgggttcaagcgattctcttgcctcagcctcccgagtagctgggattacagactcgcgccaccacagccagctaacttttgtattttttagtagagacggggttttgccatgttgcccaggctagtctcacactcctggcctcaaatgatctgccctcctcggcctcccaaagtgctgggattccaggcgtgaaccaccacacccggcccctaattccattcttgattgctccatcacactgcttgctctcaggtttctgctgaataatgctccttggtcctctcaacttccaattctttgatgtattttgactcctcccccatccagccaccccatccccccatcatgtcaagactgggttgagggggggtatcttggcaagtgaagaggcagaatctagggtgactaacatgactgaattgcaaatagctgttgatgaaaaagagggcacagcactgcaatacatccagattcccaggtatctcatctggactccggtggctgatgggattcttgattatggagtgctccccgccccaaccctgaggctatctgtggaaaggcaatgggttgagtttgagttttctccatcataccgcagggagggaggaagtgactgttgtgattatagcagacggcagttagagaagtgactgctgcttactccccacaggatggtgagcagggcttctcagaggaggtgggaaattctcccgcggtgggtagagtgaggaatgttttatgggcccagaaaatcaagagcagcttcacacatactctcatgtctcttatctttgagccactcagtggctcttgacccagtcaagggctgccgatgagaattacctggagagattgaaaacgtaacagattcagagatccagatttagttggtctccactggaatgtttttttaaagttctccagatggttctaatgtgcagctggagctgaggaacttactgaagcaaatgcttcttcctcctaattgtaggcatagttgcgctagacctttggagggcctgagaccttctgttcttcatcataattttaagtgttcacctaccatcttctgataccaccactaccactccacccctgtctttactcctagcaagacaaccttagcctgtagctgtattcttattttacaactgggaaagcaggcctggagaagttaagggactttcacagtgtaccaggtcatacctactgcagaaaccagggtttcttattcccattccagaaccttgtctgtagatctcatgcatgacttccagggtcgtgatttttttgtctgaaatattctagagaagtgacttctacccaccctagttgtcatcctccctatcttcttggactctctctgtgatagaagggagtaatttagaacctggaatcagggtcgggtgtggtggctcatgcctgtaatcccagcactttggggggccaaggcaggtggatcacgaggtcaggagatcgagaccatcctggctaacacagcgaaaccccgtctctactaaagatacaaaaaattagccgggtgcagtggcgggtgcctgtagtcccagctacttgggagactgaggcaggagaatggcatgaatctgggaggtggagtttgcagtgagccaagatcgcgctactgcactccagcctgggcaaaagagcgagactccatctcaaaaaaaaaaaaaaagaacctggaatcagaagacctggatttgaatcctgcttctgccgagggtgttcttggaccccatccaagccttagttataataatcccttgtggagtgggtgtgggaatgaaacagaacgttctttggaaactttaagatgcttggtaaatgctacttccttggagcaattatctcatcagcatctgtcgggacccaggttgtactctccaaggaccgataggtcagggggagacggatcagactagatcagacttgtacatgggaaagagtgaagccggctccctcctttctctctgcaggacgggtttgggccttgcttgtggccttcagcagtctcttctcatttatgcccgagaccatgggtgcacaatcctttttttggcactggctagagtgaagaataagggctaatagatttccccacacccttgcctccaccttgctgcccagccagaaatcttcccagtagagatcaccatccgcccccgacccccaagctgaatacttaaggggtgggtccttcccatcaagctgatttctcaacgagagggacaatcccagcttccccaacattgcagagcccaaacatgtggaagagttggaagctccgcacagatgtcagagtaagggagggggcaggcggttctccttgtgcctcttcccagcccggtagcaggggcccatgcttcctccctggtctgtcctcgcaggaggtgtccaggcggaggcagttcctgcgggagcatgcggcccccttctccgccttcctcacagacagcttcggccggcagcacagctacctgcggatctccctcacagagaagtgcaacctcagatgtgagtcaccttcctgggccctctctgggctggtgtccatctgctgaagcagcccttgaaatttccctgtgcctggaaatcctcctgtgtcctccagttctgctttctaacttcttcacctgctaccccttgcttaccaggccaggtgggcttcaggggcaagataggggtcaaggctgagttgtatgattatagaagctgtgtcctacttggaattagatttgaaaacataaatgcagttggatttagaattaagattggatcctggacctctcattcttcaggggtccttcctcctgtttccctgtagttcccgaagtccaggacatggccaggggtggggtggtggacattataaacatttgaagtagacagccatgcccatgccagcactgctgactctggaggtgccccagtcccgtgacaaatcagctggggctaggctaataacaaagaggcctcatttcataatcctcccaaagagtgctctggatctgtagccactgctggagggacttccaaaggtgatcttccttcccctctgttccttccttctgcctctccccactttccccttccccccttcccccccttcttttcctccccactttctttcactatacctcacgataagaaataaagttacttcatggcccaataaatgcatgcatgtatgtttagtaactttttaaccaaacaagatgtactatatgctttacattctggtagtcttacttattctcttcagtctcaaaggactggttctggacccaactgagtaatttgccttcatgactctctaacagatcttgacccaaaccttaatgaaactgcaccacaggaagtgatggtggaggatggtggcccttccacagcctgccgctgctcacctcatttaccccattctgatacctcaccatgaacaagtagtatctcagttttccaacatataaaatgggtctgatgataacctgaaatagatagagtggatttgagaatgcttgtagctacagaggacggcagcttttgccaggccagagagtacctctctctcaccccatgacacacagagagaaagctacctgtttgccatagccagtgaaatgcaggaggatgggtgacaatgccaggaggaacgcccctgcccaggtgccctcagcccaggaagtcaggccaggctctgccctcagcctacttcatctctaacccatgcccttggcctcccactgagggatgttatggccagattgtgtgtgttgggcatagggaaaggtgttaacgtttcagaaatgagaaaggtgaggcctggggagatgctggcctggggtttttccacctcaggtttagtgaggtctccgctcacatccagatgggtttgagaagcctttggcctgatggagagttggggagtggaggcatcacggggctgtggccgtgcctctttcctccctccacattcccattcatccttccctcaggtcagtactgcatgcccgaggagggggtcccgctgacccccaaagccaacctgctgaccacagaggagatcctgaccctcgcccggctctttgtgaaggaaggcatcgacaagatccggctcacaggtggagagccgcttatccggccggacgtggtggacattgtgggtgagttggacgaaagtcatcgccacttctcccagcgctgcctcatccggctggacactgatgccgatgttaacagtggcagctgacattcatttagcacatgacactctcttggtcctacaacacctgctgagacaggtgctattattatttccatttttgatgagaaaatgaggcttaggttggataacttgcccaaggtcaggaagctcgcaaatgccagacctcagtagcttgctgtcacattgagaccaaggtcctccaggaggcccacgtgacctggctcttgctgacctccaaaacccttgcaggcttctccacctttcccctccttcccattcacatgaccgggccttgacatgtgctgttccctttgctaggagctcagggcactctcctcgacctcattcaggtctctgttcacatgtcatcttctcagcaaggccttcctcaaccatcctgtctaaagtgcgtcctcatgtactcacaccagccactctttcccagaaattggcaagttatagcagccaaatctgggccgacatgtgtttttgtctaacgtgcaaactgagtgttgtttgtttgtttgtttgtttttgagatagagtctcgctctgtcacctaggctagagtgcagtggcaggatctcggctcactgcaacctccacctcccaggttcaagtgactctccttcctcagcctccagagtagctgggcttacaggcacacaccgctatgcctggctaattttttgtgtttttagcagagacggggtttcaccatgttggctaagctggtctcgaaaccctgacctcaagtgatccacacacctcggcctcccaaagtgctgagattacaggcgtgagccactgcatcctgccatggtttttatgctcctaaataatggggaaaaaaataaaataataacattttctaccacacgaaaattataaaatcctatatgttcagtgtctattaatggagttttattggaatatagccatgcccattcatttacatattgcccatggctgctttggcagagttgcatggtgttgacaaagactgtgttgcaaagctggccagccaagtagaaaatatttactatctggacttccacagaaaaagtgtggcaacccctgccctactcacttaccctactttgttttgcttcatagcatttatctcatcctggcactgtgtgtttgggttgtgtgtttggtttctttaattgtctgtctcctgcattcgctggcgtgaaagctctcaggttgctggagcaggttttgtttttggcatccagtaccgtgcctgacacgtggttgatgctccctgaaattcgctgaatgaatggagactgggtcagagtagtctctgcagtacggcatattcctatctgagtctccactgtgcctcttacaagaagcgtaccttgggcaacttttaaaatctgttctaagccttgaggcagtgatagtacctaccttataaggttgacctgaggagggaatgagaatgaaatgcccagcctatggcaagtgctctgtaaaggtagctctaaagggcctcttgccatgagcttctaaaccccaagatcaggaaagagacctttgctcatgtaattataggtgatgaaatcggggctatgaggttccatgttcttgattgctgccccgtccagctgctttggacaggaccccccgcccctcagctctctagctcagtaattgttcgctggagtgccctcttgcatgcctcctactgtgctgagcacacgaagatgaatgagcaccagccctgctgttgaggacctgtggcccactggaggaagcagctgctgtataaggggagcctaggtgctgtgagagtcccaaggaggggcccaggtccccctgacagccctcttctccctcctgccccatggccagctcccttcagctcctactggtcacttggcctgggaacctctgtcatcctgtgctggctgagctggcccaggcaagctgaccccatgttccaggcagctcctcagggctaaaaggcaggctggctgccaggaaagggctgaacctgctgaaccagctgcttgccaggcccagccccctcatccaggccacttcctctccctggcacccgcgggcatgggccgccttgtgccaggacctgtgagagagcagaggggatgaggatcactcactggtcagggaggtacaggatggctgagcactggtatgaggactcggggctctcccgggaaaccccagcatgcagagagggaagaatgggagccaggaaagttggtagctctgtccccattctgccactctctggctgggtgaacttgtgcaggttccttccccaccgagggcctcagtttcctcagctgtggatgagccactttaaggatgttttctgctgtgatattctgtggttattggccctggctgatggaatgggatgggcaaggggtgatcgccacatggatgctagttaggacaaggccccgcttgcagtgacctgcttctgaggatttacctcctgcctcccaggtggtgggggtgggtgaaacacctccccttgcccctctcccagtgcttcaaaaagaatggtggctgcaccccctcacttcctgtggcgctgtgcctgtgagcactctgacatccctcaggggctagcctctgatcttccccagaggagctgcttcagagcaaagcagccttgaagggcagggcagatgggtgctggtggaggaaggagggatgggggaagagagagaacagaagtcagggccaggatgttcacgaacacttgtgcctaccctctcacgtgagggttttgaggggcccccacctggaggcagagcaaaaggattgcaggttacagtttctgccgagcctgaggtcccgttcacctcaggtccatgtctgaagctctgtcagcctttgagaggtgctgcagaacaccccacgggaagggtttgggcccctcagctctctctggctccctctgccaaccccttgcctctccagcacttctgcaccctgcttcgtgtgcagacaaagtcccatgccccttcttttcagctgagatgggtttaaagcattatcttggtgcaaaagttatggcgggtttggccatgaatagcattgtcccatagagcatgggtgtcctatcttttggcttccctgggccacagtggaagaactgtctgaggccacacataaaatacacgaacactaacgatagctgatgagctaaaaatttaccaaaaaatctaatgtttttagaaaatttacaaatttgtgttgggccacattcaaagccatcctaggccatgtgcagcccctagggcacaggttggacaagcttgccatagagcttcccaagatgatggaatgttctgcatctgtgttgtctgatacagtagccactcatagctcttgagggcctgacatgtggctaatgtaaccgagaaactgaatttgtattttatgattttttcgttcatttaagtagcctcatgtggccagcagctgctgtgttggacagtgaaagttagggtcttccaaaggaaggaagaggaactaagcgcacaagtactgtgagagtgttggaggagtttgcagggcccttgttttccatcctaacttcccgaacgactggccactgccagatgagctggacttagcttaagaattgctcactggggaacagcagacactgggacctacttgagggtggagggtgggaaaagggagaggatcagaaaaaataactattgagtactaggcttagtacctggatgacgaagtaatctgtacaacaaacccccatgacacaagttaacccatgtaacaaacctgcacatgtacccctgaacgtaaaaaaaagttgaaaaaaaatcactcattgcggcagcttcttcctttcctttttctttccttccttctttccttccattcctcgctccctccattccttcctgcctttcttgtagagtatagcttgatttcacagcttaaagcccatgagaggcttaatgtaatggaaagccaatgacagattgtgaaaagaggtaaagcattttgttttatttttggtgggctccagttgcatagaattaggttaaatcatagttaaatcatacttggttcatgagatattctcatcattgatccatgtatgacttgctttactttattcatgttaataatgttagtggttcctaaggaaacccactataccaccaatgttttggcaaaaagtttttttttttttttagacgtagtcttgctctgtcgcccaggctggagtgcagtggtgcgatctgagctgactgcaaccactgcctcccaggttcacgccattctcccacctcagcctcccaagtagctgggactacaggcacccgccaccatgcctggctaattttttatatttttagtagaggcggggtttcactgtgttagccaggatgatctcgatctcctgacctcatgatccacccgcctcggcctcccaaagtgctaggattacaggcatgagccactgcgcccagccatttggcaataacttttaactacctatggggccttccctatactgtaccctgcccccaccccactgccacctaaggtaagtgttcctcagttttctatttatcgttttcttgctgccctgtcccccccccttttttttttgggagaccggatctagctctgttgcccgggctggagtgcagtggcacgacagctcactgcagcctcaacctcctgggttcaagcgatcctcccacctcagcctctagagtagttgggactacaggcgcacaccaccacacccagctaatttttgtattttttgtagagacagtgttttgccatgttacccaggctggtcttgcactcctgggctcaagtgatcctcctgccctggcctcccaaagtgctgggattacaggcatgagccaccacacctggcctattcccttgctttttaaaaagtagatatagcgttttgaagtttgtaagtgtcatgctgtgtgtagtctttcagggcttattgtttttgactcaagtaaaatgcataatgttatacagagttgtagttcttttttcctctgtggtctactgttacattatgtgaatgtaccctattttctccttttagtgagcatttgaattggttctagcttttttgttgtggacggtgccactttaaacactgttttcattaacatatcttggtatacagtttctctagcggtggaattgctggatcataaaataggtgaatgtttaactctggaaaacaatgtggcattacttaataacatggttgtgccaaatacactttcacccgccctatgtaagagatcctgccaaatgacctcccaacactcagtattattcttgatatttgccagttgaacaagtgtaaaattatatttcattgtggtcttaatttgtattttcatgtttaagaatgaagttggcatctcttcacatgttaattagctatacatatatataaaatatattttactgtgtaattcctggtcatgtcttttgcctatttttctatttggttctttgtcctttcgtacttatttggtacaggttctttatatatgttgtgaatatctcctccccatctgaaaaaacaagttacaccatgtgtaatgattgtttttgatcagtagcagttcttgaatttatcagcgtttttttcttttatggttagtgttttcatatcttgttaatgaaacacctaaccccagatcagatcacctaccttcgttcttcacaaaaaattttaaatttgcatataggtccttagttcatctgtagatgatttttgggaattcaatgtaatttttttccatatggatagccatttttttatagttctttatattgaacaatccttacttcctccataaatctgccattctgaacttgatctgtttcaagttctactttgttctgttggtccatttgttagtctctgtgccagtatcaactgtcttaatcactgtagcttcatcagtcaattatctggtagggcaagttctttttattctttttcaacagtgttttacatatactaaggcttgaccatgtaaattttgaaatcagcttatcaggttttttttttttttgttgctgttttttgtttgttttttgtttttgagacagagtcttactctgtcacccaggctggagtgcaatgacacgatctcggctcactgccacctttgcctcccgggttcaagcgattctcctgctttggcttcccaagcagctgggattacaggcatatgccaccaccacacctggctgatttttgtatttttggtagaaacagggttttactacgttgggcaggctggtcttgaactcctgacctcaagtgatccacctgccttggcctcccaaagttctgggattacagccatcagccaccgtgcctggcctccagttgacttttaagctagttctttgggcagttgccgctgatttcttcagtaaggggataatcagtgatggtgctgaggtctcagtgggcaagggaaagaatacaacgtaacctgcttcattttcctttatctactcgcattctttgcccatattcatcccctaactcataccatttcacaacaactagccttcttaaggacttagattgttaagttcttacatgcctagattgtgtttctccggggttgatttggtagaagtgaacaaccactgctaattttccttattggtagagtcagagtgaaactctttcctttttcaaacagctcttatttgtaaactttattattttttttttttacaaaagtaatttatgtttatttcagaaaagcagaaagaatgtcattactgcctgtttgtaaccactgttgacattttggtttgatgacccacctgccatttttcctctgcatcttgtgtttactgcatctcttgttactgttctctctacgtaatatagtgcgtgcatttccctacaccctaatgtatgattttatagagtcattttgggttgcataatgttccgtcatccagagaaaacataatttaaccagtttgctattgttggctctctagattatttcccactttccttaattatgcattactccgtgatgaacatccttgtaggtaaatgttattcacatccgtgattatttccttaaattcttagtggaatttcaggtcaaaggctttaaaaattcatgtacaacttctctccagaaagattatatgattttattcttacaccatgattgtgtgcattcccatgcacccctaccttaaactgatgatgaattttgtaacattctgccttttctaatatttggcttcacttgagcactttactcttggtttcctctctcttgcagcgctgagctgggtcttcatagagacatacgtttacatagcttcttggaaacaactggtctggtggctggaagggtgtagtcagtggcactgtccatgtagcaaaggtcagctaaaattcagggggaggggtgtgtatgtgtgtcacccacattatcaaagaaaacgtgtttgttatagaaagaaattttacctataaataaatacaaaaatcacctatgatcctattgatcacagataactactgtgtacattttcatagcttatcttttctctagatcttcttggatttgaatgtgagcaggtgtgtttcttcagactcattcttttcattctttgatcttttgtatccagctcttcaagaatgcctttgctgaattttccagtttgctcattcattcctgtgttcattctgcttctcaagttttttcttcttgtaactatatattgtttaattttcaagagccctaattagggttttttcttggtttattttcaagattgaatatttatcccaataaggatattccctctgctttttaaaagaattatcttctgttatcactgttccttctcctcctcctttcattcttctatttggggaagtagttatctttctttcatgcttcttccttaaatgtttgttgattcttggcggtgtactcatcttagtgcctgaggtctctgttggcctgcccggcaatgttgtttgtgttgtgtttctgtttgggttgctccaaggttgtggagaaggggtgtgaggtactgctgagtgtcaccaggactcaggccttgcccccgaaatggtttggctgtgtccccacccaaatctcttcttgaattgtagttcccataatccccacgtgtcatgggagggacccagtaggaggtaatttaataatgggggtggttaccctcatgctgttctcatgatagtgagttttgacgagatctgatgatttttataaggggcttttcctgttttgctcaacatttcttgctgctgccatgtgaagaaggacgtgtttgcttcctcttctgccatgattgtaagtttcctgaggcctccctaaccatgctgaactgtgagtcaatgaaacctcttttctttataaattacccagtctcaggtatttctttattagcagcatgagaaggaactaatacagccccatggctggcttaagtgtctgcactggtgctttatccttgaggcaaatgcttctgctgccttcccgtgccgacagggaaggatgaggccaacctgtccagctccttcaaatataactcccctcttagacaacctccctgacatgtagtaggacccctctgctcctgtacatgtgactactaagctgcgtgcacactagtcactccctgtttttacagaaccttctcctgggtgcactttgagctgtggtctctatccgtctggtcggttccatctgctttctctctttcagtactaatttacctttctgggctatctacggcattctttcttaccttccaatgctattatggatttttaaaatccttccattatttctagggatatttggtagaatggagctgtcaaatagcacttaattcaaacacttttgtttccattatacagagtatcaagacctgtgtagtacttggttgttaagagcagagtcctgagtcaagtacacatggatttaaatgccagctcttcttactgtgtgagattaagcaattttcataatctttcagagcacctctttccttacctactaaatgagataattgttattgtgaggcttcaatgagctaatgtatgcaaagccctcagcagagcacctagcacagagcactcaatgcttaatcttttggttgtttttgtcagttttgattcttagctttctttttaagttaggcctggttaatataggtctgcagagagcctcttttccatccatcttgtctggacaaagagttttgccttccagcccttttcccggcctcaccaagaacaagcaagcagtctgaccccctttctgttgtccttacagcccagctccagcggctggaagggctgagaaccataggtgttaccaccaatggcatcaacctggcccggctactgccccagcttcagaaggctggtctcagtgccatcaacatcagcctggacaccctggtgcctgccaagtttgagttcattgtccgcaggaaaggtgagcggatgtggatggggtgggtgtccctcccagggcctgcacatagctggggagggcatggccattgctgagccaggggcctggtcacttcctcttggtgtctgggctatcagtaagtcaaagcacttatttctcacccctcatctttgccaaatgtatgtcagggactttgggggtcagacgctaatgacctagggtgaccaacctccccaccaccccagccccagtttgcccaggacttgagggggttttagaatgaaggacttgaagttttaaaaccaagacagtctgtggcaaactgggccgagttggtcattctacgatgagctctgaagaaacacgggacagcccagggtggaagtagccaccctgggatgccagggtctgggtgtatgctgccaggagggggtcccccagcaggcccccatggttatccctgtgcccacctgggtataagcccctcctatgcacctcctactacaggcacagccataccctccactcacctgcctcaggaggcccaaggtagacaggtggagccagcctcgagctctgggtcacaggagaccagtgcctggcttccctttggcatggacctcatgttggggcaaaggctcttcaggttgggataccctttgatatttgggagggggtacatgactgaggactctggaggatcagaggggtggcagggagacccagatctccttcctcttccttggaaacagcttcaagatcagccccaccaccttctttccttccttttcttaaacggggtgtgatgccttgcttaataccctccatgtgctgaggaagcactcatggtgtctctttcctctatggaggcctgctccaggtgctgtggaggggacagaagacacataagacattgccctgtccttacaggctgctaagggccaaaagatgtcattccatgggacagcctttgcttgtcttgtggtactgattaaagagttacagagaggaagaaagaactcttagcaggagagaactaggagggcttcaaggaggatgcatgcatgctggccttgaggaactggagggtttcaatcaatggcacatactctgagggggagcaggagtacagaacctgcaagggctctacggtgggaaagtgggaggtggatctgtgggctgtactgcccgcaaacacgttctccctttttgtctcttatttcctggcacatggattggagacatcagatcttccctcccattcatactcttttgtccaccacctgcctttggaggggagtgttttacagaaaagaaaacttatagttctaggttatcctagcagcattatttttttcaaagctatacatttttccctttaccctctcactgagcagtctgaaaatgctgcaaggaaaccatggaggccatctctaggcaccctgtctcacaggtgaccacccaggctgtgcaggctgggggtgctggagggggccaggatgcagtaggtgatcaagtgattggatgcatgagagaactgggcagtgagaagtcagcctggggtcacattgactgtggttaatgattgttgagacaataattgcttaccagccctggaacagcacctgtgcgtagtaggtgctcagagagtatgtgttgagtgaataattgatggactgttgaggaaaaaacactgaaacgggagtggaaaacctgcattctgaaagatggagccatggggctttgagcagagcattgcctcactctgggtcttggtttcctcccgtagactacaagagggttcaactagatccagggtcagcatgctatggcccacaggccacatctagccccctgcctgttttcatgtagcctttgagccaagaatgcattttacagatagcattcaaaatcagttaatgatagggaacattaactatgaaccccatttaagcaaaatattgtccctgcaaaaagaatcgcattattgtatcccatttgtagatctgttttacaagacactgtagtcagttattactattacattttgaatttagccaacactttgtgacatgtacttacacggatcctcaattttgcctcttggcttgcaaagcctacgatattactctggcctgttttagaaaacgtttgccaatctccagactagatgggctctggtgcttttctgtgggggtgtgggggaagaggagagaggacagaagttcctggatccttgtttctccctcccaggcttccacaaggtcatggagggcatccacaaggccatcgagctgggctacaaccctgtgaaggtgaggccgtgcccctgccgtagattcccgacttccctccacactgccctggccttcccctcaccgccccttggcccacttgagagccctcagctctggccagcatggctgaagtacgtgcacccttccacctcttctctccctgctggtccagccctgccgacccttgagagaaacgagaaaatcagtgaccccaaggaatcccgtaacttagagaactgagtgggagaagcaaggaatgggtccctgagtggaaggcctcagtgagtgccaggcccccaagggtcatctccacaaaagaatgcagggggcacagccctcatggtcccattgttccccggccaggtgaactgtgtggtgatgcgaggccttaacgaggatgaactcctggactttgcggccttgactgagggcctccccctggatgtgcgcttcatagagtatatgccctttgatggtcagtgaccagggatgggttgagggagggaagaaggggttgggcctgcaggtcgcatagtgtggctcacccactgggtatggctgacctcaggggcagtgagtctaggattatgatgggctgttggtggcttctcggagcccgctgtggatgtgattcaatccaccagttttaggcagagcccccgtccctcccttccaagaggctggagaactgattgctatgctgtggcaggggatggactcaaagaccccggggccccttcaactgtgattcagaagctccccttgccttcccccatcccgaatacaggcaacaagtggaacttcaagaagatggtcagctataaggagatgctagacactgtccggcagcagtggccagagctggagaaggtgccagaggaggaatccagcacagccaaggttagggagcaggagggtgtggggcaggcctggaggaaggtcgtacctccaccctaggatggagagctagcagggagctgcactgtggtggggatgctgtgatgtgggatggtaccatttaagcaggaagcatcagtgctatcacaaccacctccctgtttcatggatgaagatgtgggctcggctagggtggggggctcagtaacatgtcagaggacacactccaggaagtggcagagaggggtgctcatcccgcttccacgcagacttttctaaacatgctgcccacaggtccctgccttagcagcttttatctagggcaagccaggcataggtcaacccatgggtcatccatcctaccagagtcttctatcacctgagggccttgggtggagcttcacgtggggtcctctgggagagggttgaggagtggaggttctgatgtcatggagtgagaaactgggctcagtagcccatcccctccactgcccttttgctcccactctcccctgcccaggcctttaaaatccctggcttccaaggccagatcagcttcatcacatccatgtctgagcatttctgtgggacctgcaaccgcctgcgaatcacagctgatgggaacctcaaggtgagcatcccctcctccacagggaccccttgccacctctgtgttctcatgtctcctcccacctgtgctccctgattggagaggaggctggcagggcacggtgtcgggggaggtggttggtgcaataatgtcaggtttgggggcatgatgggagcagcaggtgagggtgaactcatggcccctctggaaatgtcaccctgattccttccttccttctgtggggccctgaagtagcttctggtttattgggagctcctttccagctctcatggagctgcaggatcaatgtgcattttgcctggcccccgccatggttagccccttccaccaggccaggggctcagctctgaaaccagaaatggatgttactcatatctaacaagcatgtcctgtgcattcgtccctgtgggggatgtcgggaccccttctcgtcagggctatgcagactcacaggcaagaccaaacagaggcaatgtgtggcagcacgagagtccttgccacacgcgtggctagatagcctgtgagagtgcagggcatcaagagcactacagacctcagcgagccttgaagaatgggtggggcagaagtggggaggggagggtgcatacatagggttcatactggttgggcgggctagggcagattaaagtcagctatgggaagactacattgtagggggctttggttcagaatgtgttctgtggacaatagtgtgctgcgtaaggttcctgaacaggggagacatcccccatgtatgttttataagccacaggctgggtgtgatggcaggaagaccaattaggtggccattcagtggttctccaaatatgttagagtgtgaattgaagggaaggaagactcagagagcttggtaatgttcgcggaaggagaggaggaaggcatcaaggtagctggaaggccttgggatcttttacaattgtgggagggtgatgatggtgggttgggtttagatgcatgcagtttgaatccaaaaggaaccatccagcaggttgctgaaaagcttgggggtttttctgggctggagatacggaattgacttggactagaggtggtatctgtatctgtgaggtcttggcaggaaatggaaggtgggattctgaagagaatgtaatgaagaagctatttataacatataagattaagggaaccaataaaggatattgaggtacttgggaccagcagcagcaaagtgctgttcccacttaggaagggcaagggggaggcactgatgtcactggggcccaggaagggctggagccttagaagagaggccacctcattggcacttgagctgtgcagagaagcagctgctgccagatacatcaaagcagggaggaagtaggggagaaatgcctgaagattgttctttccctttacccattgatctcccaggcaggagccagctggggggcgggaggggagggtggtaccaggtgaagtccacaggaggaacctctttgttgcagagaagggaacctggaggctggttggggagcgaggcatgaggaataacaggcacgctgaagcagttagacctatcctagatttcactggtatcttctccagtggtctctgcctgcagaagcttctcagacattcttctttctctgtggccacagtgccttgtgcagagctggcacagagtagatgcttcataagttttggtggaaggatggtaggtatattgatttctggggctgtctcatccatccctcttacagaagctgagaagcattgagtgaagtttgaccttaagttgtcatgcccagcagccctcagctgaagcttccaagcagtgatcacagactcaaataggtacagggcagtcaggtgatgtccacaagggacttggaggggctgaggtgaaatgggatgtgtgtgccacaacaggggtaggagacttccaggacacacacagctccaactggttgggggccattctcatggtgataaagtggccattccagcaagtgtctcagaaggtagagatctggatttttacatgctatctctgttggcatctacttagttttttaaaaatacactgagggaagtatgactgtaactcacatataggtattgggaagtcgaattttgcctcttgctcttctagcctctctgacctccctacagcacctctgtctctcactgctaggggccctgccatgggaggcctgggccctggtgctcctcccggagggagaaccagggaaggagttagctcctcagaggccaggaggccaaggctcaggggtaaggaaggcatattgtcctcacccacatgtaggtctgcctctttggaaactctgaggtatccctgcgggatcacctgcgagctggggcctctgagcaggagctgctgagaatcattggggctgctgtgggcaggaagaagcggcagcatgcaggtaagtgcagggtggggagggctggcctggatggtgagtgggccttgtccctgggagggaggtgtggagttgtggggtgagatgaccaaggaacacctagggggaagctggcgagagtcagcatcatccccactaccactcactgctgttggccctctggactcagggtacagtgatgcttctccttccatggggaaaagtcatagcagaggctgcacaggagaggggaccccagattctcttgggctgttttactaggtggggagaagggggtgtcattgcttctttctcatcccacacgtggccttctgtttagggagggcagggtcctgatgtccacagactgttctttgggctcagccttgagcgacctcgcagtgcacatgtgggggccttttgtcatacagctgagtgcatgtgctcggggctgtcaagcgcgtttgtttcagtgaactctcctctccccgccctgtccctctcccgctcccctgctttcctctccctctccccttcccctgctttcctctccctctccccctccccctcccctgctttcctctccctctccccctccccctcccctgctttcctctccctctccccttcccctgctttcctctccctctccccctcccctgctttcctctccctctccccctcccctgctttcctctccctccccatctttccctcaccccaggcatgttcagtatttcccagatgaagaaccggcccatgatcctcatcggtgggtgacccatcagtacgtaaccactcacccttgtcatttggggatctcgtggggtgggagccgtgccataggcacccccagctcctgcatttcatgctgatttctcatccttgtttttcttctattcctccttcatctcttcttaaccttcaaggttttactgtttcttcccccactgttcatgatcccccttactatacctgccacagaaatgatccttctgtctcaccagacatcagagcagggggatggtctgccagatttaatgatcactaagttagtggctccctgagaattgaaatcctggttaaaacagaggccttttcctcggctctaaaatctcccatttggataatgtgacaggtgtcctctgtagtacccaatgatccatgcacggtgtatctggaccatgagcccccacgggtggatgtgtggccagacgtctgtgctgggcagatcttgaggcagcaagttaataatgttactcacatgtaacatgaggtaatgatggccaagacctcaacttcccaattccttaactctcaggaacatctgcataggatgtatcatcgtgtgtgtaggatgcttcaaacaaaagccccctggttttaagtccttatgtggtctcctacccctgggggctgggctggtcactgaggagctgtagggtggctgttgcccctctgtcacggtgcccagattatagcaggtgaggccttgaccctttgctcgcagtcagttctgagccccctgaactgtgccactaggaaagaaaaagcaggggggagaaaagatgagaggaaagatcctttctttagaggttagagcagagggaactcagtggcccagaggggaaggcaggctagagacagcccaaggaccatctttgcccactggctgcccgggaaagcaaaggtagcttgccactgggaagaagactctcatctcctctcctcccacccccagcatccaagtcctcttgttgggccctgacccatgctgaggcaccttcatggccttgatggcatctccccagaagggaggctgcccctctgacattgacatgtctggggcttagagtatgatgcgaagtgggaagctgggggagcatttgcctcatactttcagagatattgagtaaccagtctgctttctatacaaccaagagttgcctaggacagggcctctcagaatttcatgtgcatgtgaatcactggggattttgtccttttggattgacttggaaggtctggggtgggattctgcatctcttgtgagttctcaggtggtgctggtgctgctggtgctgctggtccataagccaaccaccctttgagtaacaagagcctgcaccattccctaggccctctgcaccatctgaattagcccgtcagtttgtatgtgcttctcatgtgcttcaggggacttgaaaaacatttaagtagatcacaaattccccttattatcttgtctgtaaactaagtggttatattaactcttcatggagaatgtgaagataaaaataggtgtaattggtaatttagagtgagacctagctctagttttaagaaaatgaagggacattcagaggtcatgtgatccaggcctcaacttggtgctgcttgagagaacttgggaattgagaaggttttcatgtggagggaaccctgtgccacggtggcacagcagtttctaggagggctgttaccctgtacatcactgggtgagaagggctgtgaacttggactctgggtgccatctatctgtggatcttctactttgtcttgtcccactatgctttttgttcttcattcctctttccccggtatgaaagagaacttgaggtgggatagggagagggttggggagtagaggtgggaaaaagaattgccttttggacttagtgtttcttctcttttcttcttgccttgcagagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtcctcctgggaccggtagccttcaagcttgtccagcagaaccagctcaagaaaggagatgccctagtggtggcccagctggctggagtccaggcagccaaggtgaccagccagctgatccctctgtgccaccacgtggccctgagccacatccaggtgcagctggagctggacagcacacgccatgccgtgaagatccaggcatcttgccgggctcggggccccaccggggtggagatggaggccctgacctctgctgcagtggccgccctcaccctgtatgacatgtgcaaggctgtcagcagggacatcgtgttggaggagatcaagctcattagcaagactggtggtcagcggggggacttccatcgggcttagcacctgcccttctcacccatggcccacccaggcctggagctgggatgcaatgtaggctgagggaaagacgtcaggttcctttaatcacagtcactgtttgtttaccttgagcagtaaacccgaagtcagcctgctctactactaacaaacaggcctgctgctagatgatctctaatgaccaatggggcttcctttctatagggaggataccagcaggcccttaagccttccaggacactaaggtcgtgggagcgggactgcaacaagcaatgccagataactgagaaatcatgttctttgtggactatttcagacaaccaggttccgacagtccagcccagaacttttccttctcattttgggttttctcttctcctgctttcctggggagagattaagcgctcattaagcagaggagcccactttgaggagagcaaagcacaagcttgcctgaagaatggatcccaacttctccccggcagctctgcctccctaagtctgtgaagccgcagccctgccctgtcctgtcctgtcctgacttcatctctccttctgcccaagtctgtgtcccatcagacttgcagcctttcagcttaacagttgcccggtcctgctggccccttttcctctggcccccctcttctgaaacaggatgtgcacacatgggccatagccctaaggactcctgccagaccacacagcccacacctggccctgttcacggctgttccacccacccctctttattctggagcatatcagggaaagaaaagttgatgatagattgccttcaccctcacagcgcacaaataaagctacgatgccaactttgcagatgcaagaatgaagacactgtgtgggtagggcactgagctgctgcagtttcacagggaaggctgcacctatcaatcaatcaatcaatcctatcccaagacacagttccctgagggaagaagaggagggacctggaaaggcctaagggtgtactctctgtatagccccgctatgggaaaataaagtggagtagggggcatagaaatgcaccatctaagggaaatcttttgtcaggtggtggccaggggtgttcaaagctcattgcttgcattaccagctattagagagatcagagagggcaattaattagaggctcctggttctcacatcccaaacacacacagttctggcctgctgggctctctaacttggatgtctttgagtcctcagtggtgccccctgcctgcctcccctctgccctatgccaaggtgtgctggcaaatattaaacaaccagctctctggaaaagacaatttgtgatataaatactcccatgttgaataatttcaagctaccagtatgtcaaatggcttgcaaaatttctgaaaatgtaaacaattggttctcacagagctggtacaagctggctccagcacactctcagcccaccccagatcccctcataggaagaaggcacaagtttaaaggcagactgggtagggatggtatgaatttaatattttttagtattacaatatattcttataaaaaaggtgcaagtgaaaaaggacactgtagattatgtccattagcctcatttgtcatctgaggcagctggtgagaacagccttggcgtgaaggcatccctggtagaagtcgggggagatagatagtcacagttccccagttggtggaaatgggatgggagtagggagaggctggaacagacccttccccattcacctggagaattttctcctcccactgccctaaacactttatttccatcacaggggagaaatgctgctgagaaggttgtgtttgttaggttgatgacgaattttacattggccacaaaattagctagagaaacttatctaaaggtggcaggagcagtggggagggcatgaagaaagcaagaccaagaaacaacctattaaggaccagctcagccaccccgactgggcaccagccccttcttactcagttgagtatgagtccatggtccaaggcactgttggagatctggctacagtggcatctagcaccagagccactggccagatgtagaaaataaatagaaaaatatctttcttttagagtgagaaggctgagctctggaacaacgtatttgtgtcctctgtcaacagttgaaccaaattctgcttttctgaagatcaaatgtatcttgaacagcttccatagtccttttgtttccaggtgcgtatccagtcttccatggtgggtgggaatgccagacacgcttgtggagccctcccctgttccctgcccctgagggggttaggttgacatcagcctggtcagtttgggagaggacctttagaggcctcacccacaacctcccatcttccccaacacttgtcttgcagtgggagctcttggggctgcagatgcatatagccaaactctctgcagctgttctgcctggaagccttcatcttgccctcacctgggttccaggatggcctcttcacacctgtgtcagccaggcttgcacttgctcagatccctcccaccagaacacacacacaccgcccgccccctcaaaccaacgcacatgctgggctcaccgaccctgtgtttcttcccccccgcagctactacggtcccagccccaggagttggatgcaagtgaaaggcagaagataggcagctgagagtaggcccagctcaccagtctccactggcaataaccctgagccagggattaggttggaaagtgagaaacacagggaagggcagaagggccaagagctcattgatggtagaggttaggcagggccagtctcaaagaagatgaaaggccaactcggaacgtggtattgaataagagccttgatggagttttagaaaaattttgtctagatacagccatcccatccaccaaggccagcatgagatggacaaaatggaaggtggcagtggatgggaggaccagaaggaaccccttgcaagttgggctgaagaaccaaattgggtaccagaaatggggtggcccccctctcagccttcctccttggcaccttcaggtgatgtgctccccagaggatatcagccttcctcctccatccccatctccccagtttcccttgcctgctctgctgttcgcaccatctgaacgcctgagaggaggggccacccttagagacagcatgttaatgtagagggcagctctggccctcagacctctcaggaaccaactccccaacgccagtggacacatggttccaagtggccacctgcaggctggacagaggctgctgtggcttctgccttgaagctagtgttagagaaggggtgggagggcctgagcaatttatatgaagtagagaactatgggatggagctaagcattcaagtgctgccctctgctgaggggctgtaggggactccaaggcaacatttgaggtcactgtctggcttcacaacaatggccaggtgtccaggagatggggacatgggagatgcccaaaaggcatgaggtgtggtgatgcatgaggtctgtcttgagcccctcgccagattcatcaagcacctggtagtgagccatagctgtggaaacccaaggtgagtcttctaggactgtggattagtagacaggatggaggtgagggtagagaaggaagggaaagatacttaagacatgcagggagaggccagaggacttgtgacatgggaaacagacactgctactctgtcctgatggctttggtccctgcatcatccttccaacattgactgttctctggaacctaccagagctgatctaactagaatatataatgcctcctctgttcccattcaagaggaaagtttgcccccaggtcaatgttctgttgagcctccccttgagagaagggagtctggattccctcaccagattccctctcaggggctccctccatcattgctccccgtgctacacaggaactctggacaaggctgtggacctctccagtctagatctggaactgttctgtgccagcacatgggtgcccatggtaggggatggggagcagggccccttcagcctggggttacctggcctgaggccatccaaggcagcctcagaataatacctggggccagggcacagaaggaatcatgtgaaggggagataagaggagccccttaaggtaagcgtggggagacacctggtccagccacacacagccccccatcccaggacccagcccaaggctctaaaccaagcaccaaatggtttaaatatcaccacctcctccactcagccccattctcaccagtccctgtctcccggcctcctgtgtggctagttccccaggtcaataatttagccggtttattgcccgctcccgggtaacttccagggcctggctccctgatcgcttgcggctgcgcttgagcttgcataagtccttgtcgaagacctccccagagcgcagggccgacaccaggtcatcgaactctcctccctcctccagcgagctgcctgcagccaggaccttccgctgccgctgccaccgctcacgttccctctgctccttcagctgcgggcggggggccaaagataggaaccctctcagggagaggcgctgaggccagggcagccccccaaccctgggctaactcctaggccatggtcatgctgcctgcctgtatctgttggccccactttcttcctgcctaggacatacaggcccccagcttcacaccactctcttccctcaggctgggaagaagtttctctctcctggggctgacatccaacccctatggtgttcctcagttcctcagtctctgccctcctcccacacaccccagtttgggggtgttctccccaagtagcacccgtctcccctcagtcccaggcctggcactgcccctcaccatggcttccatgcgcgcccgccgctcctcctcctccttcctcctcctcatggcctctagatcctgccgggcctctgagaaggcctgcaagaaggtatcaaagatgccaaagaattcgtctggctgcatcttgctgtcatgctccccgaagtgcatcaaggccttggcgaactgtcaagggacagaacaggattggtggagagtgccctggagcatgctgggctcagcccctgaggttagctgggttctagccagagcagagcccagcgcaaggctggggactgttggcacagggggcagggctggaagaggtgagaagacacccccatcatcatcaggatcagagacaaggctaaggagaggcaggtaaagagttgggctcactcagtccaccttagagccacccctgggcctgtaaggggtaggcatgaggtcaggggtatagaccttgggaagcccttcctgaggtcaggaagaggctggcagaactcagaacttcaaagatcctctagttatgttaataacccctctgtgcctcagcttcctccactgtcaaatgggaataatagaatctacatcatagtggtgttggggggttagatgagttggtggctataaaacagtggctatatttatataggccaggcactgttctgagttactgagagctaccattgttaattcaactcactcagtatcctctaagaaagatctcactactcaaaagtgtgcttcatggactagcagcagattcacctcctgttagaaatgcagaatctcagaccccaggcctcctaaatgagaatccatgttttaataagacccccatacatgaggtctatggacacgttagtgtgagaagcagatagaggcatggtaatcatgtccactgctgagctgtggtgtcagattctaacccagttctataacttacagctgggcaatcttgggcaagttacttagcatctctgattttagcgttcatatctgtcaagtgggaaataacctttcaacaaacccataaggtaggtggtgacaaatcattaaaacacttaacatggtgcctgatatctgataaatggaccatgatctttgcggtatgtggttatcattgcttgtcttgttaagagcgaagaaacggttttctctcaaagctctgtaactctgggtttgtccctcctgggctgtctgtggtaggaatgggtgaaggagcttgtttagataaggctgggttggcaagcagtgggggttggggcacccttaccttgtccctggcctcatttagctggtcctccagctcggagaagctgaagctggacaccgtgatgaagtcgctcatgacagggacaaacttgtcactgggctcccgtacctggcgcctctgatactccagctcctgaggagggagggtgaagtgctgcttagactggtgccaagatgagagtcgggtgcaggggtcaccacatctcccctcgtcactcacaggacattgagccctttggaagagggaacaccctgcatctcaaagttctaaggatggcaaagactatgagctaacattagcagccagcccaccctgccatctttctttctctagagcactgagacccaacatgtgacctggggccagcagcatcacctaggaaattatgagaaatacagactctcagacccacaggatcagaagctgcattttaacaagactcatctttacaagactccaggtgactcatgcacaaattaaagagacatttttctaaagctcccagctgattcagaagctgctggtccatgtaccgcactttgagtagcacttaacaggactataaaattgtaaatttggaaatcatcttcccccaccgtagtggcaacaaaacgttctttgtcatcctt

SEQ ID NO: 37867 - DNA, 1570 bp, Homo sapiens
gcagttcggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctggtgagtccccaggacgcccctggccctaatttcctccagctgcgcacctccggccctcactgcacgcgccagccttctttgtgcggtcgggtaaacagagggcggagtccccttggcctcgcctcccgctaaccattgttgcctccatctcttcccgtagggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaaggtaactagtgtgtgggtaatggactacatctcccagcaggccgtgcgcgcgaggagccttgatttgagggcgtaggtgtcgcgtgggcttctgggagattgagttcggtcttgtgagccctcttaaccgctggaaatagaggcgcacctcgtgcagtgcccacaacacgcggcagtccacaccgctgcgtggtcttagggacgtatagctgtaagagctaggacagggtgcggagagtgataaatacaagctgtcacatgtctttgtggcctgggcctctgacccccaacgactcttgggaaatgtaggtttagttctatgtgccgagtgtgtgtattctgagccatttctcccttctatatagaagccagctgaagatgagtggggtaaaaccccagacgccatgaaagctgccatggccctggagaaaaagctgaaccaggcccttttggatcttcatgccctgggttctgcccgcacggacccccatgtacgtacccgctgcatccatggctacccaaccatacccctcaagcctctgctccctttgggcaaatttccttcagagcctcatttcacacctgtcacattttaatctgcaactggctgctctctccccctcttttccagggattgggtttctaatttctccctcttctctctcagctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatgc

SEQ ID NO: 37868 - DNA, 27842 bp, Homo sapiens
gcgagcaacaggccgtgccgggtgagtggggcgctctcgtgggcatcccagcgccggggcaggccgggtagtgcccgatcccgcggggcgcgcgctgctgctttaggcacccgggctcgggtgcgggtctgggagacctgtcggtcggcgagaagcctcggtggccggcgctgtggttgcgggacctgggacgcgctcccaggcgtcccacctccccggagactggggcagggtgggtggggcccggatctaggggtagggtcgcggaagccttggttacagagagtcgcacacgtggcctgctaatggtcgcgacaccggtgacgagcgcacggaaagtttggaggcttagcaaggagggtggtgccggcctccgcccggtggtggcagaactgcctgtgcgagcacggcttccacgtgggctgcgccgccgggcgtcatgtcgggcctaagagacacgctctacagctgtgaaatctgaagttcaggtgtgtggggagaagggcagctgcattacatcatatgcttccaattcatttaccagcaaataattccgcaacgattggccgacagctgggttgtccaacaggttactgagaccaggttattcactgttttcaggaaggatagactgggaggaagaggatctgatttcgccactcattagctgtaaatctggtgcctcgggtttcatgtcactgggctcatctttgagcagaggaacctgatttactcagcttcttctgctggtactggtttttgcctcctggacatcaagctttgtaacctcatggtcacgaaaatacattgaggtatagtccgtttcctctctaaaatcagactaaaaagataactgctgatcactcctttaggtcaataggagaaccagttttccctctggattgattaacatatctctgagccaaaaagaaatgttttagatcagtctgggcaaccttgttacaagcaatatataatttctgacagccgtgtgtttaactgagctgcgtttgactgttgtcctccattagtggacctaaaattcatctagagagcgtattacgttaatgcagattatgggcctcagccatcagaagtggcaatccagtgggcttgatgagggcccagaaatttgcatgctaacaaccttgctggtaactctgaactacattctgtaaaactgcccaggggatgtagaaattcatacttccctccccgatttagtaataactactgatgtctaaagtgccttttagcttttacgatactcttgaatcctgaagtgacagctgcaatcagaaaaataatcccctctgcacaggccatctgttttttccgtaactgttttgtgtaaggcctttgtggtttgtctccaaaattgtatacagacaaaagatgaaaatgtgaaaaattcagcagacatttcttgaggacctcctatgtaccacaccgtgcttgtttccggggatatacaaatcctttccttcaagagcttcctcacgtcttcatgtcctcaaatattatagaaaaggaggttagggtacctttaaaatatagtgactgtctgtctgttgcctatagtatggttgtcaacattgattttcttatagggtttatctgtggggtagtcaccaaagtatgaactgtaaatcttttagtctttttacatttaatgcttatagtcaactcaaatggaaaacaattgctcttcaaaaacttttctgtgattttacagaaatatttactcctattggggtggtctctaaggcttatgggcaaggttgtgttggctgtactattctagacaaagcattgtcttctttaattactatagtattggattctaagatatgtgttttacttcttgctgtttccgaaattatgatatgtaccttaagacttttgtatgtttaatgtggtaggatgcttcatctattctcccctctgctctagaaagctgttaagaggaatggttgtcttacagtatgagtagtgtgagaatcagagaaataatgtatttgcccagaaacctctaagcttaggctccaattaactgagcctcaaatcatttcaacatgaacacagagaaacaaatgatgtaacttttggcagtatgggtagtgaaatttatattctaaggaaagcatttgttatacagtattggggtttgttagtgattgtagatgggaaagattcttttaagtgattttattttggcttaagtgttttgcattctttgattagccacactttctggtgaatgtgcttatactgtattcatatattatgcttaaagaaaagcttttcgtttgcatcttcctcctgctctctccccttaaatgaattttaaactgaccaattgtgagagataagagatgtgtggctgaatataaaatgactctatagggtgcctttagtaatacaaacctaataaaccaatctaagtttttaaaaattaaacgtgagcaatgtgctgtggtccccaaggccatctttagttcagcaatttgctaggaggactcggctgatttattacagggaaaagatatcaagcacagtcagcaaagggaagaggcacatgggtgaagttctggggataccaagtgcaaggctccaagggtcttcgagcggtcacactggctgtgctcagttgctccagcaactagttgtgtcaacacttgtgaaatgttgccaacctgcgaagcttgttagagactcagtgcccagggcttttactgggggcttttcacttaggccacccctgcctggcacataccaacgtttccagactcccagaggaaagcaggtgttggtataaactgtaatgattgtacattttaggcatggtgagccactcctatcagttaatggtggtggaaactctcccaaaatcttaagttctcagacatcggccacaagctgcactttcaaaggatagcagtcaggcctgctatggaacgtcttctgcataagcagtaccccttcccgaatccatttttctatctctttgtatttctccatcacttgagagttccatgtactagcaatgctgtgccttcctgaagccttaattctttcctggagaattcaagctggtctgtttcacttaaaggaaacattttcagaaaatgtgtcttactgaccacatatcctaaacactaaagtttattttttttttctaagcttcaagctttacccctctcctgtagtatcagtttgtgttagtcttccaccatgtcctgtgtttccttatcaaaagcacctggtcttttgaaggaatggagctgtttagagggttttatattttgacatttcctttcttaatttgttcagtttacatctgggtttcaatctaaagtttcttttataagttgcaacacgtcacacagtatgcaacacatcgttccaggatgcttacttcccaggccagaacattaattccacttagtctacagtgtagctgaaatactgcttagttataatgacaaaagaacagaaaacagtattcttgcaattctgataactcaccaaagtaggaaactataccatttataaataacaagtctttcagaaattttggtttttataagtacagtggttcttaaccttgtcaggagatagggacttccttaagaatctgttgaaagtgatggagtcccttcccagagggaaaggactttaagatagaattttgcagtctcaggaaatttaaataatttgaattacagttcttggaaacagatgagggaaacctaccctctaagtatcaatagttgtggtttggaggcagttctgaaggagctttgcaaggcttggctgtgtggcttcgactactcagcagtgtcagcagcagaagcatcacctgggagcctgttagaaatgcagaacctcaggcttcaccttggagctagtggatcatatcctgcattttattgagatgctaaggtgatctgtgtgcacattaaagttggagaagtgctgtgttaggggctaatgatattggtattatttaaaatcttcagttaaaaagttatagttttttcaaggctttagatataactacttttagccttcacttttcagcctttaggggctttatttctttaaacgaaggggagtttctgataaaagtggccgttttcaggaataagctcagagttggaagtgagcaggttcaggtggttagtggagacaggagaaggcagtggcctgctccagccaccaggagacaccgcgggtccagggcgcattgattgacctgcgcaacagttggggtggtgctgcggtgaggagcacctggcagtgggcggctgttagtttttctctagtcaaatgtttgtaactcagagtacatctaattagatgtgggccctgatgctgatgggagccaaatccaagatatttgactttgctgtgtcagtggccacaggctaaacctgtgagtaggaactgctgagacagttgaataggtttatttgggataattatactgcctaataaataataccatgacatagtgcttgtgtaaaagaaaaacacgttcttctttagatgaatatgtcatctgagtggtggttgagcttgaatcatatcttagaagaaatggcattggcttaaggctgtctcctatcctgggggaagtagctttgacctatgaagagttctcacgaaggtgtaatggtcattcagttgtgtgtgcgcgcgatccactaacaccaatgctggcactccttgtaaacctaaccatgtgtgttttgttcttttggtaggtttgcatttccttactgctttgtcttgaagacagaacgatgccaaagaaagcaaagcctacagggagtgggaaggaagaggggccggctccctgtaagcagatgaagttagaagcagctggggggccttcagctttaaactttgacagtcccagtagtctctttgaaagtttaatctcgcccatcaagacagagacttttttcaaggaattctgggagcagaagccccttctcattcagagagatgaccctgcactggccacatactatgggtccctgttcaagctaacagatctgaagagtctgtgcagccgggggatgtactatggaagagatgtgaatgtctgccggtgtgtcaatgggaagaagaaggttttaaataaagatggcaaagcacactttcttcagctgagaaaagattttgatcagaaaagggcaacgattcagtttcaccaacctcagagatttaaggtaaccagtttccccattgcagaatcctcatacattttaaagtactaacatttggccacatatcagctcaagggtgaatacgtagtttgatgatggttagtctcttgccagtttgagaaggggtagcacctctttggtctaaatgcattctaactaggattaagattatgtgttatgtttggttggactgttagaaactccagcaactcagggtagacattgttgggtatcattgagctgcaaaactaattatactgcaagtttataaagttgttaaagtggcactacaactgcaggagtatgttctgtgagccagtttatgtttttctatatgatagacatttctatttggtttgtcacatcactgtaatttaaggcatgacagcatcaaggtgatcattttttcccgaagttgcttccctttactgcctgcatctaaatggaggcttcagagccatgaccagatcacatgctagatgcaagtccaataaagagacttcacccttaataacacccgaatgggtgacattgaggtacctggaactgctcctggtaaggcttcataggtggaggaaatctttgctttgcaaatgcagaggattggcaaatttttaaatttttttctatatcagggattgacatttgggaaataatttgcctcctctatgcttggtttctacatttataaaatgcagatttagtatgaactaatttgttttcctcaaggtttgagatctgtatctcatctcatgacagatggcccagaataggtgaggggctgttctgaattttagataaacttttatccccattcagaaacccccttctgtgacccttcattaaatcaaaatggcaacataggaggagaaagagaggggtttgtgaggttccatgttgagaggaatggattctggctttattgatggcttctggggctctgtcgtcagttaccaatagtgtttccagtgatttaacttgaggtggcttgttatatcccattgggcttcatctggtgaatgcccttccctttctttcttgtctaaaagatcttgaacctattcatactctgtatgaggtatgagtgctcttagatttttcaagatgagtcctgattccagctattccatctcaagcaatcatacaaagttgaaatgtccctgaaatgctaaccttgtggcctaggcactcaaaaagaatttacaaatcatttgtcagaccaagttatgatttgaattcagaaaatatggacaccgtcaataaaatgcttctcgctgagctagtccttgactagaagtagcacttttaagagtggtttttagaaacctgagaactctaaacataaatgaattcagtgaatttgattacgtgtactttggtcatagaccagcagagagatgatatttggcatatgtgtggtatccactgtggctgtcatttctctactttagaatcatcccccgcagggcttttctctgctcatccacttaagtgctgcacattcctcgtctgggattccagtgtccaagaacctgtttcttttgccttgttgactaggctctggctgagtttattaaagcaggaaggatgagctttctcagcccaaattcagccctcaggccagactaggatgtgccttttttttttttttttgagacagagtcttgctctgttgcccaggctggagtacagtggcacgatctcggctcactgcaacctctgcctcctgggttcaagtgatccttctgcctcagtccccctagtagctgggattacaggcacataccaccatgcctggctaatttttgtgtttttagtagagacagggtttcgccatgttggccaggctggtctcgaacttctgccctcaggtgatccacccgcctcagcttcccaaagtgctgggattacaggcgtgagccactgtgctgggcctttttttttttttttttttaatctctttgtaccacccgtgctggagagacctataagccataggagctcaccgtcttacactagagtctggattctaagtgctatattataaggtggtttggcattgtgtgtgtttctttagtaatgggcatattaacgtcagaacagaggaagtctagaaggagtttatccctggccaggttgagagactgttagagtgaacatgcagccctttgtttattgggtctcagactgtgcacagcttattagtatagttagtttaaaaacgagtaaggaggtaaccagggagccataataagttgtttggacttgctttcagtaatccatatattaaaagtcctggtgagaggaattatcacaattatttgcattttgcttagcaggctagagtttaccaagtaatttcatatattttaacttttgagctttctaacaggcatttgaaatagggcagcttttgttccattttcttttttttctttccttctttttttttttttttttttttttttaagacagagtcttgccctgtcacccaggctggagtgcagtgacgcaatctcggctcactacaacctccgcctcctgggttcaagcaattctcctgccttggacctcctgagtagctgggattacaggtgcatgccactatgcccggctaatttttgtatttttttttttagtagagatgggggtttcaccatgttggccaggctggccttgaactcctgatcttgtgatccacctgcctcggcctcccaaaatgctgggattacaggcatgagccaccgcacccagccgtggactccattttgtatgtggaaaaactggagttcacagatgtgacctttccataactattccaagctgataagggtttctgactccaaatttaaggcattttcctaccatactttgaaagatgtattgaaatttagtagggctttttatatgtttgcttttgcctttctttaggcatatacgtggtcttctattttagccatggcgttgagttttgattctgacgggtaggtcagtggagagaggaggtcacagccagccgggagagagacttccaccttctccctttcactgttctaggtcctccttgggctcgctggatatcgaatcctgtggtaaaggagaagacaggtttcaggagccttgtttgtgcttgagtcaatgttagtaaagcaatatcgcttgtatactgctttgcaatttaaataggatttgtgataagttgttttatgctgttcgccacagtgtttgagtgggagtgataatatctttatcttaaagataaacaactgaagtcaccttgcttgtaattataacttgaaccgaggtggtttgactccagatctcttctagtaggccacggttggcagattcagaggctaaaggtccagatgaaatagaaaaattgtgccattgatagcattttcagtaacctttaagaagaaaagagacatattcattagttaccctgatagttgggtcgggaaccataaaatcacctatacagtcctgaaagacctctcataccatcagagagagaaagagagagagagaagccctggttttctagtggttccagttactatataaaaataattacagaaccaggtcctgctggcctttccctgaaatagattaggcccttttggagctctgttaactctttggagctattcagatgacattaaattattttttctgtgttaagtagaaactctgagatctatagagaagcccagtggtctgtataaagaggtccttggctaaatccatggctcacatctgtaatcccagcactttgggaggtcagagcaggaggatagcttgaatccaagagtttgacaacagcctgggcaacaaagtgagaccaccatctctacaaaataagagaaaaaaattagccgggcatggtagcatgcacctgcagtcccagctacttgggaggttgagatgggaggatcatttaagcctgggatgtcgaggctgcagtgaactgtgattgtgatcacaccactgcacttcagcctgggtgacagagcaagaccatgtcttaaaaaagtcttttttcatattgacccagttcttcccagttctttctcacttgatatttttaatacagtggattctttttcactcctgtggtagaagggactcccaagctgtggccattggtttgctcagcaagtatttaaatatgttgtcatgcagtctgtgtgccaggcactgtacattcatatgtttaaaacttcagtctctttagtgccctttgtgatttgtcttttcttaaattctctgaaaggtatggactttggagccatgctgcctgaatttgaatcctggctccatcatttactagttgcatggtctcatgcctcagtttcctcatctgtaaactgaagataatgttagtaccctctttatgaggcagggttattgtgagggttgcataattgatatttgtaaagcacttggagacagtgcctggcacataggaagtgctaatatctacatggcctaattgcccccctcctctcttctcaccagccttggtaaaatcagacttccttctctctcctgggaatatatggcccatcgctaggcccctaagtctgatgtctgctctgaagagttgatagtggagagaaggaacattacccagcctgttatttcttctctgtctgtaccttcttcccgtgttatcatttctgttcccattgctttaaatatccattttgtgtaggcaattcccaagtgtaaatcttcagtccttagtttctgccagaacttcagaccgacttaaagacatctccatgtgggggggggggggggggtcttagcattccaaacttaacattcctaatataaaactcttttttttgtcctgaaaacttgttttttagtaagtttttcccatctcgttacgtggaaaggggaactgattgcccaagtcaaaaacccaagagtattttttttaactccgctcctttacattgagtctgtcggcaagtcctgtctgtgctgcttctagagtgcatcccactcttctacctccctccttgcctttcttaccaccccagtcacttctcgcttgagctgctgcctgagaagcttcctcactagtctctctgacttccactcttttctacagtgcattcttcacacaataaccagggtgagctttcaaaaatgtaaattggattgtgtccttccctgcttaaaagccttccggactcccaattgcccaccttgtcagtcatccctttatctgttcacgtctgttacatggtgtttctgcactggaatggaagatttttgagaccatgggtattggctgtatcattgcataattcccagtatctggtgtataatagttgtgcagtaaagacttcctaagtgaacaagaacatgctcttattcttatttctaatacatttttcactcccccacgccgaccctttcttttttccttttttgtaaaggatgagctttggaggatccaggagaagctggaatgttactttggctccttggttggctcgaatgtgtacataactcccgcaggatctcagggcctgccgccccattatgatgatgtcgaggtaagagatggagaaaattgccccatgttgggaagaatgagttgttgagagcctggtttagtagagttgtcagggtgagttcacattattctctaaggctcttaggtctgtattcgctctttctgtgcagtttctgagatattgatttcatcaaaatgttgggccaaagtaaatcccactaaactggtttcctgctctgtctcaaaggaacagcttgtttccaaccttactaatttaaagagccacacattcgtctgaaacaagtatttattgaatttatctacagaaaggtgtgcttggcttttcctttaatttcacaaagtatggtctttaataagatgaggtcacaaataatccttcatgtgctttcattttgttctttttcagtagctgccaaaaatatgtatatattttccatttgtgaaaatcttggggcagcttgaatgagggtcatggtttcacttaagcattggcatcttgacaagtgttgatttcactctgatatggcttccaaaaaaatttaactctttggcttatgtattccatagttttatttttgtcctaatataaggtgtaaacacagagttattggtaaaaagtcccctttttctcctttgatagcaatttgacatcaatacattttcacaaaatgttatttttaatatttttaatagaatatctttgactgaataaagaataaaaaactcgaagttttcctatctccccaggccctttcaacattcaggatttagacattcagtaatatctgaagcttggcttttccatcagagattatgggcttttagctgtctgatagaagatttaaaggaatgagatagtgggatataaagaactcagcgaggctctaagaaagtgaaaagaatgaatatccagtgtcaggattcacgattccgtttttaaaaataaaacccagtagtggcaacttttgtttaactgtggaatgacatgcatttctcatctttcatttttattttttatcggaaacttgacccttgtgcagtgtgggggttagtggtgccaacacctcatgcagtcaaaaatctgcttgtaacttttgacttccctaaaacttaactactagtagccttccattgcctagatatcttactgatagcataaattggttaacacttattttgtatgttatatgtgttatatactttattcttcagtaaaggaacctggagaaaagttattaaaattataagaaagggaaaagtatttttaatattgtgtttatcagtaccgtaagtttacatcatttgtttacaagctgaatcgtccatctgaaatggtgggtagccacagctgcaggccttaatctacaatacacatcaagcaattcaactttttcttgtaacgttacgacttttttctgtttctcgggagtacttgcagtagcagtagtggcacatcatatgggtcccatggtgttattcacggcttaagttgttgcactaaacatgatgaaaaatacacaagaactgttgagagatcattttttactgtgatacacaattcactggagagaggaactgctcatgtggagataattagcatcacacttgagctcgtggcaatagcaacaggaggtagcacaaaattattacagtagtacaatatgtactaaagttaattttattcagctattccatattgcatctttaagtttgtttacatttcttgactgcaaatggtggtctagaagtatttgtataggtaagttttgataaattttaaccttctgtaatagatttgtgaatattttatggtagtagatgatagactagtatctacatatgtttttatatttgatgcatttatgacattcttaattcttttgatatttttcatgtttttcaaattgttgcaaatctcctccaaattttccaatataatttattgaaaaaaatcagcatataagcggacctgcacggttcatccccatgctgttaggccaggcgtggtggctcacgcctgtaatcacttttggaggcccaggtgagaggagtgcttaaagccaggagttcaagaccattctgggcaacaaagtgacaccccatctctacaaagaagataaattagctgggagctgtggtgcatgccagcttcccaactacacaggaagctagggcaagaggatcattggagcccaggagtttgagaggctgcagtgagctgtaattgtgacactgcactccagcctggccaggagaatgagactgtctataacaactaaaaaaaaaaaaaaaaaaaaaaaacctgtgttgttcaaggttcacctatatatttgtctattagccccttagagggctaatagtccggaagcactttgtgtgtgagttgtcaggaagctctctgatgctcctgggccttgtgggtctctaggttttcatcctgcagctggagggagagaaacactggcgcctctaccaccccactgtgcccctggcacgagagtacagcgtggaggccgaggaaaggatcggcaggccggtgcatgagtttatgctgaaggtatgtgataaccgttgtgggcacctcattgttagagccattgtggtttcccctattgctaagacaagttcaggctcaaggtttagagttcgtgtgatggtccccgtgggaatatatccctgggtttcagggcagggtgcttctcattgctgtcagccagcacatgtaatttctgaaggagtcttggtggtttgcacttggagaagtgggttaaggaagtattaagttcatttcccaaataacctgttttcatgtacagttcaagtccaacaggaagaaagagaattcagtgaaccactgactcctctagaggaaaaatggaagctctggccttgggcagcttctccacatccaagacgatggtcagcacagggctggaagttgcttaggcagaacatagccagggatcccttagttttttttgttgttgttgctaaaattccagtgtgactcattttcatcctggttatatgtcaggctatctctgtgccccctgcatagttaccagaacagtagtaatcaggaaagttcttgaggattccttctctggggattcaggtggcttaatcatgtgcaggttccttggcatcttgctgctgagaaaatctgtctttgagcagttaacatcgatgggaacatagccaatccccagcagaagaggttgttgaggaaaagaacgttacatggataggagtagttccataattcaactttatactctttcttaaaacatgtaacttaatttcctttagcaataaaacaatagttattttaaaccattccaaagattctaccaacctgacacatttgcatatacttattgtttttcttgtgtctcgaagttataattagcctgtttcttactcaatgccttgtgtgtttcttgatttcaaaatccttacctacctcccagtaactaagggaaacaatcttgctgtttaggatgggtgcctatattacaggagacttaaatcaataaacaacagtaaaggtaaccttactggttttttttatgcttttagtcagtggtcatcaaactgtggcccatggaccagaaaatctggcctgctgcctgtttttgtaagtagtttattggaacacagccacacccattccttaatgtcctgtgttcatactacaccagcagagcggactagttgccacagagatcacatggcccgcaaaccaaaaatacgtactgtctttccatttggctcttcacagaggttgccagctttgttgcatcatgtttacatagattcacggttggttatctttaaagactaagccatctgtactctcggaagtcagggctgagttactcaggccggtgacctggctacttgctctgcccgagaaggtcaggcttcatagtggcctttaagtgtaaagggtgtggattctttgtattgttgccatgcccatgcccattaaacagtcaacacagagtccattaggagatgcactgagtctcctggacagagaaagaccatgttgtacagtattgttcaagtgtgtatgtgtatgtgcatgtcatttttttttttttttttttaagacagagtctcaccctgtcacccaggctggagtgcaatggcgtgatttcagctagctgaaacctccgcctcccgggttcaagcaattctcctgcctcagcctcccgagtagctgggattacagctgcctaccaccatgcccggctaattttttgtatctttagtagagacggtttcaccatgttggccaggctggtctcaaactcctgacctcgtgatccacctgcctcggcctcccaaagtgctgggattacaggcgtgagccactgcgcctggcccacatttgagcttttaaccagtgggcctcttcaggcgaaaccttgtgtcaatgcccaatgatgaaatagaaaggcttagtggctgtggttgagggatgggcatgggagggtgacagtgggggtcttggagcccttatccgcttctttcccctatgctagtggcagcccgtgcagttcatctgcagacccagactcccaggatgagatcacgcctgtgatggaaacaccactctgtggctcagggatctgacagatctgagtttgaattcagctgctgtcacttattagctgtatgtccttggtcaagttattaatccaagtctcagtttcctctttattaaaacagagatcatgatatttaccttgcaggctatgaggattgaaaaatattattttgctgcctcctttacaataaatctttaggcggggtgcggtggctcacgcctgtaatcccagcactttgggaggccgaggcaggtggatcacctgaggtcaggagttcgagaccagcctgaccaacatgtagaaaccccatctctactgaaaatacaaaattagctgggcgtggtggctcatgcctgtaatcccagctactcaggaggctgaggcaggagaatcacttgaacccaggagatggaggttgcagtgaccgagatcacgccattgcattccagcctgggcaacaagaacgaaactccgtctcaaaaaaaaaaaaaaatctttagaggcaatatctgtatgtctgtctgagtttttctgttgcttcttgtcaaattaccacaaactcaatggtttaaaacaacataaattcattattttatgcttctgaaggtcaggagactaaaagggatctctctagggttgctgtactgcattccttcaggaggctgtaggggagaatgtttacttacgttttccagccaggagggtggggcaaatgtgtatgaaatgaatgaaatatagtcatgtgccagttgacattttagtcaacaacagactgtatatgtgacagttgtcccataaggttataatgaagctgaaaaattcctatcacctagtgttattgtagccattgtaaaatgttgtagtgctacgcattactcacgtgtttgtggtgatgctggtctaaacaaccctacttctttgctagtcatataaaagtgtacagtagggccctaggctctcccattcacttaccatcactgacgggctcacccagagtaacttccagtcctatgtagatgtaccatttattattgtttatactgtgttttttcttgtccacgtttagatatatttaagtacacaaacaccattgtgttacagttttctacagtattcagtacagtcacatgctgtataggtttggagcctaggagcagtaggctgtaccatgtaatgtaggtagtacactatactacctagatttgtaagtacactgatgtttgcgcagtgacataccacttttctcagaacataaccccattgttaagtggcatgtgactgtatacctgagagtctcactcaggctggcacagagacactcagtaaatgatagttataattatcagtaaagcatttacttgaagtactgtcagtttgttgtcattcagggaaaatttgcaactaagatagctcttatgaatatatatcatgatatattcctcttgctttgaggagaatcttaatttttttttttaagctggcatttcttgagctctttctccagggctcatggtcttaaccattgcactagactacctcttgtagttgcagagagaagatgagctgccctcaagattccctcttttctccataggtagctgctacatggaatattttggcctgagtgggattgggaaggaggcagctcagggcaggagtaatttggggagaatgttttggtccacccacttggaatagggtagaggaggctcagctgcccaagaaaatgatgaatttttgattacatcttatttttcagttgaaatagggattgtatagtttttcaattcatcccaacattcattgagcctgtgttgagtgctaggtgctttgctagggtaggctctgggaaagacaagatggtaagatacagaccctgcgcctagaagtactcaaaaattatcaggaagtgggggactggcggataaaatcatataatccaatcacatgcccatcattgccctaagagcttggaagcagcatctctaatcctcaaaataatcctgtaaggtttggggctattaaacttcattttacagataaagaaactgaggctttgggcaggtaaattgccagatcatcagccagtaagtggctgtgtctgtgtgactctaaattcaagctcctactcttaaccactgaagcatgcaagagggaggaagcaggcgtcccaggcacaggatgttaccttccttgatccctgcatcagggcagggtagtctcaggtgagtctagtctcagcttgagaatgaaaagatagtgacttcaggcaccgagagcctctcgtggatcatggttaacagtgacaggctcacggacacagagaagctagactagctgcacacgacatgagcccagcatatagactgtgccttgaggttgtggtttctagaatggagaactgagactcaaagcccatatttatctccctgaaatgaagaggactgagaaggaatacttattaacttctctaccctttcctattccttcctttagccgggtgatttgttgtactttcccagaggaaccattcatcaagcggacactcctgcggggctggcccactctactcacgtgaccatcagcacctaccagaacaagtaaacactgcctcccagctgcacatgctaggacagctctgagtcctggcctgcagcagccacattcaggagggatatgagggagttggcccctacctcctatgcaaaccccagggtttatgtcctttactgacttccacattcctttgatgtcccatgtatgtgactggtccctctggacttgcttctggggacatcatgaacctgactctgtaggatgtggggcattgcccaaatagagagtcacatagtttggaaagaaagagactagctgtgggtacatcagtgtgttagtgatgccaggctgggctcatactctctctctttttttttaatatgataaaatatatagaacataaaatataccattttaaaccattttaaagcatagtttgacattaattacattcacactcttgtgcagccatcaccactattcgtttctaaaacatgtttattccaacagaaactctgtacccattgaaatctcttggtctctttgagggtttctctttttacagtccatgaagttaaagtaggacaggcagtctggaacagcaggaactaaagtgcatgtgctgacagcagttccaattaaaatcatgttcatttcagctagtacctcctcactgggtggcagtgctgtgtgagttatatccaaaaagcagcaaccttgctggtccaaatcatatttaaaaatactaatcatggccaggcgtggtggctcactcctgtaatcccagcactttgggaggctgaggcgggtggatcgcttgaggtcagaagtttgagaccagcctggccaacatggtgaaaccccatctctactaaaaaaaatacaaatattagccaggtgtggtggtgtgcacctgtaatcccagctactctggaggttgaggcaggagaatcacttgaacacaggaggtggaggttgcagtgatccaaatcacgccactgcactccagcctgggcgacagagcgagaccctgtctcaggaaaaaaaaaaaaatactagtcatgagttaatgtgttaaacaaatatgtactagacattgtgtttgttgctgggaattcaaggattttatcgaaggggttttgagagagcttatactttggaattggttgtaggagaagagatggtgtgataaattctattgtaggtttgcagaggagactcttggagcatagaggaatgcatttagctaagtaggggcattagagaagccttcagaaatgacaccaatgctgagtgagtcttaaaggatgagtaagtaggggtgggtcagcagatcagagtaggagaggacattctaggtccaagggacggcaagtcacctcctaccttcagggccagaacttgcaaaacaagttagtaagcatacctctgcttcctcatcagacttttcagtgtgaatttcacctctacatttaaaagacttactggaggaattagctgaggcctggccctagtttagtgctatctttcccacaagtagaaggcccaagtttgtattaggcttccattttgaaaaatgccctcatcactttggctaggtaggttccttgcattttaagggacagaaagtcaccaaagccagctcaagaagtgcagggtcacttgagggagtgagtcctagaaactccaggctacagagaggctggaattagaagtccattctggattcagagcagttctggaccacatagtttggccctttgaatatccgtgcatctgtgggtgtcccatcgttaatgtttctcaggtactccctttctgtaattctcttttccatttctcttgctgctaccaactggttttctagtgactggtgttttctcccttctgttccttcttcagcttctgtttactcataacattaggccatcaccagttgctactctgacctccatctcattgaccctgttagcttttgcttctgctaaggacctgactcactctctgtttcccaatcccaagagtgaggaactggccggctgcccctgggtcctattcatttcttctcttttcagctggggctgggaagagcttcctaagttacagaagttgcctgcttaggattgtgggtgggtaccatgatcaatgtgtccaggctggattttgacctgtgtcttggacagtgatgctggagctagaatgagaagatgtgacttgagggccattgctccccagaaatgatcctgtgttttgagcctaatgctccttcaggtaccatgtaaaggtgaatatttggggcctcttcctaacacctgtcaaggtagcattgttggagtgtttgggggtctgctgtatgttgttgatttggttgttttaccaaagtggacccttcaagagatattcctaaattgtgggaagtcccaatatctattctgactcttagaggagcactatttaacttctactaaattcctccatgagctgttgctgtatgacttccacctacataaacctgcaaaggaagcacatattgtatggtgctgagagatctgcatgtgccctccgggttgagactcaattaaagatgcagggttggatataacattaagtcacaaagcagtgaggccgccaggtagtagatgtcttgggaaaagtgtctctcatgtggcttttgtcctcctttgcaacttttctgggagggaagcataacagtgttaattttgcttactgagtgagaagtaaaagtcatactgtgaatttccattttctactagccggcaatttgaaatctgctggtgacacaggaaaattttaaatagctaagaaatgtttaaagagagcatccccacagagtgcatttcttacaccggcacgcacttaggaatgagccaattccagataccccagagaaagcaaaggtaattgaatagggatatttgtccctagatgttatttttagtcactggcttctatcccccggtaaaaccactgctagacataattgttttggaattattgatggtagatattttctttaggagtagcatcccttgtaagtgacaaggaaaatgtaacatacaactgttcaaataattacacaatccagatatcttgctgttaccccaaatttgttgtatttattgcacataaaatttggttttagatcctataatgactgtttaaatttcctacaaatctcccctcatagacacttttgttaaaaatttggtccattgaacttcctgttttatgaaagtctatggttaattttctgagagcttttaagagaaatcagtattgaagcctagcttcccacttttaactttgcaagtgagtgtctggaacggggagggaggaaacagggtggttgatgaaggtcttagatttccatgctgagtaatgtccaattaatggaactcaaaatgcctggacagggaagccataatccaatttgtagcttttggctttactagcaataagtattttatgtatatttcgtatgcactcactgttttggtttttttttcccccttggtgcatatcctagttcatggggagatttccttttggataccatctcggggcttgtatttgatactgcaaaggaagacgtggagttacggaccggcataccccggcagctgctcctggtaaggagtaaaggcaggtaggaatgaaggatggtagctgcagcccaggccagctgaagtcctaccttaaggaccccaggatacttcttccaacatgagccaggcttgtctactgtgctgcactgctgagctgtgtgacttgcagaatgagtggagtgccatgtgttatgtggtgatccaaagaactgtgatgttgtacagacagctctgtatttcacagtggcagtagcaggcagtgtgaaaatgttggttgagtaaatgaatagtacggccaggagaactgtagatttagcacacatcagattactagttaagagaaactcactgtactggagatcctggcctcggtgtattcgttggcctcctgttcttttattacattttgaaacaggagtgttatttgattagttttgagatgagtggattagagctgagttgagcaaaggttgctttctctgaagcattcatcttaggacagtgacctgctttccaaaaggcagagctcagactgtaccatatttccaaggatctctatttctaggcaaaattctgaaaattttttgcaaacaataggcagcttagaattaacagtgtttataaggaaatgatgagatatcattcttaggggctcaggttgtcccttcccctttggaatgacatggattaatgtctatacccggtggctggcagttttgcagtctactgtggagactgagctgggcagtaagttctgctggcatctgggccaggactcacttctgtgttcctagcaggtggaatccacaactgttgctacaagacgattaagtggcttcctgaggacacttgcagaccggctggagggcaccaaagaactgctttcctcagacatgaagaaggattttattatgcacagactccccccttactctgcgggagatggggcagagctgtcaacaccaggtggagcttgctgttttcttctgggtggtcagaggctaatgcaggatgtttacggtttttctgggtaggctcctttttgaacagatggaaagtatgaagtgctttcgtgttaatgtggaccacatccatccttagtgaatatgggcagacgagatgtgctgcactcaacctttagcaacctgtatcttagaagtcatttggaaagaacttgtatcccaccctgatgggaaataagagccctgtccttttgggtgagaaatatgtatatttataggtactctggtattcatagtcttcaggaagttttcaaaatttgaacattgaaataatcttgttggaattaagtcagggttgggttgtctttatttgtgttgcttaaaggaatacctgaggctgggtaatttatatagaaaagaagtttatttggctcatggtctgcaggctgtacaagaagcatggtgctggtatctgcatttggagaaaacctcaggctactcacagtggaaggggaaagggagctggcatttgcagaacacatggtgagagaggaagcaagagcgaggagaagtgccaggctctttttaacaccagctgtcatgggaactaatggaacaagaagtcactcaccgcccccaaccccagggaattatctattcatgagggatctgctccccacaatgtgacccaaacacctccccttaggctgcacctccacactggggatcaaatttgaacatgagatttggatgggacaaacatccaaatcatagcatgggtaaaattgttaccatcagccagtgagattcaagaaatgtccaagattatcatcaaccttctccaaggcacaggtgcctaatttatgacagatttaggctgcaaatgatataacatacttttggatggatgatgtcattgatgacttccagatggatgatgtcagtatcctatagcaaagaccaccaagaacatactcctgaattcagacgaaattggatttattgacttgttgcagtgggaagaccacacaccattgagaactgcagggcatctcagtaaaacggtgttagaaaagacttataggactcaggtgtatgttaggtgattttggagagggttcaaggaagcagggctttgctctggattggatgctgtcaggaaatggaagggattctatgattaagtctcctaaatgttatctggtaggcaggaggaatgtatgaggctgaagttatcaatggtaaagcggaagtggtcactcattagccagagtagggggatgttcggtcagtgttgtggtttggaatatgttcttgccttgcctgagtccagacatgagtatgtacggagtggtggtgttttgttttgacctatcatggtgacagtgatctctgatgttagcattctgtggaattgcctgtgttcaacaggagaacacaaagacctagctgtgagtgccaggccagctttttggctgctgttctttctcagggttgagtgaaaagagtattttttactaactttaataaaactcttaattatgaccaagagagaaccactgagatagataatctataaggtcccttccaacactgattctatatacatttttatcatagtctttggaggaagcttagaatttgtttttgattgtatctattcaaaatagcaaatgttttacaagcacatggtttaatctttagcagaacagtttgcttatgcaccagcttatggcccagactacttcagtgttttccttatcttaggcattatactcaataaagtgatgatccctcacgactccttccccacgcagatgaccctgtaaggctagtctgtttttattgggtattgttccactaagttaaatccaatttggaaaaaaaaaattttctgtggactttattagatggcttttataggatactattcttgacttacatagactgaataattgaccagggtcacacacctaataattggtggagtagtgcaattttgaactcaggtagtacttccagagtccatatgttgagcgagaagcttgtagaggacagaacctggaggagtgagtgttctgtgcagaaagcaccacagccttatgtgctatgatagccactgtacttcgatggtattatttttgtctatttattgtacttataaacttacattatttatctatgtctgtcttcactgtaagaatgagctgcataatgatgtgaactataatatcagtacaatgttggggtaagcaaattcttcagttggagtgtatgccatgtttggattcacctgtaaattgttagtaaatgtgtttcctatgtgtatgtataagcaagtttgaatctgcctgtttccttttttgaaggtcggctttctctctttggggttttctaggtggaaagttaccgaggctggacagtgtagtgagactgcagtttaaagaccacattgtcctcacagtactgccggatcaagatcaatctgtgagtatccaagaggaggagatttcctgtcttctcagggtgtttttcatcagaggcctcaggttattagattaaccactggtctctgcccttctttaggaatccacctgcattcagtttaatgccatttcttcaggtcagatgatgaccaaatctcacagttccaattccatattttcttgccctcatcctcacagaaccttccttcatcccctttatgtggtgattaatgtctggtctttgcttctcatcctacttcgggccttactgttcttgcttggacagccacagacctcattcctgagtttctcagccccagtcctccacactgtgcagatctatatttctatgtggttttgtggatattgttgcatctccttaaactctatcctgtagattatggagaacaaagtatatattctgtaattttgcttcctagcccagtgattccccaaactggctaactgatcatggagtcaattggaaagctttttaaaattataaattcctgggtttcatctggtcttggagcctttggatttatgttttgatagagctccctgtacagtcctaaagaccttggaacgatctcataccatatggctccacctcattcctcctaatcagctctctaaggagctatcccatgaatgatcaagggggatgagaggggcactcaacatgtctcgataaccagattgttccagccgtcagggccagagttggaatatatatatgaatatacatgaatagatatatatatatatatatatacatcctcaaaagtacacattcctacatccctgtctaaaaaaaaaatagtgattctgataaccagtcagtttgagacattgtacgctaggctaagatttttttgcccttatctaagaggtgacaaagaatgactaaaggctctggaagagacaataaactgcactgtgtaacatggggagtgaagggagatagggaccatttgggagggtagtgtaattgaaatggagttttttatcgatcacacagctggtatttctcaggagttaatgacttcatgattataaattgtcagtttatacctagaaatgtcagatttttttattcaaaaaagatagtgcaggtatgattaaaaaaactgaggatttcattgataagttgatacataaatcactgctttttcattaaatcctgaagatgctcttccaggtagcactccagctgttttaacaacttagaatgcccattaattgccacatacaaatagtaacctgtggtgactaatgaagtatagacattgtgtggatgcacacacccgtcactttttgccaaaaggattctttacagtattcaataaatttcacttgagcaccaaggcttttgaaattttttttggtgttgacctattggaaaaccttcctagtactgacaccttcagtgttgtgttgttgatggcctaatgcatttattttttccccaaaggatgaagctcaagaaaagatggtgtacatctatcattccttaaagaatagtagagagacacacatgatgggaaatgaggaggaaacagaggtttgtttcaactgaaaacaaatgcctatcctgtgacttgggtggtggttgggaagaattgattatttttgatttacaggtaatatgctttttatggctgcactgtggacttaaccattttgcactactcacagagctcctgcatggggatgattaagtcagacatttctgtgatacatgcacaccagttttaagacatactagctgggacctgtagccttataggaatggtataatgtaaaacatttcaaattactaatatcacttactacataaattaggatgccttttatatagaagttggcatcttttatgttatctaattgtagtgtgtctaaaatactcatgaggggtatcaaaaataatgatgtatggagaataaatttacaggaaaatgctacttcaatgacataagtagtatacatatattttgacaaataaatttatcctttcagtttcatggacttcgcttccctttgtcacatttggatgcactgaagcaaatttggaatagtccagctatttctgtcaaggacctgaaacttactacagatgaggaaaaggaaagcctggtattatccctctggacagaatgtttaattcaagtagtctagtgcctttgcagaatcaaatgcctactattttatatgcatatattaaaagaaaagcaaagacctgagccgaggagaggatgaattcaagtttccttacctgcgtatctactaacaaacatgagacctccctgttacaggtggtcagttggccaaatgtactaacgggcacatgaaagaaagaacagcaaattaccaagtgtctcagaaaatgacaaaaccatattttgacaagtttatttaatccagtgtggtagaaaaggcacaattccaatgtatcatttagaattgaatgtcattaacctggctttgttctttggaagaaacaacttctttaaagagcttctttggctctagaaaaatttcaaacaattaaaataagaaaaaattttaaactggttttttataatgaaaatatacatacctttgtgtatagacaagcccatgcccattaaaataaagttatcctgtaacataaattttattaaataatacttccccacagatgagaggcacgcaacacctatggacaaaagggagttacagaggctgcttaaaagatggagaaaagcctgagattgaaggaggaaaaaaacccagtatttaaagtctataaaaaatactcaa

SEQ ID NO: 37869 - DNA, 64529 bp, Homo sapiens
caaactgagtgcgctgagcggggaagcgcaaaggggcaagttacccgtcctggcgtttctggggttcgcctcggaggctagcctcggtgctctcgcaggctcgctcgcttctgcatccccgttgccgcccggagccaactcttaagttctggacgccaggcctgaggcagttccgccatggacttctccaagttcctggcagacgacttcgacgtgaaggagtggatcaatgcggccttcagggccggctccaaggaggcggcgtccgggaaggcggatggccacgcagccaccctggtgatgaagctgcagctgttcatccaagaggtgaaccacgccgtggagggtgagccgctcggggccctggccgcgggaccctcccctgctctcggctgggcagaggtcaccgaacttgcgtgaggcactcaggtgggcggggcacgcatggacagcaaataccctcggcaaaagagcaagccccgaactcctgatcacgtcagcgggagtctcagctgggtgccgggctgtcttgaacacttgctaattttgggtgttgtttttcctcctctggctgggctataagtttcctttttcttttctttctttctctttgttttttcttttgaaacagggtctctctacagtggctcgatcatagctcactgcagcctcgaactcctgcactcaagcgatcctctcgcctctcgagtcgctaggactacaggcgcgagccaccgcgccccacaaattctgtttaaaaaaaaaattgtagagatgggatctcactgtgttgccaggctggtctcaaattcaaattcctgggcataatgggttttccagtcttggcctcccaaagtactgtgattatacctgtgagccaccacatctggcctgaagtttccttttggaacttaaaagagtggatcttattgcagtagctcttctctaaataattcaatagcagatctctgggattccctttttattattatccataggcactggaagacaagatggatctttttaaatgctagaagttttaaccagttcttaacatgtctttgttgaggcaccttccagaatataagataaaacaactccagtttctgttatagtgacttgaatctcagagtcaagagcccagtgtcaaagaaaattggctttgactttttgtaatctaggagcacgagtctgtgaggtgtttattcaaagagttaaagagcctgttttgtaccaaacaataaactgtaaaaagaaaaaaaaagtgaattttgagagtatgaaagaatagccaacagatccatatatctggaaaaaacgtattatagtataggtataagagaatgacacagatctagaaaacattgttttagtggattttatttcagctgaggaagataggctggtctcagtggagacttaaaccttttttttttttttttttttgagacagggtctcattcctcattctgctgcccaagctggaatgcagtgataccatcatagttcactgcagcctcaaactctgggttcaagcagtccgctcgcctcagcctcccaagtaactggaactataggcatgtgccaccatgcctggctaattaaaaaaaaaaatttttttttagagacaaggtcgcactatgttgcccaggttgatctcaaatttctgacctcaagtgatcctcccatcttggcttcccaaagccctaggattactggtgtgagccaccacgcctggcctaaaccatttgttgaggataagttaaattataaaaaataacatgcactggcaaccatttcatgtaactcctcaacttgacttttattcaccgtgtgttgattcactgtgtgttgattcagtacgtactgcacacaagtctctctcctaggctcagatggaaagaccaaacagactgcttccactgggagtggatagtccaagagatgttcccatttttgtttgtttttttgttttttttgagacgaagtctcgctctttccccctggctggagtgcagtggcgccatctcagctcactgcaacctcccccttctgagttcaagttattctcctgcctctacctcctgagtagctgggattacaggtgcgtgccccacccctggctaatttttgtatttttagtagagatggggtttcatgatgttggccaggctgatcttgaactcctgacctcaggtgatccacccacctcggcctcccaaagtgctgggattacaggcatgagccactgtgcccggccagatgtgcccattgtttaagaaaaggtagggagggggctctatttcactgcagattgttttctttctttctttttttttttgagacagggtctcactttgtcacccaggctacagtgcagtggtgtggtcagtgctcactgcagcttcacctctcgggctcgaggaattctcctgccccagcctcctgaataactgggaccacaggcttgtgccaccatgccagatggcacaattttttgattttttgtagagatggggtctcactatgttgtccaggctggtctcaaactcctgagctcaggcgatcctccagcctttgcctcctaaagtgctgggattacaggcgtgagccaccgcgcccagcccttattctttattgtaccttgcatcttttactaattattgagcatctactatgcatgtgtccagaaatgggcagtggggaggaaaagtttatcttgctcgagcttgctgcctttggggaagatagaaacagtaaattacaatgacggatggctttactcagaatagaatctggagttgtgagaactgtcaggagggtgcagttacttcttgtttaggagaatcataaagcacttgccctgtgttagaccttgaaggaaaactttgtagggcaaagaggaaaggacattaataataatataatagcaaattggctgggcgcagtggctcatgcctgtaatctcagcacttttggaaggctgaggcgagagaatcacctgaggtcaggagttccagaccagcctggtcaacatggtgaaaccccatctctactaaaaatacaaaattagaggtgggtgtggtgacatgcgctgtagtcccagctactcaggaggctgaggcaggagaatcgcttgaacccaggaggcagaagttgcagtgagcagagatcccaccactacactccagcctgggtgacagagtgagactctgtctcaaaaataataataataatgatataatagcacatatatgaggtttggtacatgtcagacactctttttggtgctctatatgtattaactaagtgattctgaaacatgggttgcaatgctttccttgcctccccttatccttgttcctgccctcaggaacagggactatttggaaattggtgggaggttttttttttttttttgagatggagtttcaatcttgttgcccaggatggagtgcgatggagtgcaatggcgtgatcgcggctcactgcaacctccgcctctcgggttcaagcaattctcctgcctcagcctcccgagtagctgggtgtataggcatgcgccaccatgcctggctaattttgtatttttagtagagatgggttctacatgatggtcaggctggtctcgagctcccaacctcaggtgatctgcctgcctcggcctcccaaagtgctgggattacaggcatgagctattgcgcctggactgtgggagcttttttatttattttatttattttttattttattttattttattttattttattttattttattttattttaatttaattttatttttttgagatggagtctcgctctgtcgcccaggctggagggcagtggcgtgatctcgacgcactgcaagctctgcctccagggtttacaccattctcctgcctcagcctcccgagtagctgggactacaggcgcccgccaccacgcctggctaattttttgtatttttagtagagacggggtttcaccttgttagccagaatggtctcgatctcctgaccttgtgatccactcgcctcggcctcccaaagtgctgggattataggcgtgagccactgcgcctggctgtgggagcttttttagttgttgcattaaaggggtgacattcagtggcattcagacataagacattcagtgggaggacccagtgatgcttaatgtcctgcagtgcttggtacagtcctgcacagtgaagaattgtcctggcctaaatgtgaatagtacctgcttttgggcatggttatctaatttaaacctgacagttatccttagaggtaggcacagttattatgtccactgtagacttgtagaaactgaggttgagagaagttaagtaacttgctcggcatcatgttcctaatgaatggagagcctggactgaacccagacagttggctccagagcccaggcccttaaccattatatttcactacttccttggtattaaagagagagagagagtaacatatgcacaggagtgtggctataagaaggcgtagtccagggaaaggtgagaagttcaaacagagctgcatgaataatatcaataaacagtctgggtgtgatctcagtgctttgggaagctgaagtgggaggattgctcgaggccaggagttccagaccagcagttccagaccagcctagacaacatagcaagaccctatctctacaaaaaattaaaaaactagccagcatggtggttcatgcttgtagtccagctactcggaaggattgcttgagcctagaagttcgaggcagcagtgagctaggattgcaccacagcactccaatgtgggggacagagtgagacaagataattagtagtgttattattagagaatcacacttttgtaggggaaatgtaactgaagatgaggcagataaatagatcgggatcagcctgcgaaagacctttctggccagccttgggagtttggcttttatcccttaggcagtaggtagccttcataggtttaaagcttcatttatttttatgcaagatgagacaagggcccaagtctgcgatgaggaagggtgattgtagccgttcaagcacatgttgaggaccccaaattggaggaccaatttctccatttagtcagtcaacaaatatttattgggcacaaactcttttctaggttctaaaaatacactgttgaacaagacccagtgttggattggagaggtccacaggggccacgttatgcagggattttatttttatttttatttatttatttatttatttttgagatggagtctcactctgttgccaggctggagtgcagtggtgtaatctcaactcactgcaacctccgcctcccaggttcaagtgattctcctgcctcagcctcccgagtagctggggctacaggcacacaccaccacacccagctaatttttgtatttttagtagagacagggtttcaccacgttggccaggctggtcttgatctcttgacctcgtgatctgcctgcctcagcctcccaaagtgctgggattacaggcatgagccaccacgcctggccagggattttattttatttctttatttttaagaaacagggtcttgctctgtcacccaggttagagtgctatgcagggatttcagtgtcacattaaagagtttgattttaaggccaggtgcggtggcttatgcctgtaatcccagcactttgggaggctgaggtgggtggatcacctgagaccaggagtttgagactagcctgacctacacagcaaaaccccgtctctactaaaaatataaaaattagccgggcatggtggtgcacaactgtaatcccagctacttgggaggctgaggcaggagatcacttgaacctaggaggcagaggttccagtgagctgagattgtgccactgcactccagtctgggtgacagagggagactctgtctcaataaataaataaatagagtgtgaatttaatttaaaaataaggcattgtaagatttttaagcagcagagtaacatggttcaggaggctattgctgaggtccagaaaagagatgatagtggcttcaactggggtgatggcagtgaagatgatgagtaatgggtatatttaagatatttttaggcttggcattgtggatcacacttgtaatcccagcattttgggaggcctagccaggcaggtcccttgagcccaggagtttgagaccagcctgggcaacatggtgaaactgtctctgcaaaatatataaaaattattcagtcctggtggtgtgtgcctgtagtcccacctacttgagaggctgaggtgggaggatcacctgagaccaggaggttgaggttgcagtgagctgtgatttcaccactgcactccagtctgggcaaccgagtgagaccctgtctcaaaaataattttaaaataggccgggcctggtggctcatgcctgtattcccagcactttgggagcccaaggcgggtggatcacctgaggtcaggggttcaagaccagcctggccaacatggtgaaaccccgtctctactgaaaatacaaaaaattagccaggcgggtggcgggcgcctataaaaccagctactcaggaggctgaggcaggagaatcacttgaacctgggaggcagaggttgcagtgagccgagattgcgccactgcactccagcctgggtgacagagcgaaactctgtatcaaaaaaaaaaaaaaaaaaaaaaaagaccatggaaagcaggcattggggccagacctatctgaggcttacttttagctctgtaagatcttgggcaagttactttaacctctctgagttttcttatcagtaggaggtggctgctaatgaccgccgtggacattaagtaatatgatgtatgcaaagctcctggggcatgcctccttgcaagtggagttatgatttcactggtggtggcaagttggtgttgggacaggttgattgttgattctttgtgatatcaaaggccctttcccatcagtctggggacgtgatcccggcaggggccacctcactgcccatctcctctcctgccccatattttctgcaggctccaaaaaccgtttggttggtcgtgcatttcctttctgttgtctgatttgtttcctgtattttactggtggctggtccaactttcaccttttgtggctatcgctgttgttgttgtttttttttttttttttaactacagaaacaagtcaccaagctctccagaacatgcccaaagtgctccgtgatgttgaagccctaaaacaggaggcatctttcctgaaagaacagatgattcttgtcaaggaggacattaaaaaatttgaacaggacacatctcaatccatgcaggtattttggctccttttggctcctgttgtaaatggtgattcttgctttgggaaggtggtcactctcgtaagggctttagaacagcacggtgttttgggaggccaaccatcactcaagattctgcccagcactccagctatgctcttttttttttgagacagagtgtcgctctgtagctggagtgcaggctgcagtacagtggcgtgatctcagctcatggcaacctccacctcccaggttcaagcgattctcgtgcctcagccttctgagtagctgggatcacagacgtgcaacaccatgcccggctgatttttgtatttttagtagagacagggtttcaccatgttgcccaggctggtctggaactcctggtctcaagtgatcctcccatcttggcctcccaaagtgctgggattacaggcgtgagccactgtgcctggctccccgaaactatgcttttgcttgggtctttcagctggttcatctcttcagcactgctgaataaatttagccagatgattggtgttttgggagacagaagctccctaaagacagaagcaagccaccatacttacatttcaagtccctggtggcagatggagaaaaaggacctaccccttcatttttcacccctcacgcctctttcaggtgttggtagaaattgaccaagtgaagtccagaatgcaacttgctgccgaatctcttcaggaagcagataagtggagcacgttgagcgccgatattgaggagacatttaagactcaggtaggtttcttgtttaggggatgttatgaaaggtatttaagcaagaacttgaggtttggagaaagcaaaagagatacaaagttgatagccaatagcagcattcagaaaccttcagactcagggtggggaagatctgaagctgctcggtgtgtttccagcctctttagcttgcaccctctgtgtgactgaagcctcttagtcacagaatgagttcaagagaagccttgataaagatgtacaggcaccaggcactgtggctcatacctgaaatcccagctctttgggatgctgaggtgggaggatcacttgaggccaggagtttgagaccagcctgggcaaaataatgagacccccgtctctacaaaaaaattaaaaaattagccaggtgtggtgctgcacatttgtagttccagctactcaggaggctgaggtgggaggatctcttgagcccaggagttgaaggctacagtaaactatgatcataccactatgctgagggacagagcaagaccctgtctcaaaaaaaaaaaaaaaaagaagaagaaaagaaaaaccagcacaggcagagaaggttgggggtaaatggacgagagggtggaacatggggaaaggggagccttatataccttggggacttggtgggttattgaccccttctgaggctgcaaagtgtggaaaatagtaacattttccacctgggatgtaaggatgaagtaagatgatgtcttatgaagaactcttactcaattgtaaagcaaaatgaatgatttatcagtcagtttttttaaaaagttacaaatgcacatgggaacaaatttattacacaggaataaactgcaaaaaataagtttttttcctaaccctgacccccaccttagtcctctaatttttctttttttttttttcttttgaaacggagtctcattctgaagcccaggctggagtacagtggcatgatacctccacttcctgggttcaagtgattatcctgtctcagcctcccgagtacctgggattataggcgcgcactaccatacccggctaatttttgtatttttagtagagatgggatttcaccatgttggccaggctggtcttgaactactgacctcaggtgatctgccctcctcggcctcccaaagtgcagggattacaggcgtgagtcaccatgcccggccgggggctaatttttcttgtgcggacaagccctgttatcaactttatgcccatccttccagatatgcacatacatatttatgttccctgcccctttttttcctcacaaagctcattgtgaacactgcttttcactttattttttcactcaacaatctatcttttatttatttatttattgagacagagtcttgctctgttgcccaggccggagtccagtggcatgatctcggctcactgcaaacctctgcctcctgggttcaagcgattctcctgcctcagcctcccgagtagctgggattacaggtggacgccaccatgcctggctaatttttgtatttttagtagagatggtttcaccatgttggccaggctggttgcaaactcctgacctcaggtgatccttcagccttggcctcccaaagtgctgggattacaggggcgtgagccacccttcccggctgcctgaccaatttcttaaaatgttttgtaaagacaaggtcttgctatattggtcaggctggtcttgaactcctggcctcatgcaatcctcctgcctcagcctctgaaaatgctgagatttataggtataagccattgtgcccagcctggatgtgaatatttttaaaactcttagcacatattgctaaattgccttccagaaagacagtataaatttaaatttatgataccagattgtcttttttctttgtaccctcaccaacaatagctattataatttttcaaacacttttccaatttgttaggaggaaaatgacactttattgttttaatttaatttgcatttatttgagtacaggttttttgttttttttttgagacggggtctttctctgttgcccaggctggagtgcagtggtgtgatcttggctaactgcagtctccaccttccaggctcaagtgatcctcctgccttagcttcctgggtagctgggactacaggtgcgcatgaccacactcagctaatttttactgtttgtagagactggatcttgccatgttaaccaggctggtcttgaactcctggcttcaagggatcctcctgcctcaatctccgaaagtgctgggattacaggcatgaaccaccacgatgcccagccccattttcatacttgatgagttgccttttcatgtattttatctattcccaattgaggcagtagggatcatttaaaataaatattctctattctggtcttttctaggacatagctgtgatttctgccaagctaacaggtatgcagaacagcttaatgatgcttgttgatacaccagactactcagaaaagtgtgtgcacttggaggcactgaagaacaggctggaggccctagccagtccacagattgtagcggcattcacctctcaggctgtaggtgagtgctagctgcttctcatctctgtgtatatctctctataaagataaggccttgtaagtcttcagtttttagaatgtcttaatggtgattgaattacatagattagaaggaactctgtaattttttttttttttttttttgagacggagtctttctctgtcaccgaggctggagtgtagtggcgcaatcttggcttactgcaacctccacctcctgggttcaagtgattctcctgcctcagcctcccgagtagctgggattacaggcgtgtgccaccacacccaggtaatttttgtattttgaatagaaacgggctttcaccatgttggccgggctggtctcaaactcctgacctcaggtgatcccctcgcctcggcctcccaaagtgctgggattaacagacatgagccaccgcgcccggccaggagtgtctttctattgcttttatgtgtagaaagcaataactgcttttggaattcttgggtcacacactttctccttcagaattcttcattgtcttctgccatctatatttatttttcttttcccgcagaatgtctcacaaaacagccaaatatacttctgtaaaggcaaaaggtgaaatgctacttctgtgaattctgtcttctagtgcgaatgcatttccctctatattctgataagtatgagattggcctgctgcttcttcctattattttttttttgtatgtagcttgtttcttttccctgaatagttataacaggactgacaaacatttcctgtaaagggccagatcataaatattagtatttggcggccttgtggtctctctcacagatacctctgcagttgtggcacaaaagcccactcgtaaatggatgggctttgctgtgtgccagtaaattttttttgtttttttaagacgaagtctcgctgtgttccccatgctggcgtgcagtggcgtgacctcagctcaatgcagcctctgccccccaggctcaagcgattctcctgtctcagtctcccgagtagctgggattacagacgtgcgccaccacacctggctaatttttatattttcagtagagatgaggtttcaccatgtcgtccaggctggtcttgaactcctgatctcaagtgatctgcccacctcggcctcccaaagtgttgggattagaggcgcgagccaccatgcctggccaagtaaaactttatttacaaaaacagatggcagtttggcctgctggcgcatagtttgccaaattatggcttataagattcttttaccttgtagtttagtaacttctctaggttctttttcagttttgaaaatttttaacttttccaggacccagcgtcagcccttttcacctaccaattcatatcttcatttatagaaaatcaccttccttaaaaattttttttttctgttttatttgttctcttttctgtctttgagaacatcaactatctgttcattagctctcctttttccctctccatatatatcatattttctctggtctcttttggatgtttgcctgctccctctcagtcccctcctgccatgtgtggtttttctaaagcttgtttttcatttgactgatggggttttctgaagtatctgttccggagcatatatgcagggcagcgtgaatccatgactctggtttgcagtcctcaaacttcacccaaataaactctctacttatttaaaaaaataaagtatctgttctcggccgggtgcagtggctcatgcctgtaatcccagcactttgggaggtcaaggtgggaggatcgcctgagcccaggtgtttgagacaagccgaggtatcacagcaagaccccgtctctacaaaaaataaaaaattagctaggcatggtagcgcacgcttgtagtctcagctgctcaggaggttggggcagaaggatcgcttgagcccaggagtgacagagtgagaccttgtctcaaaaaaaaaaaaataggttttgttttctttgttcttctaattaatttttaatttttgttatgtcatgatttacttcctaatttttttccttagctctgccaacctccctttgtatctcattgtaataccttagattcttttttttttttttgagatggagtctcattctgtcacccagggtggagtgcagtggcatgatgtctgcctcctgggttcaagcgattctcctgccttacctcccaactagctgggattacagacatgcgctaccacacctggctaattttttgtatttttagtggagatggggttttgccatgttggccaggctggtcttgaactcctgacctcaggtgatctgcctgccttggcctcccaaagtgcaggtattacaggcgtgagccaccgtgcccagcctatttttttttttttttttttgtatagatggggtcttgctatattgctcaggttggtcttgaactcctggcctaaagtgatcctcacacctcagcctcctgaagccttaggtcctgttaaagaaaggacatgtaatttctttgagagtgtgaagcaattattgcctaaaattttcttctctttcttagggaaaatctttggaagtgttcttttttagaaaaaaatttaaaaaattgtggcaaaatgcatgtaacaaaatctaccattttaataatttttaagtgtgcatttcagtggcattaagtacattcacgttgctgtgcaaacatcaccaccatccatctccagaacttttttcatctttctgaactgaaatttcatacgcattaaacagcaactgtccattcctcctaccctcacctgccagcaatcatcattctacttttgtccctatgaatttgactactctacatgcctcctataaatggattcacatagtatttttccttttatggcttagcgtaacatcttcaaagctcatccatggtgtagcatgtgtcaaaatttcctttcttaaggctgaataatattccatctcatatattaccacattttctctatctattcatctgttgatggacatttaggttatttctaccttttggctattgtgaagaatgctagaatgatcatgggtgtacaagtgtctgtttgagttccagctttcaattcctttagggatctactcagaagtggaattgctggatcatatgcttatctttttttttttttttttttttttggagacacagtttaactctgttgcccaggctggagtgcagtggcatgatctgtctgtttgagttccagctttcaattcctttagggatctactcagaagtggaattgctggatcatatgcctatctttttttttttttttttttttggagacacagtttaactctgttgtccaggctggagtgcagtggcatgatctcggctcactgtgacctctgccacccagattgaagcgattcttgtgcctcagcctcccgagtagctgggattaaaggtgcgcaccaccacacctagctaatttttgtatgtttagtagagatggggtttcaccatgttggccaggctggtctcgaactcctggcctcaagtgatccgcccgtcttggccttccgaagtgctgggattacaggtgtgagccaccacacccggccatatggtaatctgatgtttaattttttgaggagctgttatactgttctccatagtggctgcaccattttacactaccaccagcaatgcacaagggttccaatttctccacacctttccaacccttgtcattttttgtttttttttggattatagccatactaattagtatgaaatggtatcttatggttttgattttcattcctctaatgattaatgatattgagtgtattttcatttgcttattgactatttgtatattcctggaaaaatgtctattcaaatcctttccccatttttgttttgttttgttgttttttgagacagggtcttgcactgtcacccaggctggaatgcagtggtgcaatcatggctcaccgcagccttgacctcccaagctcaagtgatcctcccacggcagcctcccaagtagctgggactacaggtgtgcactaccacgcccagctaattttttgttttttgtagagatagggtcttgctatgctgctcaggctggtcttagactcctggactcaaacaatcctccctcctcagcctctcaaagtcctgagattacaggcgtgagccagggtgcctggccctttacccaattttatattgggttatttggttttttgctggtgagttgtagaaattcttcatatattctggatattattcttttattgaatatatcttgcaaatattttctcccattccatggattgtgttttcattctattattgataaaatcttttgatgcccaagtttttaattttttttttttttttttgagatggagtcttgctctgtctccaggctgaagtgcagtggcttgatctcggctcgctgcaacctctgcctcccgggttcaagcgattctcctgcctcagcttcccgagtagctgggactacaggcgtgtgccaccacacccagctaatttttgtatttttagtagagatggagtttcactgtgttggccaggatggtctcaatctcttgacctcgtgatccacccgcctcagcctccccaggtgctgggattacaggcgtgagccactgtgcccggccccaagtttttaattttgttgtagtccaatttattgagtgcataggtaccgtggtggagttttctttgtttctgctgattcatgtttgtgtgtgatagtgcttttgttctgggcctggtattcactgaaaaatagtggaatttccttggaagcccctccttgtttaagagcgctttcctttagcccttgattgaaagtttatattctccgctgtgctcttcagttagctagagagaatggcctcagtactcatctccagccctgtaattccctctcttcctcatttgttaattctttattttgagtcttttcttcattcacagaattctaaggctggagctggggggttggaaagttaccatctaggagctttgttcctcacattctcttgtgaatttgtggctactacagagctcacttttctggttggggttacatccagttctgtggggttgggggagtgggagtggggatggagaggtggtggctccatgcatttaagcttttttgtttgtttccttctgagtgagctggcttctgggagctggtgttggatttgagtgatgcctggtggttcagcatcatgggtttggttttggagataagcagtttttgacagcttttgtgcacaaatttgaatcaggcttgactctaggcaggacatggattcagaaggcgaaaatggcgcttttgagctccataggctgcctcctctgctgggccgcagtggaaacagccctccctcccatgcctggcccaagcccccttggcccccagtctttggccctttgtactgttctgcaccacccttagcgcccagacttttaccagcttccccacccattgtggcccaaagtgattagatatctagttgggattctctgaaatatgtagtacagatattttcctggcttcaacgcagataaaacaatgttttcttttggtgattaatcttaattttggcaagcatcaggaagggttcccccgccccacaggtaatgtgctgtttataatcagccatgtttcctggaaggctgaggtagttctttatctaacagtttttactttttattttttttgagacagagtctacactctgttgcccaggctggactgcagtggtgtgatctcggctcacagcaacctccagctcttgggttcaagcgcctcagcttctggagtagctgggattacaggcatgcaccaccacgcctggttaattttttatatttttagtagagacggggtttcaccatattggccaggctggtctcgagctcctgaccccagatgatccacccacttcagcctcccaaagtactgggattatagtcatgagccacctcacccggcctagctaacagtttttaaagggaattctctgataaatttgttcatccccaacatgttccccttttccatctcctaaaatgacaatgtgagtatagccaagtatacatgcccagttcattttatataaccaatgaattcagctgatacactgaagcaactttttatagaattattttaattaatttttttgcttctcactggtcaaacccaatttatagaattttgttttttgagctagaatcttgctctgtcactcaggctgaagtgcagtgatgtgatcacagttcactgcagccttgtcctcccaggctcaagtgatactcccagctcagcctcctggggtttacaggtgcacatcatgcccagctaattttttctattttttgtagaggggtcctgtgttgcctaggacatttttgaactcctgggctcaaacagtcctcccacctcagcctcccaaaatgctgggattacaggtgtgagccaccacacctggcctatggaataattttaaatgtaacaggaagattcacttatttaagtgttcttatgaaaataataagcattttaaaggcaaatattcgttttctaactcatggatttctgcccattaagtcaagttccactggcaggtctccagcgcttagctgggtgtcccacagcggttgctgttacaacatttccttctcagcagtttattgggcttcccagaagtgaaggggaacagagcaaatataagaagtttggagacctgttagctcaaggcttttttttcccttcttttgatatagttctaaggctgtggcatgtacattttggccagaagggggcggacaggagccagaggtggcgctgctgtgcacactattcagagactgcactgaaacccaccttcctgtctgtccagcggtgagcctggaagcaagtgctttgcccagtcatttcctctgcccttagggaaatatgtcagaaactacttgatattaagcccataacttgggtcttagaatccattgttatgtgtggaatgctaatagttaccaaattatttgattttatgttttgtttttttgttttgctttgttttagagggagtcttgctctgttggccaggctggagtgcagtggcgcgatcttggctcactgcaacctctgcctcccgggttcaaccaattctcctccctcagcctcccaaggagctgggattacaggtgtgcaccaccacgctcagctaatttttgtttttcttttagtagagatggggttttgccatgttggccaggctggtctcgaactcctgacctcaggtgatccgcctgccttagcctcccaaagtgctgggattacaggcatgagctaccgcgaccagcccaaattatttacttattcctcaaaccaccagatatgttgacatatagcagttcagtgtgtttgcttttttaaagttcccatctggtataatcgaagtaggaattttgaaagacataaataacctctcagtatcatgttaaaatatgaattctgtgaggaacagtggggaataccttgcagtatctggttttcacgtcatgcttatttttcaaatttatgatcctcatgcatgagttaattcagtatctaggcaggaacttgtgaatactagcttccatatatccaccttcatcctggtgagttttttctcatgtctacaccagaaaggctggtaacagtatatatacattgtatgttctttagatcagtccaaagtgtttgtgaaggtgtttactgaaattgaccggatgccccagctcctggcctactactacaagtgtcacaaggtaagaagctgtgcgcgatgacagttgtgcagttgtggaatgctcataactctgggtcacagaatcgcaggttcataattcagaaggtaagaacatttgtctccttgccctctggctgtttttctcttagttagccagtagggggtgctcttggtctagcatatggatttgtttaattgccagttggaaaaagttatccgttttcattctcttttctgtttacagctggattcattatagacttgaaacgttgttttaatttattctcatttttgtcttttaagggagatttatgtcttaagctttattacaccctcagaaggcagtaagaatttctctttttttctttagagatagggtttcactattttgcccagcctggagtgcggtgactattcacagatccgatcatggtgcactacagccttgaactcctgggctcaagtgatcctcccgtctcagccttgtgaggagttgggactacaggcgcgtgccactccacctggcttggaattttatgttttctaggtttgctgaagttagattgccaaaaaacttgacagcttcctgaactgaccttaattccttcaagtccagtgctctgtgtcttttaagcagtgatgttaggacatgaagcttaaacatacatgtctgcccgctcttgccccaacatctattcagaagagtgatggtgtgccaagtggttgcacattacatgtttttagggcaggataaatggagaggggatcacatccgcagggtgacagattaaagctgtgaatcagtgcagataactgcaaatgtttttttttttttcctgcctttctttgaagtgaatggacctcactgggctgcccagtgagcccattgagcaatccgtgattacgctgggtagcagggcagggcagtgttcacaggcaacctatgttgacgtacccaataaggttccctttgttctgtctctgcaggtgcagcttttagcagcctggcaagagctgtgtcaaagtgacctatccctggaccggcagcttaccggactctatgatgccttgcttggtgcttggcacacacaaatccagtgggctacacaggtaacagctcatttttgttctagggagaacagagtctgtggtgacaagggaacgggtgactgcctcgggagtggccaccctcaactgcagagcacagctcaaagaacttccccgtttgttgctgtcattcaaggggttaaaaaataaccagttaggccgggtgcggtggctcacacttgtaatcaccacactttggaaggtcgaagtgggcggatcgtttgagcctaggagttcgagaccagcctggccaacacggtgaaaccccaactctacaaaaaatgcaaaagttagccaggtgtggtggcacaattactaaggagaccgaggcaggaagattgcttacgtccaggaggttgaggccacagtgactatggtcgcaccactacacttcagcttggacaacagagcaagcaagactgtctcaaacaaacaaacaacaaaagaaaaaacgataaccagttaaatggtttaagtttaaaagataagcttagaaatccacgtcagtgaaatctttaggtctccactgaaactcttcttaccactcttatctataacttaaataggacctaatgtgacaatgccgcctgttgtccagcaagggagcctgtggaattcctgaaggccattttcttcccatctaaaagcaggaggcccctcgtcaggtggtgttcgaatgaacaggaatgtttttatctttacttcaggtaaaatttacctacctgaagtgagtctcccttgttctcatgatacaccaagaagtaggggaagagataattttaaaggtaccccctgactaggagtgaggagagacagaggaactttgtttcaagtggcaactatccatcatttactttcctcaagtctctaggcatttccagccataaaggttttaaaccgttgttctcttgccttgagacaggaggcacagtagaacctcttgtaagcaggggaagagcctgtcttactttgcagtaatgacttactgggcctgtttctagtgtggcttattttatttatttttttcttatttatttattttttttctccaaacccttgtgttgagggctgattttcaatagcactcagatagagagctattgaaatagattgcagtgagggagctgctctgctatgtacgaaaccccaacctagaagcaggtcatctacgagtggtttagtgtcacgttccccatattttattttttactatagttgtgaatcactcttcagatgttcatcagtcatttgctggaatgaatttgactaaggttggagagaattccttataccgggtcatgtcattcaagttgttggttaaagcacttttctccatccttgttctttttccttgaactaacctaattcattcttaggattttgttttgttttgttttgtttgagacagagtcttgctctgtcatgcaggctagagtgcagtggcatgatcatggctcactgcagcctcggcctcctgggttcaagctgtcctcctgcctgagcctttcaagtagctaggaatacacgtatgtgccaccatgcctggctaattaaaaaaaattttttttgtagagataaggatctcactgtgttgcccaggctggtctctaactcctggcctcaagtaatcctcccactttggcctcccaaagtgctgggattacaggcatgagccaccatgcctgactttattttatttttcttaagaagaatatttcttttttttttttttttttcttcagacagagtcttgctctgtcacccaggctggagtgcagggacacaatcttggctccctgcaacctccgcctctctggttcaagcaattctcctgcctcagcctcctgagtagctgggattacaggcatccgccaccactcccagctaatttttgtgtttttagtacagatggggtttcaccatgttggctgggctggtctcgaactcctgacctcaaatgaccacccacctcgacctcccaaagtgctgggattacaggcatgagccactgtgcccggccaagaaaaaaattattcatgtgttcttgcctcttctactacttcttgtatcacaaggataaaaacagttcatgtccatacatacgaatgcctttcgtcatctaagaaaaagaacttagacttctcagacttctctttgggcctcatcctagattttgggagacatgagtttctgctgatttatactgttggcctgtggcccattttcttttcaggatggaagcataatagttgggctgtcccctcctgaaggtcggtatagcacacaggagccagggcacatgtgtctccttcagatttttccccttagcattttcatatgagaaatttccaatatataaaaatgttgagggaattgtacagtgaatacccatgtagccacctcctacgttgtacagtgtgcattttgctctatttgctttattgcagatctgcctgtctatccctgtctctgtctgttcattaatccatcttattttttaaaattatttttatttgtattcttttttatataaaaatattaaattaaacagagatggggtctcactatgttgcccaggctggtgtcgaactcctgggctcaagtgatcttcccgcctcagcctcccaaagtgctaggattacagacatgagccaaagtgcccagtcaatcatcttatttgttttactcatttcaaaataagttacaagactgggcgtggtgtttcacacctgtaatcccagcactttgggaggccgaggcaggaacatcacctgaggtcaggagttcgagaccagcctggctaacatggtgaaaccccatctctactaaaaatacaaaattagctagccgtggtggcaggcgcctgtaatcccagctacttgggaggctgaggcaggagaatcgcttgaacctgggaggtggaggttgctgtgagccgagattgtgccactgcactccaacctgggcaacagagcgagaatccatctcaaaaaaaaaaaacagagtaagttgcaaacttcattcacttcagaccatacatattattaactagagttcaatgtttacttacattttttttaggtaaaattgtgaaatacaatctttttttttttttttctgaaacagggtcttgccctgttttccccactggagtacggtggcatgatcatggctcactgcagccttgacctccctgggctcaggtaatcctcccctctcagcctcctgagtactgggactacaggtgcgtgccaccacacccaactaatttttgtattttttgtggagacagggttttgccatgttgcccaagctggtcttgaactcctgggctcaagtgatcctcccactgttgggctgcacgcctcccaaagtgctgggattacaggagtgaaccactgcacccagccatagtgatcttaaatatgccatcccattcatttgacaactacaaatacctgggtagcctaatcccctttcaggatccagaacatccatatcaccatcgccctggaaagttccctcatgctccttcccagttggtctgtgcaccagcacccttaaggcaaccactgccctgattttttccatcataagttagtttaatgtgttctagaatttcacctagatggaatcagacagcatttcatcttttgtaggcttctttcactcagcgtgtttttgagatttgctcgtgttgtttgtatcactagtttgttcctttctgttgctgaatactgttacatggtgtgaatatacctgtttgtttacacttttttttttgagacggagtttcgctgttgttgccgaggctggagtacagtggcacgatcttggctcactgcaacctccgcttcccaggttcaagtggttgtcctgcctcagccccatgagtagctgggattacgggcacacaccaccatgcccagctaatttttgtatttttagtagagatagggtttcttcatgctggccaggctggtctcgaactcctgacctcaggtgatctgcccacctcggcctcccaaaggtgctgggattacaagcgtgagccactgcacccagcctgttgacacttcttattggtagacacttggtatgtttccagtgttgggcaattatgaataaaggtgctttgaatattgttctgtaggttttttttttgtagacacatgttcccatctcttgggtaaatacctaggagtggaattgcagggtcaaatcgtaggtgtatgtttaggtttgtaagaaactgccgagccaggcgtggtggctcacacctgtaatctcagcactttgggaggccaaggcaggaggattgcttgagcccagaagtttgagacccacctgggcaatatggcaaaatcttgtctctacagaaaatacaaaaattagttgggcgtggtggcacatgcctgtagtctcagcaactcaggaggctgaggtgggaggatcacctgagcctgggaagttgaggcttcaatgagccatgattgctctactgcactccagtctgggcgacagagtgagaccctgtctcaaaaaaaagaaagatggctgggtgtggtggctcatgcctgtaatcccagcactttgggaggccgaggtgggcggatcacctgaggtcaggagttcgagagcagcctggccaacatggtgaaagcctgtctctaccaaaaatacaaaaaattagccggccatggtggcagatgcctgtaatcccagctactcgggaggctgaggcaggagaatcgcttgaacctgggaggtggaggttgcagtgagccaagatcgcaccattgcactccagcctgggcaacagagtgagactccatctcaaaaaaaaaaaaaaaaagaaaagaaacaaccacattgctcaaagtggttgtactttttccactcctacatagtgtgtgagagttctggttgttccacatccttgccaaaattaggtgttgacattctctttaatttcagccatgctggtgggtgtgtagtagtatctcatcatggtttttatttgcatttccctgatgactaaggatgttgaggaacttttcacgtgcttattggccatttgtgcatcttcctttgcgaaatgtctattcaggtcttttgtccattaaaaaaaaacaggttatttgcctttttattattgagttgtagcaggttttttttattttttattttttattttttgagacagagtcttgctctgtcacccaggctgaagtgcagtggcatgatcttggctcactgcaacctccgcctcctgggttcaagcaattctcctgcctcagcctcctgagtagctgggattacaggcatgtgccaccatgcccagctaatttttttttttgtatttttagtagatatggggtttcactatgttggtcaggctggagtacaatggcatgatctgggctcactgcaaactccgcctccccagttcaagtgattctcatgctgcagcctctggagtagctgggactgcaggtgcatgctgccatgcccggctaatttttgtattttttagtagagacagggtttcaccatgttgcacaggctggtctcgaactcctggcctcaagtgctctgcccactcggcctcccaaagtgctgggattataggtgtgagccaccgtgctaggccttgaattttaaaaataacatttaaaaataacgaatttggtggtggtctagagggtgaactgatgaggctatgctggagacaggtaagaacctttggtagaggatggtgatggaaatgttgaagttcaagaagaataaacagttgttaggacctggtaactgatgaatggaccacaagaacagagagtcagagggcagttttcatcctggttcaatggagatgttactgacgggaacacagaagttggaggaagcaggtctggggaggtcagtggcaaaacaatgaattccaattctgactgcttttaaattccaagtgagagtgacgcatcctaatggtgacatccagtaggtggttggaagaaacacaaattggagagtcctcagcagtttagctgttttttgttttttttttttcttttgagacagagtttctctctgttgcccaggctagagtgcagtggcgctatctcagctcactgcaacctccacctcctgggttcaagcaattctctgcctcagcctcccgagtagctgggattacaggtgcccaccaccacatcttggcctcccaaactgctgtgattacaggcgtgagccgccgcgcctagcctggtttttttttgtttgtttgtttgcttttttgcaacagagttttgctctttcgcccaggctggagtgcagtggtgcaatctcagctcactgcagcctccacttcctgggctcaggtaattctcctacctcagcctccccagtagctgggactacgggtgcacaccaccacacctggctaatttttgaacattttttgtagagacaggatcttactttgttgcccaggctggtctcaaactcctaggctcaagcgatcctcccaccttagcctcccaaagtgttgggattagaggcatgagccactctgcacttgtcctgaatttattaactctaaaagtattttgtggattaagattttctacacataaaataatgtcatctgtgaacagagataactcttgttttcaatttggatgccttttctttctttctttctttctttctttttttttttttttttttgtccaattgctctggctaggacttctggttctttgttgaatagagtggcaaaagcaggcatccttatcttgttcctgttcttaccatctcttaccaatgggtatcacgttagctgtgggttttcatatatggcctttattatgtggaggaagtttccttctattcctagtttagtgtttttctcatgaagggtatggaattttgtcaaatatattttctgcattaattgagatgatcatgtattttcccttcattctgttaatgtggtgtattacattgattcattttaaaaaattagagatttataatatttttattttttgagcctggtctcaaattcctaacttcaagtgatcctcctgttttggcctcccaggtgctgggattacagggctgagccaccactgtgcccggccttgatccatttttgtttagtttaaccattctcacattcctgggtgaatcctacttgatcatggtgtacaatgttttttaatatgctgctgaactcagcttactagtgttttcttgaagatgtttacatgtgtattcataaggcatgttggtttacagttcttctcttttctttgtttcttttgttttgagacagagtcttgctctgtcacctaggctggagtgcagtggcaacatctcagctcactgcaatctctgcctaccaggttcaagcaatcctcctgcctcagcctcccaagtagctgggattacagtcgtgcaccaccatgcccagctaatttttttgtatttttagcagagacggggtttgaccatgttggtcaggctggtctcgaactcatgacctcaagtgatccacctacctaggcctccaaaagtgctgggattacaggcatgagccaccacacctggcccatagtcctctctctagttaatttttggtgaccatcaaaaaaatgccacatgaatgtgttcgttagatttgaaaataactagacacttggggccactgatagacatgaacttgccagttgttctaggcaagttgcaagttccaagtcttgccagtttactttctgagcatgttcacatttgccatgaggaaaactttgggcttatagctctaaactagatcacttttcatctatcaggggagatccttttgagatgacccaggagatagcttctttaaaagttatacttctttaaaaggtgatgtggctcacacctgtaatcccaacaccttgggaagttgaggaaggaggatcacttgaggctaggagtttgagactagcctgggcaacatagtgagaccccgtctctacaaaaaaataaaataaaataaaaaattaatcaggtgtggtagtgttcctgtagtatcagctacttgggaggctaaggtgggaagatcacttgagcctgggagttaaaggctgcagtgagctatgattatgccactgcacttcagcctgggtggcagagtgagaccctgtctcaaaaaagtttttaatttttaattttaatttttatttttttgagacagagtctcgctctgtcacccaggctagagtgcagtggcacagtcttggctcactgcaacctgcacctcccgggttcaagtgattctcctgcctctgcttcccgaataggtgggattacaggcatgcgccatcacacccggctaatttttgtatttttagtagagacagggtcttgccgtgttggccaagctggtcttgaactcctggcttcaagtgatccaccttccttggcctcccaaggtgctgggattataggcataagccaccgtgcctggcatctcaaaaaagttttttaaaaaaggtgggctcctatttggctccatgtgctaaggcaggtacacctctctctcactgcaggttttccagaagccccacgaggtggtaatggtgctgctgattcagaccctgggggccctcatgccctcgctgccctcctgcctcagcaacggcgtggagagggcagggcccgagcaggagctcaccaggctgctggagttctacgacgccaccgcccacttcgccaagggcttggagatggcactgctcccccacctacgtaaacattccttcctgccagttctctagcttgtctttactcgctctttctgaagcttctggggcctggatttgtttgccttttcagatgactgattttacagaaatggaagggatcggtgttttccttctcagcagatgtggagggcttttccatgaaaaaacattgccatcaaggaaatagttgtttaatatctttgcctggctccagtgctgcctgggtgccttacatgctctggggaagtgatggacacctctgtggggcttgggatataaaagaggcatcacagtgaggcaggtagatgttatggcaaagagttggcggcagattacaccaggaggcaagtgtgcttatcctttgaagtcatcacgaagcctcagacatttcaacctcaaaagtcagttttagagaacaaacaggctacaagggctttttttttttttttttttttgagatggagtttcgctcttgttgcccaggctggagtgcaatggtacgatcttggctcaccacaacctccacctcctaggttcaagcaattctcctgcctcagcctcccaagtagctggaattacaggcatgcagcaccacgcctggctaattttgtatttttagtagagattgggtttctccatgttgaggctggtctcgaactcctgacctcaggtgatctgcccgcctcggcctcccaaagtgctgggattacaggcatgagccactgtgcccagcctacaggggctttttgaaggagcaacagcaagtgtcccagggcaggggagctgtgttaggactacaggtggttgtagagaaaatgggctttccccggtggccgactgagagcagagcaccccttactcccatttgggtaaacagtgcctggtgtgtgatgctctccaagctctttcccgtctatgttaaaagctttataaatttttaaagaacacagaccccgtgacgcatgttgctgtcaaatcaggaaattgcttcaggaaggccttgttctgctgttcggcggctgtgtgtcactgacttggtttatttaatagttcttctctttaattacatctgtgtataattgccttgtacgttccagggagtgtgtttattgttcggattcctgatgactcatcggtgtttttggcatgctcacaggtcaggccttagttatgggaaaggcccagtggatggggaagcttccaagggaccgtgatgcctttgtggaagtggctaaggagagttgagagagctgggctaaggcgagttgctgcagcacagtgggacgaaggtggagcaaggaatggctgcatccttcccctggggatggatgtagtggggaagagaaccacccttgagacagatctggaagtgctttgctagtcagccatgggacgagtctcactctcgcccaggctggagtgcagcggtgtgatcttggctcactgtaacctccacctcctgggttcaaacaattctcctgcctcagcctcctgaatagttgggactacaggtgtgtgccaccacaccaggctaatttttgtattttttagtagagatggggtttcgccatgttggccaggctggtctcgaactcatgacctcaggtgatcgacccgcctcagcctcctgaagtgctgggattacagcaggtgtgagccaccatgcctggctgggactttagatttcattttttttttttttttttttgagacagagacttgctttgttgcccaggctggagtgcagtggcgtgatcttggctcactgcaacctctgcctcccaggttcaagcaattctcctgcctcagccttctgagtagttgggattacaggcacacactaccacacctggctaatttttttgtatttttagtagagacgaggtttcaccatgttggccaggctggtctcaaactccttgcctcaagcaatccacccatcttggcctcccaaagtactgagattacaggtgtaagccaccacacctgacctagattactaatgattctccctgaggttttccaaaagagttttagtttttcttttaacttaaaaattttttggaaacacacacaaaaataaaaagagagcaagaacaatccataaactcatcagtcagagccaccaacaacattatttgcttccagtaatacaaatataaatatacattgttcacaaatattaatatacttaatatctaccatataaatattatgtaataaatacataacatattaaatatattaaatacttttatatatttacatgtaataatatatgttatataatatatacaaaatatcttaaaatattggttgtagacagtcttatattttcattttttgaaatgctcaaaataatataatgggcattttcttatgtcattaaatgttttcctaagacatagttttgttgtctttattttttttttgtttttttgagacagggtcttgctctgtcgcccaggttagagtgcagtgacactatcacagcttactgtagccttgaaccttctgggctcaagtgattctctgaactcagtctcctgagtagttgagaccacgggcacatgccaccaaggctgactcatttttaaaaattttttgtagagacagggtcttcctattttgctcaggctgatctcaaactcctaggctcaagtgattctcctgccttggcctctcaaagtgctgggattacaggtgtgagctaccacacctggccaatttactaccatttttaatcactatgatatataaaactataatgaactgttttatacattagtttttgagcctagctccgattattccttaggataagtttaaatttgcagttgctcagaaatgaaaactttgaagatacttgtcacattttgttcttttttttttttttttttttgagatggagtctcactctgttgcccaggcgggagtgcagtggcacaatttcggctcactgaagcctccacctcctgggttcatgccattctccttcctcagcctcctgacacattttgttctttagacctgtttttgtatctatcagtagtgaacgaaggtgcctgtgttgccatcccctcaccagcactagattctttttttctcctgtcattgccaggttcttagacaattactgatatgccattttagtttttcactttggttattagcaagtttgaaagttacatgataaaaagtatcttttctcttttgaattgcttattctttagcctgttattctgtttgggagtttaacctatttctggttaatttataagagcaatttatttaaaataatatattattaaatatattataaaaagcaacaaaatatgtattataagaattaatgatatagaaatctgtgacacaaaataactctcctataatcccactttaaccactgttacaaatttggtgcatattcctgaaagatccttatatagtgaggaatttttaccattgcttatcaaatatgttgtaaatatattgcctaacttttaattttacccttaacattttttctattattttaatagttaatacatgtacctaatacaattcaaaatataaaagattatgcaatataaagtaaatttttaaaaatttaggttgactttatcattatagaaaaatctaggaaaaaacaaggaaggaaaaagaaatcattctcaactcaccattcagaaacagcattttgggccaggcatgggggctcgcacctgtaatctcagcactttgggaggccaaggtgagggagtcatttgattctaggagttcaagatcagctctggaaacatataccccatctctacaaaaaaaaaaaaaaaaaaaaaaaattagccaggtatagtagcatacacctgtagtactagctactcaggaggctggggtggggagatctcttgagcctgggaggccaaggcaatggtgacctgtggttggaccactgcaccttagtctggggaactgagtgagatcctgtctcgaagaaaaaagaaaagaagaagaaaaaagaaataacactttggattctatacatgtgcagatttgattattaccatgttagacccacattactttacctaatctctacaaaaccttgtaaaattggtgccagaaatcaagagcagcagactttagctgagtgagtattgaaggagaagtaggagttaactagataaagaggggaagggacgaagccggtccttccagacagaggatcagcatgtgaacagaaggaagcttttaggaactgagagaaggctgggagctagaggaagagggaaggaggatgaggctgtagaagtaataataaaactagctgaaggaggggaccagaaggatgtgaggataccagtaagtaggctattacatttactaatcccctgttgagactgtgtccaaagctttctgattctgagccatgtttccatgaacatccttctgtctctgtgtatttgttgatttctttgagatgattttcaggaattgaattactgtgttgtagaatatgcacatttacattctgatacagcgtgttttacatttttatgtggttgaacgtaggaatttttggaatgcctgggctatggggtatccttttgttttttgtttttgttttgagacggactctcgctctgtcacccaggctggagtgcagtggtgtaatctcagcttcccgggttcaaggaattctcttgcctcagcctcccaggtagctgggaccacagatgcatgctaccatgcccagctaaattttttttgtatttttagtagagatggggtttcacagtattggccagggctggtctcaaactcctaacctcaagaaatccgctcacctcggcctcccaaagtgctgggattacacgtgtgagccaccacgacctgccagtgggggtattctgtttctaggaagtcctaggaacatgtggcatgggaattgttcttcctgtattgccttttctctgtggcagttctttttttttttttttttttgagatgaagtcttactctgtcacccaggctggagtgcagtggcatgatcttggctcattacaacctccacctcctgggttcaagcaattctcctgcctcagcctcccgagtagcaggaattacaggtgcccgccactacgcccggctaatttttgtatttttagtagagatcgggtttcaccataatgggtaggctggtctcaaactcctgacctcaggtgatacgcccacctccgcttcccaaagtgctgggattacaagtgtgagccaccgagcccagcctctgtggcaattcttgaacctgaccttgatgagggttatctttttttttttttttgagatggagtctcgctcttgttgcccaggctggaatgcaatggtgtgatctcagctcaccacaacctccacctcccaggttcaagtgattctcctgcctcagcctcccgagtagctgggattacaggcatgtgccaccatgcccagctaattttgtatttttagtagagacaaggtttcggtttctccatgttggtcaagctggtctcaaacttctgacctcagttgatccgcccgcctcggcctcccaaagtgttgggattacaggcgtgagccaccacgcccggccaatgagggttatcttttgaagggattcttatttgtggtgggtcatgggattcagggggctggtgtctttaatagtgctttaggcaaacaatgtgcaaagcccaaatttatccagatatttgctgaactgattgtaggagaagcttccatgaatgataaaagctgcttaacaaaatatagtcccctctggagatcaaatggggaaagttctagtagagcgcctcttgattgttgctttcccacagttaatttcagattctttgttcattatcgttttacatttctgattccctaaagatgaacacaatctggtaaaagtcacggagctggtggatgctgtgtatgatccatacaaaccctaccagctgaagtatggcgacatggaagagagcaacctcctcatccagatgagtgctgtgcctctggtaaagtcgcagtgtcctggggccactgaggaagcattctgttagccagggtcttggccacgtctgggagagggctgggggttgggatccggggtgctgaaatatgacctttaagcacttgtgggctcttgtaatcccaatgtaaaatgagaccatatatttgctaccaattttctattgattgatggattgagacagagtctccatctgtcgcccaggctggagtgtagtggtgcgattgattacaactcactgcagccttgatctcctgggctcaagtgatcctcctgcctcagcctcctgagtagctgggactccaggcatgcaccaccatgcctggctcatttttgtgtattttttgtagagacagttttgccatgttgcccaggctggtctcaaactcctgggctcaagcaacccacccaccttgggcttccaaagtactggaattacaggcatgtgccaccctgccgggccctagttttctatttaaaatccccaatgaaggttaaacaaaatgagaggcttaaatcttttgggggataagttgattatctccctggtttactaatttcttactaaggcggtcttttgtttaaggaagacatgcaaatgggcacaggatcttagcactcatgggcaatgctgcaggggcaggttcactatgctatgtgggcaccaggggtggaactgaggccatttccatttcaaatattattttgttttcaagtcataaggttgtctagcatgaggtacattgatatttcagaattgatcttatagtagttcaaatctactgcctcttaccattttcttgttttctagggatatacctagaaagtctattgcacttcagtgccatacttgcacctgaaggaaggaagcattttccttttgccttattttttatttttatttttttgagagggtcttgctctgtcatacaggttgaagtccaatggtgcccaggttggagtgcagtggcacaatcacagctcacttcaaccttgatctcccaggctcaagcgatcctcccacctcagcttcccagtagttgggactacaggtgcatgtcaccatgccaggctaattttttgtagagatggggtttcgccatgttgaccaggctggtctcaaactcctgggctggagcaatctgcccacgtctgccatccaaagtactgggattacaggcttgagccactgcacccagcccccttttgctacattctttggagcgtctgataaggagaatttgaatcgtagctcgagagccagaggaagagatgccatcttaataatcacagaaaaagaggaaagcaatgaaaaacattaggatcaagtagacagacattcgatcatgcttttctgccaggagtgaatttccatgatcccactgatgacttagactgttctcccttgattcaggctctagagaagcattcaaacgttgggactatatttctgacatcgttattaagtgattttactacagatgagaaggcttggaggtcttcccctatctcagcattgtctgttctaaagcctaatgcagctttgtctgtatttgctgaccaggagcatggggaagtgattgactgtgtgcaggagctgagccactccgtgaacaagctgtttggtctggcgtctgcagccgttgacagatgcgtcagattcaccaatggcctggggacctgcggcctgttgtcagccctgaaatccctctttgccaagtaaggctggggaactggggaccagacgggccacattggagcagtgtctgtcccagataaaaatgcacgtgttctgtatttgttctctgaaccctgggaaacacttgcacctgaacccaagaggatgttgttaaggatattcatagtggcattgtttgtaatggtggaacatttgaaacaacgtaaatgtctacccattagggaaggttacttaagatgtgacatattcatatgagggaaacttgtgcagcagttaaagtatgttaagaaaaaaaaagaaaccttagacaagttaaatttaacaaagtttatttgaacaagaaaaaggacctttggcctggtgcggtgaatcacgcctgtaatcccagtactttgggaggccaagacaggtggattgcttaaactcaggagttcgagaccagcttggccaacatggtgaagccctgtctctgattgttccagaaatactgagcatgcctctgtgaactgtggaggctccttggacccagagctccctggcattgccatcgggcatccagcacctcccagggcagttccacgtaggcatttctataggaacacatcatctggtgtggccggatgagcctgaatgtgttcctgcagaaaaagaaacatcaggctgggtgtggtggctcacgcttgtaatcccagcactttgggtggctgaggcaggtggatcacttgaggtcaggagttcgaaaccaccctggtcaacgtggcgaagctcatctctactaaaaatgcaaaaatcaggtaggcatgatggtggatgcctgtaatcccagctgctcaggaggctgagacataaaaattgctgaatccaagaggcagagcttgcagtgagccaagactgtgccatggcactccagcctgtgcaacaagaacaaaactctgtctcaaaaaataaaaaataaaaaaaaatcaaaataatacatttccatattaagcattcaaactgtacaaaagtatatctggaaaacccaggccatcttctctaaaagggaagattttgaagttaccaaaatagctgatgcttataaaatcagggaaatcaggttgaagctaacttgagcagggttcaaatggcacattgttcagtagtgaggagggtttggggaagggtattaagggaggcaggggcaaggagaacagggtacgcaggaaaggcaggtgcaggttggcctaactcgaactaggatgaagcatagagtatagtggccaaccggtggttcaagaaggaggggtattaagactgtgatgggcatgggagctctggacacttactagtggggaccttagagatggtagtgttcctctctgagtaaactgatgatgacaatatctcctttccaaggaggttgtgaatattaaccaaaagcatatcattaaagcccctaacacggtgactctgacatggttgacaattggaaatgtgtattgtgagaaacagctggagggtttgggaacaaaaatgatgtgatgaaagctacacttttcctctgagatttcatgacaaaccatttagaattctggattgacagctaatgaaatagagaaagcatttgcttataaccatacctgagaatagtggctaaacaaaactccttctcctgcagtgtgtacctgctctttctgcagagcacatggatatttgccatagttgcagaggtggtgacatggttgtttaacttcccatggctaaagcacaatcatgttccttaacattcccctgtcagtttgtgcttgaggccagcccctctccttcctgggacttataaccctagaaagctgtcacctctcttggtgcaaggggaaggtgttgtcagtggtactctgggttttgcagctttccacctgaaagcatcgagctctctgtaaagggagcagcaggatcatttgcagtcagtggagtgacctgaagccgtttcttccagttggttcattgagtggcctgtgtctccactgcatggactgaccttttggggctgtgccctgggtcctcacatttcactttcctcatttagagcttcgttttgggaggggcaagcggcaaggcctcttgtgatgcatgcaaatgtcacaggtttcgtagctttcagaggacatgactccctcctttatgtccagctctgtgctagttcctggggatataagtatgaggcacaggtttcgtagctttcagaggacatgactccctcctttatgtccagctctgtgctagttcctggggatataagtatgaggcacagactctgttctcccagagcttaaagtctagcagcagcaataagcatcatacaagctatttctttatctggagacagggtcttgctctgccacccaggctggagtgcagtggcgtgctcatggcccactgcagccttgacctcctaggctcaagccatctttccaccccagcctcctgagtagctgggactacaggcatgcgccaccacgccaggctaatttttgtattctttgtagagacaaagttttgccatgtcacccagtgtggtcttgaacttccatgcacaagtggtcctcttacctcggcctcccaaagtgctgtgattacaggcatgagctaccacacccgcctaatttttttgttttttttagagatgggatctcactctgttgcccaggcaggtctcgaactccttgagctcaagtgatcctccttcctcagcctcccaaggtgctgggattacaggtgtgagccaccatgccctgtctaaacaagctgtttaattacagtgttttagatgctgtgagggaaaagtatgtgtgtacagtgagagcaaacaacgcagcctgtgagggaggatctcctggctttgaatccactttcatgcgtctgtcccattaaagtcagacacttgccagccgtgaaactttaatctttttgccacgggtatttaatctaaatttagaggatgagaatgatgcagaggtaccttggatgtcatgaccttccttacgttatcccaggtcacagtcagttattaccatgggaccgtgatgtttaaacagttcttcaaacctgctttcacagaaatgtacttatctggatgaggggggatttatcagcatcatctctcacctggttgctccctggagtcaacttcacgattattccttccttctcctcttgggcatctcttttagaaactgctcaaccaggtggtgaagacagtcttgccacatagagaagaactttttgtgttcagaggtttacaagcagtttcactcgtcggtgggagcctctaaagatgctctcaaggccattagcaatttgtccagagctgtagaattccaggtctctttagagttggggaatcagtggtgacctccctaccattttcttccctttcccggcaggtatgtgtctgatttcaccagcactctccagtccatacgaaagaagtgcaaactggaccacattcctcccaactccctcttccaggaagattggacggcttttcagaactccattaggtaaaccgggggttgtaattcaagcttgttcctaatgtagccagcataaacatgcatgatatagtatataaaaatgacaaatgtgtttggaaggggttcgttttttttctttcactgcctttttaaaaagcaaatactccagactctaaacacaaaccaataaaacccaacccaaaccaaccaacaaaaagacccctccagctcttaagatatttttaaaagttctttacaaatgcctcatctcctttaatgacttaaattttttatatttgatgtgagattttttacccccaccttagcgtatagtttttatagacctaaaataacttagggcttatgtattagaaaatgcataggtgatcggatcctgtttctggatctgagaaccatggtacatggtactaaatggttccaggcaacgctatttggcctggaaagggccatttaagagttcagtgaaagggctgggcttggtggctcatgcttttcatcccagcactttgggaggctgaggcgggcagatcacttgaggtcagtagttcaagaccaacctggccaacatggtgaaaccccgtctctactaaaaatacaaaaattagctgggtgtggtggtgtatgcctgtaatcccagctacccaggaggctgaggcaggggaattgcttgaacctgggaggtggaggttgaagtgagccgagatcctgctgctgcactccagcctgggtgacagggcaaaaccctgtctcaaaacaaaaaaggttcagtgaaaggaattgaggtgaccttctcaagtcgttgttgagggccagattctggaatagcctgtgtggcctgtgggccactaggtagacaccctattttgccccagtccctgaggcttgatggaggttcgatcagcagttgcctgagaagatttggtccttgacatgtccagctggagagcatggactgttggcctatggccagatttgacctatggacatgtttgatcattgcagtttttaacaagtggatttgttgccaatatttaaaaactagatttaacatgatccggatttctaatgtcacctaaaaaatgagatgctcaggcaacactgggcctgcattgtcatagccactggggctggcagcaggggtccctgagaaactgggcacgggttccctgttgtgcagtgcttctctcctctcccaagtgggctaatagtgatacgattaggctctcagaccacttggcagagaagagaagcaccatacaacagatgaaaagcaggctgggcacagtggctcacacctgtaatcccagcactttgggaggtcgaggtaggtggatcatctgaggtcaggagttcaagaccagcctggccaacatggtgaaaccctgtctctactaaaaatacaacaattagctgggcatggtggcacgtgcctgtaatcccagctacttgggaggctgaggcaggagaattgcttgaacctgggaggtggaggttgcagtgagccaagactgcaccattgcactccagcctgggtgacagagcaagacctcatctcaaaaaaaaaaaaaaaagcaatctggaagtttctttttcttaaaaccattcttcctggatatattttcccaagagagaaatggccgttcacttggcgcacttcacccactttcatgtcttacctgacccttgcccgtgacacatgtggttcttaatgcggtggcccatgccagagcagacccagacccacccaaggccgttgggtagatccaggaccactcaggaccattttagattattacctcacctcacaggctctgttctggattgttttgatgaaatttaatgttctatgggttgataggtgcagcaaaccacgatgacacacgtttacctattaacaaacctgcacgtcctacacatgtatcccggaacttaaaataaaatttaaaaaaaatgtaatgttctagatgctaactgtatcccttatcacccgtggtggtttggtattctggaaaatattatgcacaagtttgttctgttgcacgtaagggaagtggaatattttaccttctcataaacttttcttatgatggaatgcctagatagcctggtgatgatgcgcacttttagagaaggttaaaagttaactagacttaagatgtttttaatccttggatttgtcctgacattatgagtttggtgttgaaggacccagcagctgggagtttgaggcttggcataaaattacttgaaaattaaaggatcattcaatacggatatgatggtcatttgggcttatctctgagaaacaaatggattaatcttcatctgcctttcatatgatcagggaaagatacttctagtaccaaaacattttctgtgtctggaaactagcaggcatctagcaaatattaagtgatacattttttttgtttttaattttagatacaggcaggatgtggtggctcactcctataatcccagcattttgggaggccaaggcaggcggatcacttaaggtcgggagtttgagaccagcctggccaatatagtgaaaccccgtctctactaaaaataacaaaaattagccaggcgtggtggcgtgcgcctgtaatcccagctacttgggaggctgaggcaggagagtcacttgaacctgggaggcagaggttgcagtgagccaagatgacgccattgcactccagcctgggtgacagagcgagacttagttgcaaaaataaataaataaataaataataaattttagatataaaatatctctaccctgtttttctcaaggacaaagctgagtattttggaaatgtaaaattatttgagggggccatggatagaattgtgctttcgtagcagagatgccagtgacaatggaggttattggaagggaccagcattttctttttacattaatgactaatgaatgaaacatttcaggccagcagatgtttaacggctttcccagaaccagaactacccaaaggagcaaatagttaggatttttatgaataagacaatgtttgtcctgtaaaggctggcattccagatacttgaacttgaagtgctttttgttttgtttaggataatagccacctgtggagagcttttgcggcattgtggggacttcgagcagcagctagccaacaggtaggagagaggagtcattgtcctctacaccctggggttcctgatcagcacgagcttggtctagtacacagtacagcaaggacagcatatgccagatgtgaaggccacagggctggaggactgtctgtacctagatacagcgtgtcattattgtcatcattaaacgtttattgagcacctaaaaagggcaaggctttgtcctacttggcaggggtcacgtaattttggtttgatatggtggtttcagcctaaatgaggaaacagtgcatcttgtctccaaattaggaatgggcttggttccgactgcttgtttataaattagttgttgggactaaaaataaatttccatatagaaacggtgtgacaagtggtggtgaagtcccttgggccagccttcaggatcggggtgaacttaggcagcctgccttctgggtcctgcagtcaaattccgtgctgctgaagggctgtgtatcaaaggggaatctctggggtctgccctggaaaagcttgtcctactcccttcctctcttctcatacctgccagggcttttatgttgccctgaggtggccttcctcagacagtttttcccttcaaggggctctggcttcccacatttctttctttatccctttaaatgaaatctcttgattcccttggtatggctgatgcctttattccttaggagttaaggggaagaagtctgtttcatacagttgtttgagggaccagcagcaatcccttaacctccttcttaggtgattctttattgccctaaagtaatctctgggtgatgaaatttttagtggtggtacaaagtgaaatgaaagcaccactgttccaaaagtaagtaatgggtgctaggaaaatacagaggagccacagcaatctccctatatctggcccaagctgcccaggatgagagaaatctctcagatgagatttcaactcggccttgctttactcagcccgtaaatcacaaaatgatccctttctgcagagaagtgatcataagagctgggtggccaatgtcaatcttgtcactggagcggcccagcgcgttctgacctgttgcctctgccacccgcctgttggtggggagtggtccttggtaggagtctaggtgctgctggtgagattgatggggagataagataagctttacaggtgcctgccacatacacacacacacacacacacatgcacgcacacacacacacacacacacacacgcatgcacactgtgcagccttccagccaggaacacagatggtgactgtccctttccaggcttagtgcttccaggatgacatcatctctttcaggagctcccttggatacacccaggctgttcttgacttgaagctcagccaggctttcagcctctctgggctgcaaaatgcagcccagagaggcccatcttttatctattgtgtccccattcgtgctcctaaccagtctctccttacccttcagaatgtaatacttgatttcattaagagattaaggaaaatctgtgtcctaggaattaccatttacttcatttatattatttacacacactctactgtatgcctgtggcactttggttttattcactcccgaaagtcacgcaatttctgtgctgggcattcaggagtgagttaggaacagcagcagctgctcccactctatcctgctgtgagcctttccccataatgagaaccatcacaaaaaatcttggactaaagacagttggtggtctcagaaatgacgggaaacaaagaatcgtgagaagaaactgccaacaaagagcacagaccttccttagcaactcgcccctacctcctgccccacctccccccgccactcgcctctcccttctgccctgctcaccccctgcctcccgccccactcacccctacctcccgccccactcgtcccctacctcccgccccactcgtcccctacctcccgccccactcgcccctacctcccgccccactcgccccctacctcccgccccactcgccccctgcctcccgccccactcgccccctgcctcccgccacactcgccccctgcctcccgccacactcgccccctgcctcccgccacactcgccccctgcctcccgccacactcgccccctgcctcccgccacactcgccccctgcctcccgccccactcgcccctatctctcgccccactcacctctgtctcccactttactcacccctacctcccttcccactgtgccacagctttcctgggctctgagctaggtcttggggatatcagttaattaaactcaatcctcgccctcaaagagcttagaaattaatgggagcatccagcatgtgccagtatgctcattgctgtgccaagagaacgcagtgtgcacagaggagggaggattacaattccattggttccctcaactgtgacaagttattgcccacttctcagccatgggaacttgtaaatttatgctagatttccagaacctgactgtctcattgaactgtcccccgaagacctggtcactaaagccagggtcacccatccttcaacagttgtggagcccctgccacgtaccaggcactgtgctagtgctagtaattcacaaatgaagaacagtccgtgttttgtcctcaccgtccagttggagggaaatgagacagcatgtgttaaatgcagaacagaagcaagagccctttgggagctctgccattggctgatggcgcagagggctgaaacctcctggggtccttaaggcctctcctctaccaagcctttctaatgcccctgtgaagcactatctttgggaaaaagccaaaatcagatttgccttctgggaagatcattctgctaacccttaggaggacagattaagtagaacttcgaggactagaggaaggggaagccagttagttggaagcctgctgtgatccagacaagaactagtgaagactggaagtaaggcaatggcagagacaggccacagtttgacagataagagacccaaccaaagttactggttggctcaagcaacaggaagaacgaacttgaacttaatggcagaggcaggtagctgcttatgtcagcagtggcttctgaggaagatcgtatcacagggatttatttgcaagtacaggcatttcttgaacaactcaaggatctgtttttgaaatagtgagtgcatcctaaaaactgctatgtccaaagcaatgttttcataagaaattacagtaaaagagaaggcagggaattagccacatttgggatgtgtcataatgtgttacacatgttcatgtaattctgtacatatttagatgggtaggatgggtggtaaagttgggctaaggaaaacagggtggaggtcaagattccacttccccagcagtacaaggggtggattatcatatgaaacctcctctaggcgtttgtctttctcaaagagtttggaaagtgccagcctcaatagatctctctgtagcacctaaaccacaaaaataaacctcccagtgccaccaaacacaaataccatgcaagctcggcatgtaggacaggtgggcccatgggtaaagaggcgtgcagcgagctgctgtcactgttctctaggagccagccagctgctatcctgcccagcggtctctctgatggtggtgctggtggtccatgctggcatttgactgttctacaccctgatgctcatatagcaagaaaagtctccatagaaggtgcacagtgttccagactaaactgagagctgcccctatgtaggctgtcggtcatattagggagatagcatgttctggcactgtgaatgttcagcaggaataaaaacactgggttttttttattgtgcacctgaggtccagctcactcctcaatgatgaagggcagcctttcgttgccttataaactggaccttaattcagtctgtctcatgaggattatctttgaatttagtaaggagcaatctgactgctccaagaagaaagttccatgcaaatagctcagggcataatggtcattcctttcattacaggattttgtccacagctgggaagtatctatctgattcctgcagcccccggagcctggctggttttcaggagagcatcttgacagacaagaagaactctgccaagaacccatggcaagaatataattacctccagaaagataaccctgctgaatatgccagtttaatggaaatactttatacccttaaggtatgagaccaaatgaatggcattcttgcaaatgaaaggcttcttctcatcactcaccctctccctctctgggttacaggcgggccctgtgtgtggccctgggctgtgacgtaccctgctactacctctctgtctcatttatgttgggattttaaggagctaagatattaaacttgaaacccattgagatacagatgtagaggttagaagagatggatctttattactgataaaagccaggttagagaatgtggctttaggccaggtgtggtggctcacacctgtaatcccagcactttgggaggccgaggtgggtggatcccctgaggtcaggagtttaagaccagtctggccaacatggtgaaacccggtctctactaaaaatacaaaaattagccaggtgtggtggcacgcacctgtagtcccagctacttgggaggcagaggtgggagaatcacttgaaccagggaggcaccggttacagtgagctaatattgtgccactacactccagcctgggtgacagagcgagactccatctcaaaaaaaaaaaaaaaaaggaaaaaagagaatgtgggtttagatctgcggctagggggacttgctgtaattcactccagaatgaaacttgtcagccggtcagacagagctggacagcccctggccctgttcagggtcagcctcctgagaggggaccagatgtgtactgcttgcaggcaggcagaacctgtaatagaggatcccaacccaggataccaggaggagcaagagaagtcattactcttttccaagggagaagccaggctgcagagtcaccaggagtctacccaagtacaagttcttccacatgggaccatgaggacttggggattggtgttccctcctggtttttttctttaaactcttagtttgcctgccataacgctgcccttgactttgagccccttggggtccagggacaggagaacttcctaacaaatggaatgagtcacacaattccttgggaatggcttccagggtcataagaagaccgtgggcatcctttgcagaactgtcctcctccctcactggtctggctttaacttcactcttggtgatagacagaggagacattgctgttcctggagcaccagatgcagtagaaaattttttcttttgagatggagtctcactctgtcgcctaggctggagtgcagtggcacaatctcggatcactgcaacctctgcctccccgcttcaagcgtttcttctgcctcagcctcctgaatagctgggattataggcatgcgccaccacacctggctaatttttgtatttttagtaaagaaagggtttcaccatattggccaggctggcctcgaactcctgacctcaggtgatctgcctgtctcagcctcccaaagtgctgggattacaggcgtgagccactgcacctggccagatgcagtagaaaattatccacagcctagagctctggaatgaactgcacagggggcctggacatgtctgaggcttcagtgctattctcccagggcctccccatctctttgcaccttgacccaccaactggttgcattgagcttgacaaacacttcgtaaagcaattctggaaactcattcatccatgcttctgtgattaggttaaagcaactctgtttatctttattgctaatctgatttatgtctgttgtaatcagttcatttataataacaaaactaaggttacactttccatctctattttctcaggctatttggaattccttgggactcatggaggttgtacatactttggctttcagccaagtatatttgacctgacctccccgggaattagggctctgtccatcactctgatttatatgtgaagcttctgatcttgtttcccccctctttcccacctcctctatccctgagggatggtcacaggtgaatttttcctaaactgcttgtccatgagctcatgttagcccaagtgcatcagaatcacctgggaaagtgaatttaaaatctagatttctgggctccaaccccagtgaactctgatgcagtagttctggggtggagcttgggaatctgtaattcagcatgttctccagaggggcctggggcacagccaggtttgggaaccactattgcatagaacccccagttctcctgtgagttttcaaaatggttaactagctaatacttgggttgggtttcaggcctaacaactgccttttgcattttcttgtcttaggaaaaagggtcaagcaaccacaacctgctggctgcacctcgagcagcgctgactcggcttaaccagcaggcccaccagctggctttcgattccgtgttcctgcgcatcaaacaacagctgttgcttatttcgaagatggacgtgagtttctcactgaccacatcaatttttcccgggtcctgcctccaactcaagcatactgagtgtgggcttaaccctccctgttccaagagctttgggaagatcccgctttaactttcccaagccggaaagagccactttccaatttcacctcattgcttagcatgaatttcttatctttattgtagttactctgatactttattcacaggcggttctcaggattattaaaattgcttgattaactttccctatttggagcagcagagaagtaatagagattatgtgcagcttcgtaggttaggccaggtcagaagagctaattgtcttttgagattgaattattttcacaccacacgaatcatttctggagaattggttctggaactttactcaggggagtaccttatcagaattgaacttgtgtttttgagggggctttggagggttctgttcctttctttccttgataccttttctgtttggctgtttctagaatcgactcactttcctttcctcacaccctcttctcttttctggttgtccgaattatttttcaaggcattgcctgttctattttctctacttgctgtctttcccctgctccagatcttgttactttccttttggattactgggcgggacagccccctggttaatgtatcttactgacccttcagggccatttggattccagttatgggcctttaataaccaagagatctttttacaaaatgacaagaactcatctggcaaaatcaaacgtgctctcctttctgccaccctctagaaagcctgcaaggctgggagtccagggctcctgcatggtctcagtcaggcctcaccccctcactgggagtcaggattcccatccgtaaaattgctcagttaaacgacatgatcgtgaggttccttctacccttgaagtttgtgattttcactctttatgatttttctgtgcaaaatgccatgagatctatttcaatcagattttgtatttgtagcgcagaaggggacgtaaagtggaggagagctgtagcagaaatgaggcgggtgccatcacatggctgagttattccttcctccgtgagcctccgtttcctcatctgtgtgatggggatatagtaattcttatatagattgatgaggattaagtgagattttgtatattgatagaatttagcatagcactggccacagagtagatgtgtaataagtggtagttttcttcttttctgtgattctcatttttaagaagaatgacttacttgatttttttaaaataaaaattgtataggtatttatttttagaaactcaagcaatacaagaaaatacaaaaaaaaaaaatctaataaatacctccaagatcccaccattgagaaataatcagcgtcagcagtttgatgtccagcaacccagacatctctttctgcacgcctatacatgttaaaggctgattgggcatcagtggatagatctataggaagaaatggaattatactataatgctgtttttaagaaaaacaagatatgcacaatataattttatttgaatttaaccagaaaaaagagacactaaatgaatctaaaggaattattgaacttgagacatttttcttttcttttctctttttttgagactgagtctcactctgtcacccaggctggaatgcagtggcacaatcttggctcactacaacctctgctgcctgggttcaagtgatcctcctgcctcagcttctcgagtagctgggactataggcgcctgccaccactccaggctaatttttgtattttttggtagagacggggtttcgtcaggttgcccaggctggtcttgaactccagacctccagtgattcacccacctcggcctcccaaagtgctgggattacaggcatgagccaccaagcctggtcgagattttttttttttctccacgaaagatactcattccccagaagctctctccaaggttatgaaaaaaagattatgagtatgaagagattggagttgccattgctttttgttaatcctgtttccattgcagacagatactgatacatatgatccattgaaaaacgaaaggattagctttctttgtctctctcctgtcccctccctcacctgcagattgggttgtttgtattatttttattttgtcaaagctgacggtactgaccttctgttctgaaacctcagtgcttcccagcttagttctacatttaaacaggggtggtgcttcccccgtccttttccctctacttctgcattccagagttcattattgatggtggagttcctgggtgcttggccctaccttctcattccggcttcaccacagcaccgtggccccttgggaatgggcgcaggtggctttggagattaggaggagcactccgagggtgccagcacacaataccaaggcaaacactctggccttaaggatttgaaaattaaaccctggtcatcaaatgtttgttttcagcatttgctggtaaattctattgcccttttatattccgagactacaaaccaacgctatatttgatttcaaaatggattattgaagtttacctattttacctggtgacagatggatagaaaagcccatttgaaggacactttaaataaattttgaacaattaaaaaatgacctgcagcatttccctattgccctcaagtgacattctctgctgttttccccccccccttttttttttgagacaaagtctcactctgttgcccaggctggagtgcagtggtgtgatctccactcactgcaacctccgcctcctgggttcaaacacttctcatgcctcagcctcccaagtatctgggactacaggcaagcgtcaccacacccggctaatttttgtatttttagtagaaatggggtttcaccatgtaggccaggctggtctcaaactcctgggctcaagtgatccgcccgcctcagcctctcaaagtgctgggattagaggcatgagccaccgcagccagccatctgctgctttttaagcaccctcctatttcaagccactctgtcttgcgcttcttccaaacttctttcccactccagctgttctttccctctctcctctgcctgttcatgttttgaggctgctcctcctgcctcccctttgaggcctttcctggggcctccaggctgcagtccctgggatggatggcagcagtgcttgtcttcgccctgcacattgttacctgctcttggtctcctggaagccgttgcttctccccacactctgcttcccagcctgtcaccatctgggctcccttgctgcacccctctttgccgacaaaccaccaaggattgctgtcccttccttttctctgtgtcccacacctgtttccacaggggattctcatcatctctgagctgtttttgagcttttcatctgccccccaccccaattttctgcagagctgctgtattcaccttcacaaagcattgttttggttttatctctcctcattcaaaaccctccccagggctagtctgattgtctgtttttagcaacttcttatggaccttttcacgcatacacagaagtagggagaagagtataaggaactccatatactcatcacctgctccaaccatgatccactcctagccatcctgtttcatacataccccctcatctgaaatagaaggactctaaaaataatcacagtaccatagtcaaccctaaaaaagaaaaagaaaaggaattcctaatgtcatcagtgttcaaatttccagttgttttataaatggcataatttattttaaccctttgagtcaggatctaggatccaggatcctgcacgtagagatttattgggatgtcttttttgtcatttttgaatggtaagtttcctctctctttctttttcccttgcaatttacttgttcaaggtaaaggctttacttagcctggtgtttaaagctgtgccttctccctccagcctctgtctgcctctgtgtaccgcatacatcctatggccagccgcttctctaatcgccctgagctcttcttgctccttgcctctgacaccgagagctctagaagtgggaggcagcactcatgtgtctgcaggggggagaggggaggggccagaacaggataggaggtgtgggggtgtacagggtgggagtatgtcagggggtcttgcttccccaagtagctcccttctagagagcaaggagcaaatcttacatttctttgtctcttctctgcaaagcttagcacaagacactcgacatcctgggtacttggtaaatgtggatggttggcgtgttccttctcgctggattgggagttagctggaaaaaatgtaggctcttttgagacaaaagagcattcgcaggcaagaacaaagagtctagaaaactgtaggacaagggttgggggcacctggggtggggaagaaaagagctcatttacatcaaagaaaataagaccgaatcaagtgggcgctagagagcacggggagggctgccgaggctgagcctgggctgggagcccagggttggacatggtcattcctttcccggaatgctacttaaaggatcaggcaaccggatccaacatcaggtggctgcagacagcagttcctacatgaccgccggagtcactcccggagttcagccagaaagggccttgttttccagggctggctttagagtggctcaggttggaagtaagaagcgagatttttgtgtgaaggtgtgccactctgaagtctgtgagcacatgtgcacaggtcctttacccaactctatataaactgctgggaaggcttccacaacaacacggaagatgtttccactccaaatggcaagaaacacgtgttagtgctgaggttctcctcgcacagggggactacagagaggccagaggggcagctgttggggtttggaagtgccgtcccatccccatccctctgagttctgatgagttgagaaacagatccagaaggtggtgagaaataaagcagcagctttagttgaggtaaagcagtattgccgatgaggcttggctcttcctgcagccagaggggcttcctaggtctccctcccagataagagactgacacgtggcctctgtgggggacctcagggtgccctgttctccttagggtgctaaggacccacgaagtagtgaggctgtctgcacccagcacctctctacacagtggccccgctacgcagagaaacttggaccaaaaatatccaactttctcctgttacaatctcagcgagataaatgaaagggatcagttcccaccccacagttcagccaatgtggcagttcctgtttcatggacctgcaggaatgcggagagagaaatcgttgccttctgtatggcgggcttccaggtgaagctttaaagaagagaagcccctgcctgctgagtggtggaggctccaacggtcagctccaaccaaagacagtgcctccagggaaggccatgttcttcttgtgtatttctgggtggcgtcttcacagctgcctggctgctaggtactgattgtgtcctctcgttccacccttagagctggaatacggctggcatcggagaaaccctcacagatgaactgcccgcctttagtctcacccctctcgagtacatcagcaacgtaagagcttctgtgtgcttctccagggtggtccaagtctttcagaccttccttgtcttttgattcttgcccttatagtcatttccccatgggtgctatctgacccttttgggtagcctgtgctttggggtagtctgcacccagatcctggactttaagaagatcagcagagccacatggcgattccagaccccagcacattctcactccttcaccatctctccctatatgagatgtggccagtacctgagggcgtcagagttgagagtctaatgggaaattctgacttgggaagacaggaggcagatggccaattcttctctgtgactttcagaagagtagtgtgtgtttgtggttgtgaattcaaattcagccagcttttagtgatcacctactatgtgccaggctctgtgtggagtgctttcatgtttaacttcatagcaacaaacaaatctcttcagaagaattgcagttatagaggcttaatattaaaagagaacagaataaaccatgcaggggaatgggggcacgtggagtccttgctgccctccccattcacccctgggaattgacagtcacccagacacctgcacatggcctttccttccgttacttcctgcagtctagctcaggtgctcttaaatgtcagtgcgcacaagaaacactatagaggagtaatatgtgccaaaccacactcacctcacacaatgggagatttctgagacttttcaaggtgatttctgccttacgctcttgccttagaatccaacccctatgtgtaagttgtgactctgccaaaatgactagaaaggaattttagaagtattataaatgttaggctgggcatggtggctcatgcttatagtcacagcactttgggaggtagaggcgagagaattgcttgagcccaaaaatttgaaaccagtctgggcaacatagggggaccccgcctctacaaaaaagtaaaaaattatccaggcatggtggtgtgtcctgtggtcccagctacttggggtgctgaggtgggagaatcgcttgagcccaggaggtcgacgctgcagtgagctgtgattgcaccactgcactcctgcctgggccacacagcaaccccctgcctcaggaaaaaaaaagaaaaaagtacatgttgtataattgcaagaagtgcatggcagtccctctggcaggcagtgaggtggctggctctctgctctctgttcatttggggcagtatcaagtctaaaacaacagtcatttcccttctatttcccagggcacctgataccctctactgatgaaactgttaagatgtgggttggtctttacaacccatgggaataatctgattttatttttatttatttatttatttttgagatggagcctctgtcacccaggctggagtgcagtggcgcgatcttggcccactgcaactttggcctcctagattcaagtgattctcctgctacagccttccgagtagctgggattacaggcgcccaccaccacacctggctaatttttctatttttagtagatacagggtttcgtcatgttgaccaggctggtctcaaactcctgacctgaagtgatctgcccaccttggcctcccaaagtgctgagtttacaggcatgagtcactgtgcccggctgaatgatctgattttagagcagagatagtatgcttgcagtctaaattgattcagaaaatgatggtgctggaagggacctgagtggctaccaagttgattctaaagttgaagaaactgaggtctagagagggaatgagggctaggaggagtttccaggcccgggcccttccctgcctgctgctgtcctcctgagctgtacggaggctgatgacctgaacccaggaaaggaacacctaattgaacacgtactgtgtgcagagacagtgccaggttgtttagtggctgggccagatcatgtccatgagacaggtgtggcagccctccttcacagtgggagtggggctgggaggaagcagcgacttacccagtggctgctctgttaggacgccagctgctttacgtgcatagcacacgtattaattctaccctcaccacaaccttttgaagtaatatgaggtcatcctcatttcagcgatgatgatccgaggtcctgacagattaagttgcccaggttctcacagtgatagagccaaaactccaacccaagtctgtctgacctcaaaacttttcatttttcccaagtcagtgagttaacccaaccaggatatcaagaaatattgattgcatatgtgagaatagtagacaaatacccacaggtgggatgctaagcagccctttccatattgatttccaaggagtgaatagagacaagatccctgagagaaacctgcactgtgagatctaggaaccccagcaatccctacagtctaaggccaattgattgaagttagagatgtcagattactgaaatttttcacctaaatgatactttgccttgttggtgaaagccctcacccacacagaatcatgtgagcattgtaaagagatgaaataggagaaaatgctttgaaatttaaaaacaatatatatgcaaggtaaaactgagtctgtggacttagccaaagcttatggctacagatgaaaggtataccaaatataggagtatgtctggggtctttgtacgtagtaggtgttcaggaagggcttgttgagaggaattattgtagtacagagaaattccaacaccagaaatcagcatccttctcttcccccagccttggggaaaaatgatgaatttgttaacacttcaagctgaaatttacagtagctgttgttattagtgaggtaagtggccacttgcttactttgggtgaaagattatactaagtacatgaaagaaaaaaatgatttattttaccatctgtgtacctcttataaagggacgccagtccaggcacagtgggtcacgcttgtaatcccagcactttgggaggccgaggtgggcggatcacctgaggtcaggagttcaagaccagcctggccaacatggtaaaaccccgtctctactaaaaatacaaaaaaaattagccaggtgtggtggtgggcacttgtaatcccagctactcgggaggctgaggcaggagaattgcttgaacccaggaggcggaggttgcagtgagccgagattgcaccattgcactccagcctgggcaacaagagcaaaactctgtctcaaaaaaaaaaaagaaaaaagaaaaaaggaacaccaaactaataatggatgtttacacttacacagccaaaccatattgaatgtttggaaagaagggcatgatcatcctgtagttctctggtctgggtagattttcgagtctgtgttaacttctggacactacaccctgaaaggagcccgctgttacgtagacatgtgtgaggccagattgagaagctcttgctttgatagtctcctgacttttagtttacagagttaattaacagtgacaggaatgtcatggaatgaatatgtagcaggaagaaaaaaaaaacaacaacaggcagaaagaccttttaaaaacatatattatcattttgaaacctgaaaagtcaacccccttattttgaaacaaaacacatacttaaccttaaaacacaaaacaatgaattacaatagaaataggaaacagtggtctaaaatacactcttggcatcacgtggatatctgacaaacacatgaccaagactgtgctaattgtgggcatgtcctaaatgtcttttaggacaattgcaaatgaccttttgcaattccccaccagccaaggttttgtctatctttagtttcaagagtttatattatgaaaacaatatagttttttctccaaagtaatttatagttataaatggctttttttcaaacagaattcctttcttcttctggttaaattatctaggagggagagaatcagatccaaatccagaagacaggttttttttttttttttctgagacagagtctctttttttttgagacagagtctgcccaggctgcagtgcaatggcatgatcttggctcactgcaacctccgcccccgccgagttcaagtgattttcctgcctcagcctcccgagtagctgggattacaggtgcctgccaccatccccggctaatttttgtacttttagtaggatagggcttcaccatgttggccaggctggtcttgaactcctgacctcaggagatccatccgcctcggcctcccaaagtgctgggattacaggtgtgagccactgtgcctggcctcagaagacaggatttgaattcttgcttggccccacacattctgacactagtatcttactggtttttcacctatgaacagtaataatacttatatttacacaatgcttcaaattttacaaagcattttgatatccattacttcattggagatagagattgtgttgaatgcatttcaaaaatattgaggtcattataagaaggatgaatctataatctatatgcaagctaccagtgattcttttttagggtactgccataacaagcatcgccacatactagaaagatcagacttgggatcacccgaggtctagcaattttgtctctctgccgtttgccttcacacaaatgtacccataaagtaataacccgtatgtgtcaatgtcaggctaacagcgctttcttttgtttcagatcgggcagtacatcatgtccctccccctgaatcttgagccatttgtgactcaggaggactctgccttagagttggcattgcacgctggaaagctgccatttcctcctgagcagggtaagcggggaccgtttctggcgatgttacaagtcaagctgtcagtttccagggtagaaactccagatgacaccttatccttgggctcatttgtcaccaagtcctgtttttttttaaccttctaacatgtactttttgtacacatgctgtatctaaaacaatatcacaacttgaaaaatctataaccacatcccactgcggaacgcactggtatttccactttcgcttgtgccttctggctctgctctgtaagcagatggtattttgtatgtaactttgtattctgtattattgttattattgagacagagtcttgctgtgtcacctaggctggagtgcagtggcgcgatcttgactcaccacaacctccgcctcctgggttcaagcaattctcctgcctcagcctcctgagtagctgggactacaggcgcgcaccaccacgcctggctaatttttgtatttttagcagagacgggggtttcaccatgttggccaggctggtctcgaacttctgacctcaaatgatccgcctgcctcatcctcctaaagtgctgggattacaggcatgagccactgcacctggccctaagatgtaactgttttcggtttcctgtgtttgccattgagatcagaagcttcctggtactttggtgcattcagcagctactgcaggcctgtgttttccttggtgacctccttttcttttcaggggatgaattgcccgagctggacaacatggctgacaactggctgggctcgatcgccagagccacaatgcagacctactgtgatgcgatcctacagatccctgagctgagcccacactctgccaagcagctggccactgacatcggtgggtccccacaagacaggcggtgggagggacagctcttgcctgctgcatctgtcagtttctcctttgccctccaggaatctcatcccaagtcttcccttagcttcagctgtggatttggctctgaagctggttgaaaattcaggttctccaggccctgccccagagattctgacttagcaagaccgggctgaagctcagacatctatgttttcgaagaggacttgagaaccgttgaggggagcttcagtgagataagattcagcgagtcctgcagcctggccccacctggcccgctccatttgtgccataattcccaaccagtgtttaatgagctcttactgcataccaggcatgcctggcgctggaccaagcactcgcacccatcgtcttatgtaattccaaactcccctgtgaggtgggtgctctcttctccatcataccgatagggaacggaggcccagggcagttccataacaaggccatgtggccagggtcactttgtggtctccatccagatagcatcctgcctgccaagtcagtgggcgtgtcccctttgctcctgcctgccctcttcactggagggcctcactgcccaggtgtactctgagcatggggctactgctggcaggtggcagggagtctccccagtctcttgatgccattccaataccttgtctgctctttagcctaacgcacctctcggggtggtcaggagagcgggtggtagaagcctgaaagatcagctccctggggacacagccagagcttcgtcctcagtgaccacagggctgagccaggctcaaccggcttctggctcttgttttgcagaagaagaactagaagcaaggtgctttcctccgggtcccagagctgttagtgatggagccaggcctgggatccagctttcctgagttcctgacccctgctcatttcatagtcagctctcagcacttaccagaggaacaggcagccttttggctactgcccttcagagaaagagagatgagagaattcaaatgcgtgttggtgttccctgttagtacaagcagcagcagggggaagaactggaactagtgagtggagtgaaatctagggattgcccctcagtttcagttgtccttgttattcctccctgttaagctccccctgcagattcatttcttcactcattcagcattgctcgagcatctgtgtgccagctgtagttctaggagatagagacaacaaagctttaggcagctcccatgcttagtgagcttacactgtaaggatgtacggttaggggcagggaaggtaaggctagtatatgaaactgacagggtataaggcgacagagtggtgaggtctgtggcaaagcatgcacacctgaaagacattcaaattaagcatgagcacaaacagaacaaaaaacactgctcgccaaacaaaaatgtcctagtagactgtgggcccgctctttgcagctcttggctgacagtcaagtggagctcacggttttatggataaacttgtaaaggagtaagtacgtgcctggcggcacctttgctgggaagcagctcttcctgagtcagccgtgacagagcaggcatctcctcctggccctgccctgagtggggcctaaaaagaaaacacagggggctgggcaccatggctcatgcctgtaatcccagcactttgggaggccgaggcaggaggatcgcttgggcctaggagtttgaggccaacctgggcaacatagtgagaccctgtctctacaaaatattaaaaacaaaacaaaacaaaaaacacaaggaaagttgaggccttgcctggagctccactttagtcaaggagaagagatgaacccaagatcagaaagtagccggtgggggggcactgagcgcggtggctcatgcctgtaatcccagcactttgggaggctgaggtgggtggatcacctcaggtcagaagtttgagaccagtctggccaacatggcgaaaccccgtctctactaaaaatacaaaaaattagccaggcgtggtggtaggcgcctgtaatcccatctacttgagaggctgaggtaggagaattgcttgaacccaggaggcggaggttgcagtgagccgagatcgcagcattgcactccagcctgggcaacaagagtgaaactctgtctcagaaaagaaaaaaaaaaaaaaaaaaaaaactagccaggggcatatcgggtggtgctgtcttctagtctttccaagcatgaactgggaggagctggagaaggctttgcaaggcttcccttgggttgggttgcactgcccaggcaggagggaaaggcagcattgatatattgatcacctgcgacacatcaggtgctctcatgttcgtttcccgcttcatcccctatccatgctgccggatgggtggtaactgtggacagatggaagcagagactcagggaggtagaagggcttctctgaggtcacacctggctgcacctggtttgctcccccatgctgtctgttttgcccaagcttgcctggtggttagaaccaccggggtcgctttgtagaatgacagaaccctagaatcctctcttgggatgctcatcaacctagtctgggggtaggctcagaaatctgtatccgattgtatccccagtgcctcaggggtcatctgggaaatgtggaaacctgtgttataccagggtcccaccccagacactgtccttgtcttcactgcggcgttctgactggaggtctttagtaactgctcagacaagcttgtgtgtctcctgaccctctgggttttccaagtggtcagtggataccctgggggccagggcttggaacccaggagtccccagaacagagctttgggtgaggtcagctggtccttcagactggtgctgaaggcgggtgtgtgcatgtgagtgtgagtgtggatgtgagagtgtgtgcatgtgagtgtgtgtacatgtgagtgtgtgtgcgagtttgtgtgagtttggatgtgagagtgtgtgtgcgtgtgtgtgcatgtgagtgtgtatgtgtgtggttggggatgggagtgatgttggttagttctttattaaattagagttcctagactcgagccaagctcacagtctggtctgacactgtgggaagaacctggtgagtaaagggcctattgagggcagggttggcgccccacatctagggacttggcagggcagcttctctgtgtcgtattcaggggaggccctgtggggctctgacctgcttggtgctgagtctgtggagctctgtctgtctcctctccgcccccacagactatctgatcaacgtgatggatgccctgggcctgcagccgtcccgcaccctccagcacatcgtgacgctactgaagaccaggcctgaggactatagacaggtcagcaaaggcctgccccgtcgcctggccaccaccgtggccaccatgcggagtgtgaattactgaccccaccacacaccggaccaccaagagagccagggctgctgtttcgcgactcaccagcacagatttgctcagaaactctgcccaagattgggcagaagttactttaaaaagacttggttcagctggtcacggtggctcacgcctgtaatcccagcactttgggaggccaagccagatggatcatgaagccaggagttcgagaccagcctgaccaacatggtgaaaccccatctctactaaaaatacaaaaattaacagcagagcgagactctgtctc
